United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 76

SEQ ID NO: 145462 - DNA, 3399 bp, Artificial Sequence
  Description of Artificial Sequence: Synthetic coding sequence
atgggcgccaatgccagcaactacccccacagctgcagcccccgggtgggcggcaacagccaggcccagcagaccttcatcggcaccagcagctacagccagcagggctacggctgtgagagcaagctgtacagcctggaccacggccacgagaagccccaggacaagaagaagaggaccagcggcctggccaccctgaagaagaagttcatcaagaggaggaagagcaacagatctgctgaccacgccaagcagatgagggagctgctgagcggctgggatgtgagagatgtgaatgccctggtggaggagtatgagggcaccagcgccctgaaggagctgagcctgcaggccagcctggcccggcctgaggcccggaccctgcagaaggacatggctgacctgtatgagtacaagtactgcacagatgtggacctgatcttccaggagacctgcttccctgtgcaccgggccatcctggccgcccgctgccccttcttcaagaccctgctgagcagcagcccagaatatggagctgagatcatcatggacatcaacacagctggcatcgacatgcccatgttcagcgccctgctgcactacctgtacaccggggagtttggcatggaggacagccgcttccagaatgtggacatcctggtgcagctgtctgaggagtttggcacccccaacagcctggatgtggacatgaggggcctgtttgactacatgtgctactatgatgtggtgctgtccttcagcagtgacagcgagctggtggaggcctttggaggcaaccagaactgcctggatgaggagctgaaggcccacaaggctgtgatcagcgcccggagccccttcttcaggaacctgctgcagaggcgcatcagaactggagaggagatcacagacaggaccctgcggacccccacccgcatcatcctggatgagagcatcatccccaagaagtatgccaccgtcatcctgcactgcatgtacacagatgtggtggacctgtctgtgctgcactgcagccccagcgtgggcagcctgtctgaggtgcaggccctggtggccggcaagcccaacatgaccagggctgaggaggccatggagctgtaccacatcgccctcttcctggagttcaacatgctggcccagggctgtgaggacatcatcgccgagagcatcagcctggacaccctgattgccatcctgaagtggagcagccacccctacggcagcaagtgggtgcaccggcaggccctgcacttcctgtgtgaggagttcagccaggtgatgaccagtgatgtgttctatgagctgagcaaggaccacctgctgacagccatccagagcgactacctgcaggccagcgagcaggacatcctgaagtacctgatcaagtggggcgagcaccagctgatgaagagaattgctgaccgggagcccaacctgctgagcggcacagcccacagcgtgaacaagaggggcgtgaagagaagagacctggacatggaggagctgcgggagatcctgagcagcctgctgccctttgtgcgcatcgagcacatcctgcccatcaacagcgaggtgctgagtgatgccatgaagaggggcctcatcagcaccccacccagcgacatgctgcccaccacagaaggaggcaagagcaatgcctggctgcggcagaagaatgccggcatctacgtgcggcccaggctcttcagcccctacgtggaggaggccaagtctgtgctggatgagatgatggtggagcagacagacctggtgcggctgaggatggtgaggatgagcaatgtgcctgacaccctgtacatggtgaacaatgctgtgccccagtgctgccacatgatcagccaccagcagatcagcagcaaccagagcagcccccccagcgtggtggccaatgagatccctgtgccccggctgctgatcatgaaggacatggtgcggcggctgcaggagctgcggcacacagagcaggtgcagagggcctatgccctgaactgtggggagggcgccaccgtgtcctatgagatccagatccgggtgctgcgggagtttggcctggctgatgctgctgctgagctgctgcagaacccccacaagttcttcccagatgaaagatttggagatgagagccccctgctgaccatgaggcagcccggccgctgccgggtgaacagcaccccacctgctgagaccatgttcacagacctggacagctttgtggccttccacccccccctgcccccacctcctccaccctaccaccccccagccacccccatccacaaccagctgaaggccggctggaagcagaggcctcccagccagcaccccagccgctccttctcctacccctgcaaccacagcctcttccacagcaggacagcccccaaggccggccccccacctgtgtacctgcccagcgtgaaggccgcccccccagactgcaccagcacagctggcctgggccggcagacagtggccgctgctgctgccaccaccaccagcacagccacagctgctgctgctgctgccagcgagaagcaggtgaggacccagcctgtgctgaatgacctgatgccagacattgctgtgggcgtgtccaccctgagcctgaaggaccggcggctgcctgagctggccgtggacacagagctgagccagagcgtgtctgaggccggccctggccccccccagcacctgagctgcatcccccagaggcacacccacaccagcaggaagaagcacaccctggagcagaagacagacacccgggagaacccccaggagtacccagacttctatgacttcagcaatgctgcctgccggcccagcaccccagccctgagcaggaggacccccagccccagccagggcggctactttggaccagacctgtacagccacaacaaggccagccccagcggcctgaagagcgcctacctgcccggccagaccagccccaagaagcaggaggaggcccggcgggagtaccccctgagcccagatggccacctgcaccggcagaagaatgagcccatccacctggatgtggtggagcagcccccccagaggagtgacttccccctggccgccccagaaaatgccagcactggacctgcccacgtgcggggccgcacagctgtggagacagacctgaccttcggcctgacccccaaccggcccagcctgagcgcctgcagcagcgaggcccctgaggagaggtctggaagaaggctggccgacagcgagagcctgggccatggagcccagaggaacacagacctggagcgggaggacagcatcagccggggcagaagaagccccagcaagccagacttcctgtacaagaagagcgccctgtag

SEQ ID NO: 145463 - DNA, 2121 bp, Artificial Sequence
  Description of Artificial Sequence: Synthetic coding sequence
atgtacacagatgtggtggacctgtctgtgctgcactgcagccccagcgtgggcagcctgtctgaggtgcaggccctggtggccggcaagcccaacatgaccagggctgaggaggccatggagctgtaccacatcgccctcttcctggagttcaacatgctggcccaggagcccaacctgctgagcggcacagcccacagcgtgaacaagaggggcgtgaagagaagagacctggacatggaggagctgcgggagatcctgagcagcctgctgccctttgtgcgcatcgagcacatcctgcccatcaacagcgaggtgctgagtgatgccatgaagaggggcctcatcagcaccccacccagcgacatgctgcccaccacagaaggaggcaagagcaatgcctggctgcggcagaagaatgccggcatctacgtgcggcccaggctcttcagcccctacgtggaggaggccaagtctgtgctggatgagatgatggtggagcagacagacctggtgcggctgaggatggtgaggatgagcaatgtgcctgacaccctgtacatggtgaacaatgctgtgccccagtgctgccacatgatcagccaccagcagatcagcagcaaccagagcagcccccccagcgtggtggccaatgagatccctgtgccccggctgctgatcatgaaggacatggtgcggcggctgcaggagctgcggcacacagagcaggtgcagagggcctatgccctgaactgtggggagggcgccaccgtgtcctatgagatccagatccgggtgctgcgggagtttggcctggctgatgctgctgctgagctgctgcagaacccccacaagttcttcccagatgaaagatttggagatgagagccccctgctgaccatgaggcagcccggccgctgccgggtgaacagcaccccacctgctgagaccatgttcacagacctggacagctttgtggccttccacccccccctgcccccacctcctccaccctaccaccccccagccacccccatccacaaccagctgaaggccggctggaagcagaggcctcccagccagcaccccagccgctccttctcctacccctgcaaccacagcctcttccacagcaggacagcccccaaggccggccccccacctgtgtacctgcccagcgtgaaggccgcccccccagactgcaccagcacagctggcctgggccggcagacagtggccgctgctgctgccaccaccaccagcacagccacagctgctgctgctgctgccagcgagaagcaggtgaggacccagcctgtgctgaatgacctgatgccagacattgctgtgggcgtgtccaccctgagcctgaaggaccggcggctgcctgagctggccgtggacacagagctgagccagagcgtgtctgaggccggccctggccccccccagcacctgagctgcatcccccagaggcacacccacaccagcaggaagaagcacaccctggagcagaagacagacacccgggagaacccccaggagtacccagacttctatgacttcagcaatgctgcctgccggcccagcaccccagccctgagcaggaggacccccagccccagccagggcggctactttggaccagacctgtacagccacaacaaggccagccccagcggcctgaagagcgcctacctgcccggccagaccagccccaagaagcaggaggaggcccggcgggagtaccccctgagcccagatggccacctgcaccggcagaagaatgagcccatccacctggatgtggtggagcagcccccccagaggagtgacttccccctggccgccccagaaaatgccagcactggacctgcccacgtgcggggccgcacagctgtggagacagacctgaccttcggcctgacccccaaccggcccagcctgagcgcctgcagcagcgaggcccctgaggagaggtctggaagaaggctggccgacagcgagagcctgggccatggagcccagaggaacacagacctggagcgggaggacagcatcagccggggcagaagaagccccagcaagccagacttcctgtacaagaagagcgccctgtag

SEQ ID NO: 145464 - DNA, 2346 bp, Artificial Sequence
  Description of Artificial Sequence: Synthetic coding sequence
atggccggcggggccggggccggggctgatggaggagctgggggcggcggcggcggcggagatggcagcggccccagcggcagcagcagcggcggccgcagcctgcggggctgtgaggacatcatcgccgagagcatcagcctggacaccctcatcgccatcctgaagtggagcagccacccctacggcagcaagtgggtgcaccggcaggccctgcacttcctgtgtgaggagttcagccaggtgatgaccagtgatgtgttctatgagctgagcaaggaccacctgctgacagccatccagagcgactacctgcaggccagcgagcaggacatcctgaagtacctgatcaagtggggcgagcaccagctgatgaagagaattgctgaccgggagcccaacctgctgtctggaacagcccacagcgtgaacaagaggggcgtgaagaggcgggacctggacatggaggagctgcgggagatcctgagcagcctgctgccctttgtgagaattgagcacatcctgcccatcaacagcgaggtgctgagtgatgccatgaagaggggcctcatcagcaccccacccagcgacatgctgcccaccacagagggcggcaagagcaatgcctggctgcggcagaagaatgccggcatctacgtgcggcccaggctcttcagcccctacgtggaggaggccaagtctgtgctggatgagatgatggtggagcagacagacctggtgcggctgaggatggtgaggatgagcaatgtgcctgacaccctgtacatggtgaacaatgctgtgccccagtgctgccacatgatcagccaccagcagatcagcagcaaccagagcagccccccatctgtggtggccaatgagatccctgtgccccggctgctgatcatgaaggacatggtgcggcggctgcaggagctgcggcacacagagcaggtgcagagggcctatgccctgaactgtggggagggcgccaccgtgtcctatgagatccagatccgggtgctgcgggagtttggcctggctgatgctgctgctgagctgctgcagaacccccacaagttcttcccagatgaaagatttggagatgagagccccctgctgaccatgaggcagcccggccgctgccgggtgaacagcaccccacctgctgagaccatgttcacagacctggacagctttgtggccttccacccccccctgcccccacctcctccaccctaccaccccccagccacccccatccacaaccagctgaaggccggctggaagcagaggcctcccagccagcaccccagccgctccttctcctacccctgcaaccacagcctcttccacagcaggacagcccccaaggccggccccccacctgtgtacctgcccagcgtgaaggccgcccccccagactgcaccagcacagctggcctgggccggcagacagtggccgctgctgctgccaccaccaccagcacagccacagctgctgctgctgctgccagcgagaagcaggtgaggacccagcctgtgctgaatgacctgatgccagacattgctgtgggcgtgtccaccctgagcctgaaggaccggcggctgcctgagctggccgtggacacagagctgagccagagcgtgtctgaggccggccctggccccccccagcacctgagctgcatcccccagaggcacacccacaccagcaggaagaagcacaccctggagcagaagacagacacccgggagaacccccaggagtacccagacttctatgacttcagcaatgctgcctgccggcccagcaccccagccctgagcaggaggacccccagccccagccagggcggctacttcggccctgacctgtacagccacaacaaggccagccccagcggcctgaagagcgcctacctgcccggccagaccagccccaagaagcaggaggaggcccggcgggagtaccccctgagcccagatggccacctgcaccggcagaagaatgagcccatccacctggatgtggtggagcagcccccccagaggagtgacttccccctggccgccccagaaaatgccagcacaggccctgcccacgtgcggggccgcacagctgtggagacagacctgaccttcggcctgacccccaaccggcccagcctgagcgcctgcagcagcgaggcccctgaggagaggagcggccggcggctggccgacagcgagagcctgggccacggggcccagaggaacacagacctggagagagaagattccatcagccggggccgccgcagccccagcaagccagacttcctgtacaagaagagcgccctgtag

SEQ ID NO: 145465 - DNA, 168 bp, Artificial Sequence
  Description of Artificial Sequence: Synthetic coding sequence
atgggcgccaatgccagcaactacccccacagctgcagcccccgggtgggcggcaacagccaggcccagcagaccttcatcggcaccagcagctacagccagcagggctacggctgtgagagcaagctgtacagcctggaccacggccacgagaagccccaggactag

SEQ ID NO: 145466 - DNA, 1635 bp, Artificial Sequence
  Description of Artificial Sequence: Synthetic coding sequence
atgagggagagccagcctgaggccgagatccccctgcaggacaccacagctgaggccttcaccatgctgctgaagtacatctacacaggccgggccaccctgacagatgagaaggaggaggtgctgctggacttcctgagcctggcccacaagtatggcttccctgagctggaggacagcaccagcgagtacctgtgcaccatcctgaacatccagaatgtgtgcatgacctttgatgtggccagcctgtacagcctgcccaagctgacctgcatgtgctgcatgttcatggacagaaatgcccaggaggtgctgagcagcgagggcttcctgagcctgagcaagacagccctgctgaacatcgtgctgcgggacagctttgctgcccctgagaaggacatcttcctggccctgctgaactggtgcaagcacaacagcaaggagaaccacgccgagatcatgcaggccgtgcggctgcccctgatgagcctgacagagctgctgaatgtggtgcggcccagcggcctgctgagcccagatgccatcctggatgccatcaaggtgcgctctgagagccgggacatggacctgaactaccggggcatgctgatcccagaagaaaatattgccaccatgaagtacggggcccaggtggtgaagggggagctgaagagcgccctgctggatggagacacccagaactatgacctggaccacggcttcagccgccaccccattgatgatgactgccgcagcggcatcgagatcaagctgggccagcccagcatcatcaaccacatccgcatcctgctgtgggaccgggacagccgcagctacagctacttcatcgaggtgtccatggatgagctggactgggtgcgggtcatcgaccacagccagtacctgtgccgctcctggcagaagctgtacttccctgcccgggtgtgccgctacatcagaattgtgggcacccacaacacagtgaacaagatcttccacatcgtggcctttgagtgcatgttcaccaacaagaccttcaccctggagaagggcctgattgtgcccatggagaatgtggccaccatcgctgactgtgcctctgtgattgaaggagtgagccgcagcagaaatgccctgctgaatggagacaccaagaactatgactgggacagcggctacacctgccaccagctgggcagcggggccatcgtggtgcagctggcccagccctacatgattggcagcatccggctgctgctgtgggactgtgatgacaggagctacagctactacgtggaggtgtccaccaaccagcagcagtggaccatggtggccgacaggaccaaggtgtcctgcaagtcctggcagagcgtgacctttgagcggcagcctgccagcttcatccgcatcgtgggcacccacaacacagccaatgaggtgttccactgtgtgcactttgaatgtcctgagcagcagagcagccagaaggaggagaacagcgaggagagcggcactggagacaccagcctggccggccagcagctggacagccacgccctgcgggcccccagcggcagcagcctgcccagcagccctggcagcaacagccgcagccccaaccggcagcaccagtag

SEQ ID NO: 145467 - DNA, 1839 bp, Artificial Sequence
  Description of Artificial Sequence: Synthetic coding sequence
atgagcaacagccaccccctgcggcccttcaccgctgtgggggagattgaccacgtgcacatcctgtctgagcacatcggggccctgctgattggagaggagtatggagatgtgacctttgtggtggagaagaagcgcttccctgcccacagggtcatcctggccgcccgctgccagtacttccgggccctgctgtatggaggcatgagggagagccagcctgaggccgagatccccctgcaggacaccacagctgaggccttcaccatgctgctgaagtacatctacacaggccgggccaccctgacagatgagaaggaggaggtgctgctggacttcctgagcctggcccacaagtatggcttccctgagctggaggacagcaccagcgagtacctgtgcaccatcctgaacatccagaatgtgtgcatgacctttgatgtggccagcctgtacagcctgcccaagctgacctgcatgtgctgcatgttcatggacagaaatgcccaggaggtgctgagcagcgagggcttcctgagcctgagcaagacagccctgctgaacatcgtgctgcgggacagctttgctgcccctgagaaggacatcttcctggccctgctgaactggtgcaagcacaacagcaaggagaaccacgccgagatcatgcaggccgtgcggctgcccctgatgagcctgacagagctgctgaatgtggtgcggcccagcggcctgctgagcccagatgccatcctggatgccatcaaggtgcgctctgagagccgggacatggacctgaactaccggggcatgctgatcccagaagaaaatattgccaccatgaagtacggggcccaggtggtgaagggggagctgaagagcgccctgctggatggagacacccagaactatgacctggaccacggcttcagccgccaccccattgatgatgactgccgcagcggcatcgagatcaagctgggccagcccagcatcatcaaccacatccgcatcctgctgtgggaccgggacagccgcagctacagctacttcatcgaggtgtccatggatgagctggactgggtgcgggtcatcgaccacagccagtacctgtgccgctcctggcagaagctgtacttccctgcccgggtgtgccgctacatcagaattgtgggcacccacaacacagtgaacaagatcttccacatcgtggcctttgagtgcatgttcaccaacaagaccttcaccctggagaagggcctgattgtgcccatggagaatgtggccaccatcgctgactgtgcctctgtgattgaaggagtgagccgcagcagaaatgccctgctgaatggagacaccaagaactatgactgggacagcggctacacctgccaccagctgggcagcggggccatcgtggtgcagctggcccagccctacatgattggcagcatccggctgctgctgtgggactgtgatgacaggagctacagctactacgtggaggtgtccaccaaccagcagcagtggaccatggtggccgacaggaccaaggtgtcctgcaagtcctggcagagcgtgacctttgagcggcagcctgccagcttcatccgcatcgtgggcacccacaacacagccaatgaggtgttccactgtgtgcactttgaatgtcctgagcagcagagcagccagaaggaggagaacagcgaggagagcggcactggagacaccagcctggccggccagcagctggacagccacgccctgcgggcccccagcggcagcagcctgcccagcagccctggcagcaacagccgcagccccaaccggcagcaccagtag

SEQ ID NO: 145468 - DNA, 1635 bp, Artificial Sequence; identical to SEQ ID NO: 145466
  Description of Artificial Sequence: Synthetic coding sequence

SEQ ID NO: 145469 - DNA, 1839 bp, Artificial Sequence; identical to SEQ ID NO: 145467
  Description of Artificial Sequence: Synthetic coding sequence

SEQ ID NO: 145470 - DNA, 279 bp, Artificial Sequence
  Description of Artificial Sequence: Synthetic coding sequence
atgagcaacagccaccccctgcggcccttcaccgctgtgggggagattgaccacgtgcacatcctgtctgagcacatcggggccctgctgattggagaggagtatggagatgtgacctttgtggtggagaagaagcgcttccctgcccacagggtcatcctggccgcccgctgccagtacttccgggccctgctgtatggaggcatgagggagagccagcctgaggccgagatccccctgcaggacaccacagctgaggccttcaccatgctgctgtag

SEQ ID NO: 145471 - DNA, 1749 bp, Artificial Sequence
  Description of Artificial Sequence: Synthetic coding sequence
atgtgccgggccctgctgtatggaggcatgagggagagccagcctgaggccgagatccccctgcaggacaccacagctgaggccttcaccatgctgctgaagtacatctacacaggccgggccaccctgacagatgagaaggaggaggtgctgctggacttcctgagcctggcccacaagtatggcttccctgagctggaggacagcaccagcgagtacctgtgcaccatcctgaacatccagaatgtgtgcatgacctttgatgtggccagcctgtacagcctgcccaagctgacctgcatgtgctgcatgttcatggacagaaatgcccaggaggtgctgagcagcgagggcttcctgagcctgagcaagacagccctgctgaacatcgtgctgcgggacagctttgctgcccctgagaaggacatcttcctggccctgctgaactggtgcaagcacaacagcaaagaaaatcatgctgagatcatgcaggccgtgcggctgcccctgatgagcctgacagagctgctgaatgtggtgcggcccagcggcctgctgagcccagatgccatcctggatgccatcaaggtgcgctctgagagccgggacatggacctgaactaccggggcatgctgatccctgaggagaacatcgccaccatgaagtatggagcccaggtggtgaagggggagctgaagagcgccctgctggatggagacacccagaactatgacctggaccacggcttcagccgccaccccattgatgatgactgccgctctggaattgagatcaagctgggccagcccagcatcatcaaccacatccgcatcctgctgtgggaccgggacagccgcagctacagctacttcatcgaggtgtccatggatgagctggactgggtgcgggtgattgaccacagccagtacctgtgccgctcctggcagaagctgtacttccctgcccgggtgtgcagcggagatggagtgtccctgtggtgccccctgtggagcaggaccccagagctgaagcagagcagcctgctgggcctgcccaagtgccgctacatcagaattgtgggcacccacaacacagtgaacaagatcttccacatcgtggcctttgagtgcatgttcaccaacaagaccttcaccctggagaagggcctgattgtgcccatggagaatgtggccaccatcgctgactgtgcctctgtgattgaaggagtgagccgcagcagaaatgccctgctgaatggagacaccaagaactatgactgggacagcggctacacctgccaccagctgggcagcggggccatcgtggtgcagctggcccagccctacatgattggcagcatccggctgctgctgtgggactgtgatgacaggagctacagctactacgtggaggtgtccaccaaccagcagcagtggaccatggtggccgacaggaccaaggtgtcctgcaagtcctggcagagcgtgacctttgagcggcagcctgccagcttcatccgcatcgtgggcacccacaacacagccaatgaggtgttccactgtgtgcactttgaatgtcctgagcagcagagcagccagaaggaggagaacagcgaggagagcggcactggagacaccagcctggccggccagcagctggacagccacgccctgcgggcccccagcggcagcagcctgcccagcagccctggcagcaacagccgcagccccaaccggcagcaccagtag

SEQ ID NO: 145472 - DNA, 2211 bp, Artificial Sequence
  Description of Artificial Sequence: Synthetic coding sequence
atgagcctgtctgaaaattctgtgtttgcctatgagagctctgtgcacagcaccaacgtgctgctgagcctgaatgaccagaggaagaaggatgtgctgtgtgatgtgaccatctttgtggagggccagcgcttccgggcccacaggtctgtgctggccgcctgcagcagctacttccacagcagaattgtgggccaggctgatggagagctgaacatcaccctgcctgaggaggtgacagtgaagggctttgagcccctcatccagtttgcctacacagccaagctgatcctgagcaaagaaaatgtggatgaggtgtgcaagtgtgtggagttcctgtctgtgcacaacatcgaggagagctgcttccagttcctgaagttcaagttcctggacagcacagctgaccagcaggagtgccccaggaagaagtgcttcagcagccactgccagaagacagacctgaagctgagcctgctggaccagagggacctggagacagatgaggtggaggagttcctggagaacaagaatgtgcagaccccccagtgcaagctgcggcgctaccagggcaatgccaaggccagcccccccctgcaggacagcgccagccagacctatgaatccatgtgcctggagaaggatgctgccctggccctgcccagcctgtgccccaagtacaggaagttccagaaggccttcggcacagacagagtgaggactggagagagctctgtgaaggacatccacgcctctgtgcagcccaatgaaagaagtgaaaatgaatgtctgggcggcgtgcctgaatgtcgggacctgcaggtgatgctgaagtgtgatgagagcaagctggccatggagcctgaggagaccaagaaggaccctgccagccagtgccccacagagaagtctgaggtgacccccttcccccacaacagcagcattgacccccacggcctgtacagcctgagcctgctgcacacctatgaccagtacggggacctgaactttgctggcatgcagaacaccaccgtgctgacagagaagcccctgagcggcacagatgtgcaggagaagacctttggagagagccaggacctgcccctgaagagtgacctgggcacccgggaggacagctctgtggccagcagtgacaggagctctgtggagcgggaggtggccgagcacctggccaagggcttctggagcgacatctgcagcacagacaccccctgccagatgcagctgagccctgctgtggccaaggatggcagcgagcagatcagccagaagaggtctgagtgcccctggctgggcatccgcatcagcgagagccctgagcccggccagaggaccttcaccaccctgagctctgtgaactgccccttcatcagcaccctgagcacagagggctgcagcagcaacctggagattggaaatgatgattatgtgtctgagccccagcaggagccctgcccctatgcctgcgtcatcagcctgggagatgacagcgagacagacacagaaggagacagcgagagctgcagcgcccgggagcaggagtgtgaggtgaagctgcccttcaatgcccagaggatcatcagcctgagcagaaatgacttccagagcctgctgaagatgcacaagctgaccccagagcagctggactgcatccatgacatcagaagaagaagcaagaacagaattgctgcccagcgctgcaggaagaggaagctggactgcatccagaacctggagagcgagattgagaagctgcagagcgagaaggagagcctgctgaaggagcgggaccacatcctgagcaccctgggggagaccaagcagaacctgaccggcctgtgccagaaggtgtgcaaggaggccgccctgagccaggagcagatccagatcctggccaagtacagcgctgctgactgccccctgtccttcctgatcagcgagaaggacaagagcaccccagatggagagctggccctgcccagcatcttcagcctgagtgaccggcccccagctgtgctgcccccctgtgcccggggcaacagcgagcccggctacgcccggggccaggagagccagcagatgagcacagccaccagcgagcaggccggccctgctgagcagtgccggcagagcggcggcatcagtgacttctgccagcagatgacagacaagtgcaccacagatgaatag

SEQ ID NO: 145473 - DNA, 2211 bp, Artificial Sequence; identical to SEQ ID NO: 145472
  Description of Artificial Sequence: Synthetic coding sequence

SEQ ID NO: 145474 - DNA, 513 bp, Artificial Sequence
  Description of Artificial Sequence: Synthetic coding sequence
atgagcctgtctgaaaattctgtgtttgcctatgagagctctgtgcacagcaccaacgtgctgctgagcctgaatgaccagaggaagaaggatgtgctgtgtgatgtgaccatctttgtggagggccagcgcttccgggcccacaggtctgtgctggccgcctgcagcagctacttccacagcagaattgtgggccaggctgatggagagctgaacatcaccctgcctgaggaggtgacagtgaagggctttgagcccctcatccagtttgcctacacagccaagctgatcctgagcaaagaaaatgtggatgaggtgtgcaagtgtgtggagttcctgtctgtgcacaacatcgaggagagctgcttccagttcctgaagttcaagttcctggacagcacagctgaccagcaggagtgccccaggaagaagtgcttcagcagccactgccagaagacagacctgaagctgagcctgctggaccagagggacctggagacagatgaggtgtag

SEQ ID NO: 145475 - DNA, 663 bp, Artificial Sequence
  Description of Artificial Sequence: Synthetic coding sequence
atgagcctgtctgaaaattctgtgtttgcctatgagagctctgtgcacagcaccaacgtgctgctgagcctgaatgaccagaggaagaaggatgtgctgtgtgatgtgaccatctttgtggagggccagcgcttccgggcccacaggtctgtgctggccgcctgcagcagctacttccacagcagaattgtgggccaggctgatggagagctgaacatcaccctgcctgaggaggtgacagtgaagggctttgagcccctcatccagtttgcctacacagccaagctgatcctgagcaaagaaaatgtggatgaggtgtgcaagtgtgtggagttcctgtctgtgcacaacatcgaggagagctgcttccagttcctgaagttcaagttcctggacagcacagctgaccagcaggagtgccccaggaagaagtgcttcagcagccactgccagaagacagacctgaagctgagcctgctggaccagagggacctggagacagatgaggtggaggagttcctggagaacaagaatgtgcagaccccccagtgcaagctgcggcgctaccagggcaatgccaaggccagcccccccctgcaggacagcgccagccagacctatgaatccatgtgcctggagaaggatgctgccctggccctgtag

SEQ ID NO: 145476 - DNA, 678 bp, Artificial Sequence
  Description of Artificial Sequence: Synthetic coding sequence
atgagcctgtctgaaaattctgtgtttgcctatgagagctctgtgcacagcaccaacgtgctgctgagcctgaatgaccagaggaagaaggatgtgctgtgtgatgtgaccatctttgtggagggccagcgcttccgggcccacaggtctgtgctggccgcctgcagcagctacttccacagcagaattgtgggccaggctgatggagagctgaacatcaccctgcctgaggaggtgacagtgaagggctttgagcccctcatccagtttgcctacacagccaagctgatcctgagcaaagaaaatgtggatgaggtgtgcaagtgtgtggagttcctgtctgtgcacaacatcgaggagagctgcttccagttcctgaagttcaagttcctggacagcacagctgaccagcaggagtgccccaggaagaagtgcttcagcagccactgccagaagacagacctgaagctgagcctgctggaccagagggacctggagacagatgaggtggaggagttcctggagaacaagaatgtgcagaccccccagtgcaagctgcggcgctaccagggcaatgccaaggccagcccccccctgcaggacagcgccagccagacctatgaatccatgtgcctggagaaggatgctgccctggccctgcccagcctgtgcccctag

SEQ ID NO: 145477 - DNA, 78 bp, Artificial Sequence
  Description of Artificial Sequence: Synthetic coding sequence
atgagcctgtctgaaaattctgtgtttgcctatgagagctctgtgcacagcaccaacgtgctgctgagcctgaactag

SEQ ID NO: 145478 - DNA, 78 bp, Artificial Sequence; identical to SEQ ID NO: 145477
  Description of Artificial Sequence: Synthetic coding sequence

SEQ ID NO: 145479 - DNA, 78 bp, Artificial Sequence; identical to SEQ ID NO: 145477
  Description of Artificial Sequence: Synthetic coding sequence

SEQ ID NO: 145480 - DNA, 78 bp, Artificial Sequence; identical to SEQ ID NO: 145477
  Description of Artificial Sequence: Synthetic coding sequence

SEQ ID NO: 145481 - DNA, 78 bp, Artificial Sequence; identical to SEQ ID NO: 145477
  Description of Artificial Sequence: Synthetic coding sequence

SEQ ID NO: 145482 - DNA, 2526 bp, Artificial Sequence
  Description of Artificial Sequence: Synthetic coding sequence
atgtctgtggatgagaagccagacagccccatgtatgtgtatgagagcacagtgcactgcaccaacatcctgctgggcctgaatgaccagaggaagaaggacatcctgtgtgatgtgaccctcatcgtggagaggaaggagttccgggcccacagagctgtgctggccgcctgcagcgagtacttctggcaggccctggtgggccagaccaagaatgacctggtggtgtccctgcctgaggaggtgacagcccggggcttcggccccctgctgcagtttgcctacacagccaagctgctgctgagccgggagaacatccgggaggtgatccgctgtgccgagttcctgaggatgcacaacctggaggacagctgcttctccttcctgcagacccagctgctgaacagtgaagatggcctgtttgtgtgcaggaaggatgctgcctgccagaggcctcatgaggactgtgaaaattctgctggggaggaggaggatgaggaggaggagaccatggattctgaaacagccaagatggcctgcccccgggaccagatgctgcctgagcccatcagctttgaggccgccgccatccctgtggccgagaaggaggaggccctgctgcctgagccagatgtgcccacagacaccaaggagagcagcgagaaggatgccctgacccagtacccccgctacaagaagtaccagctggcctgcaccaagaatgtgtacaatgccagcagccacagcaccagcggctttgccagcaccttccgggaggacaacagcagcaacagcctgaagccaggcctggcccggggccagatcaagtctgagcccccatctgaagaaaatgaggaggagagcatcaccctgtgcctgtctggagatgagccagatgccaaggacagagctggagatgtggagatggacaggaagcagcccagccctgcccccacccccacagccccagctggggccgcctgcctggagaggagccgctctgtggccagccccagctgcctgcggagcctcttcagcatcaccaagtctgtggagctgagcggcctgcccagcaccagccagcagcactttgcccggagccctgcctgcccctttgacaagggcatcacccagggcgacctgaagacagactacacccccttcaccggcaactacggccagccccacgtgggccagaaggaggtgagcaacttcaccatgggcagccccctgcggggccctggcctggaggccctgtgcaagcaggagggggagctggaccggcgcagcgtcatcttcagcagcagcgcctgtgaccaggtgtccacctctgtgcacagctacagcggcgtgagcagcctggacaaggacctgtctgagcctgtgcccaagggcctgtgggtgggcgccggccagagcctgcccagcagccaggcctacagccacggcggcctgatggctgaccacctgcccggccgcatgaggcccaacaccagctgccctgtgcccatcaaggtgtgccccaggagcccccccctggagaccaggaccaggaccagcagcagctgcagcagctacagctatgcagaagatggcagcggcggcagcccctgcagcctgcccctgtgtgagttcagcagcagcccctgcagccagggcgcccgcttcctggccacagagcaccaggagcccggcctgatgggagatggcatgtacaaccaggtgcggccccagatcaagtgtgagcagagctatggcaccaacagcagtgatgaaagtggcagcttcagcgaggccgacagcgagagctgccctgtgcaggaccggggccaggaggtgaagctgcccttccctgtggaccagatcacagacctgcccagaaatgacttccagatgatgatcaagatgcacaagctgaccagcgagcagctggagttcatccatgatgtgagaagaagaagcaagaacagaattgctgcccagcgctgcaggaagaggaagctggactgcatccagaacctggagtgtgagatcaggaagctggtgtgtgagaaggagaagctgctgtctgagaggaaccagctgaaggcctgcatgggagagctgctggacaacttcagctgcctgagccaggaggtgtgccgggacatccagagccctgagcagatccaggccctgcaccgctactgccctgtgctgcggcccatggacctgcccacagccagcagcatcaacccagcccccctgggcgctgagcagaacattgctgccagccagtgtgctgtgggggagaatgtgccctgctgcctggagcccggggccgcccctcctggccccccctgggcccccagcaacaccagcgagaactgcaccagcggccggcggctggagggcacagatcctggcaccttcagcgagcggggcccccccctggagcccaggagccagacagtgacagtggacttctgccaggagatgacagacaagtgcaccacagatgagcagcccaggaaggactacacctag

SEQ ID NO: 145483 - DNA, 2526 bp, Artificial Sequence; identical to SEQ ID NO: 145482
  Description of Artificial Sequence: Synthetic coding sequence

SEQ ID NO: 145484 - DNA, 246 bp, Artificial Sequence
  Description of Artificial Sequence: Synthetic coding sequence
atgtctgtggatgagaagccagacagccccatgtatgtgtatgagagcacagtgcactgcaccaacatcctgctgggcctgaatgaccagaggaagaaggacatcctgtgtgatgtgaccctcatcgtggagaggaaggagttccgggcccacagagctgtgctggccgcctgcagcgagtacttctggcaggccctggtgggccagaccaagaatgacctggtggtgtccctgcctgaggagtag

SEQ ID NO: 145485 - DNA, 246 bp, Artificial Sequence; identical to SEQ ID NO: 145484
  Description of Artificial Sequence: Synthetic coding sequence

SEQ ID NO: 145486 - DNA, 2526 bp, Artificial Sequence; identical to SEQ ID NO: 145482
  Description of Artificial Sequence: Synthetic coding sequence

SEQ ID NO: 145487 - DNA, 477 bp, Artificial Sequence
  Description of Artificial Sequence: Synthetic coding sequence
atgagccatggaaaaggaacagacatgctgcctgagattgctgctgctgtgggcttcctgagcagcctgctgcggacccggggctgtgtgtctgagcagaggctgaaggtgttttctggggccctgcaggaggccctgacagagcactacaagcaccactggttccctgagaagcccagcaaaggaagtggctaccgctgcatccgcatcaaccacaagatggaccccatcatcagccgggtggccagccagatcggcctgagccagccccagctgcaccagctgctgcccagcgagctgaccctgtgggtggacccctatgaggtgtcctacagaattggagaagatggcagcatctgtgtgctgtatgaggaggcccccctggccgccagctgtggcctgctgacctgcaagaaccaggtgctgctgggccgcagcagccccagcaagaactacgtgatggctgtgagcagctag

SEQ ID NO: 145488 - DNA, 3258 bp, Artificial Sequence
  Description of Artificial Sequence: Synthetic coding sequence
atggacaccccagaaaatgtgctgcagatgctggaggcccacatgcagagctacaagggaaatgaccccctgggggagtgggagcgctacatccagtgggtggaggagaacttccctgagaacaaggagtacctgatcaccctgctggagcacctgatgaaggagttcctggacaagaagaagtaccacaatgacccccgcttcatctcctactgcctgaagtttgctgagtacaacagcgacctgcaccagttctttgagttcctgtacaaccacggcatcggcaccctgagcagccccctgtacatcgcctgggccggccacctggaggcccagggcgagctgcagcacgccagcgctgtgctgcagaggggcatccagaaccaggccgagccccgggagttcctgcagcagcagtaccgcctcttccagacccggctgacagagacccacctgcctgcccaggcccggaccagcgagcccctgcacaacgtgcaggtgctgaaccagatgatcaccagcaagagcaaccctggcaacaacatggcctgcatcagcaagaaccagggcagcgagctgagcggggtcatcagcagcgcctgtgacaaggagagcaacatggagaggagggtcatcaccatcagcaagtctgagtacagcgtgcacagcagcctggccagcaaggtggatgtggagcaggtggtgatgtactgcaaggagaagctgatccggggggagagcgagttctcctttgaggagctgcgggcccagaagtacaaccagaggaggaagcatgagcagtgggtgaatgaagatagacactacatgaagaggaaggaggccaatgcctttgaggagcagctgctgaagcagaagatggatgagctgcacaagaagctgcaccaggtggtggagaccagccatgaggacctgcctgccagccaggagaggtctgaggtgaacccagccaggatgggccccagcgtgggcagccagcaggagctgcgggccccctgcctgcctgtgacctaccagcagacccctgtgaacatggagaagaacccccgggaggcccctcctgtggtgccccccctggccaatgccatctctgctgccctggtgtccccagccaccagccagagcatcgcccctcctgtgcccctgaaggcccagacagtgacagacagcatgtttgctgtggccagcaaggatgctggctgtgtgaacaagagcacccatgagttcaagccccagagcggggctgagatcaaggagggctgtgagacccacaaggtggccaacaccagcagcttccacaccacccccaacaccagcctgggcatggtgcaggccacccccagcaaggtgcagcccagccccaccgtgcacaccaaggaggccctgggcttcatcatgaacatgttccaggcccccaccctgcctgacatcagtgatgacaaggatgagtggcagagcctggaccagaatgaagatgcctttgaggcccagttccagaagaatgtgcgcagcagcggggcctggggcgtgaacaagatcatcagcagcctgagcagcgccttccacgtgtttgaagatggcaacaaggagaactacggcctgccccagcccaagaacaagcccaccggggcccggacctttggagagaggtctgtgtcccggctgcccagcaagcccaaggaggaggtgccccacgccgaggagttcctggatgacagcacagtgtggggcatccgctgcaacaagaccctggcccccagccccaagagccctggggacttcaccagcgctgcccagctggccagcacccccttccacaagctgcctgtggagagcgtgcacatcctggaggacaaggaaaatgtggtggccaagcagtgcacccaggccaccctggacagctgtgaggagaacatggtggtgcccagcagagatggcaagttcagccccatccaggagaagagccccaagcaggccctgagcagccacatgtacagcgccagcctgctgcggctgagccagcctgctgctggaggagtgctgacctgtgaggccgagctgggcgtggaggcctgccgcctgacagacacagatgctgccatcgcagaagatcctccagatgccatcgccggcctgcaggccgagtggatgcagatgagcagcctgggcaccgtggatgcccccaacttcatcgtgggcaacccctgggatgacaagctgatcttcaagctgctgagcggcctgagcaagcctgtgagcagctaccccaacacctttgagtggcagtgcaagctgcctgccatcaagcccaagacagagttccagctgggcagcaagctggtgtatgtgcaccacctgctgggggagggcgcctttgcccaggtgtatgaggccacccagggcgacctgaatgatgccaagaacaagcagaagtttgtgctgaaggtgcagaagccagccaacccctgggagttctacatcggcacccagctgatggagcggctgaagcccagcatgcagcacatgttcatgaagttctacagcgcccacctgttccagaatggatctgtgctggtgggggagctgtacagctatggcaccctgctgaatgccatcaacctgtacaagaacaccccagagaaggtgatgccccagggcctggtgatcagctttgccatgaggatgctgtacatgattgagcaggtgcatgactgtgagatcatccatggagacatcaagccagacaacttcatcctgggcaatggcttcctggagcaggatgatgaagatgacctgtctgctggcctggccctgattgacctgggccagagcattgacatgaagctgttccccaagggcaccatcttcaccgccaagtgtgagaccagcggcttccagtgtgtggagatgctgagcaacaagccctggaactaccagattgactactttggagtggccgccaccgtgtactgcatgctgtttggcacctacatgaaggtgaagaatgaaggaggagagtgcaagccagagggcctcttccggcggctgccccacctggacatgtggaatgagttcttccacgtgatgctgaacatcccagactgccaccacctgcccagcctggacctgctgcggcagaagctgaagaaggtgttccagcagcactacaccaacaagatccgggccctgaggaacagactcatcgtgctgctgctggagtgcaagaggagcaggaagtag

SEQ ID NO: 145489 - DNA, 3087 bp, Artificial Sequence
  Description of Artificial Sequence: Synthetic coding sequence
atggacaccccagaaaatgtgctgcagatgctggaggcccacatgcagagctacaagggaaatgaccccctgggggagtgggagcgctacatccagtgggtggaggagaacttccctgagaacaaggagtacctgatcaccctgctggagcacctgatgaaggagttcctggacaagaagaagtaccacaatgacccccgcttcatctcctactgcctgaagtttgctgagtacaacagcgacctgcaccagttctttgagttcctgtacaaccacggcatcggcaccctgagcagccccctgtacatcgcctgggccggccacctggaggcccagggcgagctgcagcacgccagcgctgtgctgcagaggggcatccagaaccaggccgagccccgggagttcctgcagcagcagtaccgcctcttccagacccggctgacagagacccacctgcctgcccaggcccggaccagcgagcccctgcacaacgtgcaggtgctgaaccagatgatcaccagcaagagcaaccctggcaacaacatggcctgcatcagcaagaaccagggcagcgagctgagcggggtcatcagcagcgcctgtgacaaggagagcaacatggagaggagggtcatcaccatcagcaagtctgagtacagcgtgcacagcagcctggccagcaaggtggatgtggagcaggtggtgatgtactgcaaggagaagctgatccggggggagagcgagttctcctttgaggagctgcgggcccagaagtacaaccagaggaggaagcatgagcagtgggtgaatgaagatagacactacatgaagaggaaggaggccaatgcctttgaggagcagctgctgaagcagaagatggatgagctgcacaagaagctgcaccaggtggtggagaccagccatgaggacctgcctgccagccaggagaggtctgaggtgaacccagccaggatgggccccagcgtgggcagccagcaggagctgcgggccccctgcctgcctgtgacctaccagcagacccctgtgaacatggagaagaacccccgggaggcccctcctgtggtgccccccctggccaatgccatctctgctgccctggtgtccccagccaccagccagagcatcgcccctcctgtgcccctgaaggcccagacagtgacagacagcatgtttgctgtggccagcaaggatgctggctgtgtgaacaagagcacccatgagttcaagccccagagcggggctgagatcaaggagggctgtgagacccacaaggtggccaacaccagcagcttccacaccacccccaacaccagcctgggcatggtgcaggccacccccagcaaggtgcagcccagccccaccgtgcacaccaaggaggccctgggcttcatcatgaacatgttccaggcccccaccctgcctgacatcagtgatgacaaggatgagtggcagagcctggaccagaatgaagatgcctttgaggcccagttccagaagaatgtgcgcagcagcggggcctggggcgtgaacaagatcatcagcagcctgagcagcgccttccacgtgtttgaagatggcaacaaggagaactacggcctgccccagcccaagaacaagcccaccggggcccggacctttggagagaggtctgtgtcccggctgcccagcaagcccaaggaggaggtgccccacgccgaggagttcctggatgacagcacagtgtggggcatccgctgcaacaagaccctggcccccagccccaagagccctggggacttcaccagcgctgcccagctggccagcacccccttccacaagctgcctgtggagagcgtgcacatcctggaggacaaggaaaatgtggtggccaagcagtgcacccaggccaccctggacagctgtgaggagaacatggtggtgcccagcagagatggcaagttcagccccatccaggagaagagccccaagcaggccctgagcagccacatgtacagcgccagcctgctgcggctgagccagcctgctgctggaggagtgctgacctgtgaggccgagctgggcgtggaggcctgccgcctgacagacacagatgctgccatcgcagaagatcctccagatgccatcgccggcctgcaggccgagtggatgcagatgagcagcctgggcaccgtggatgcccccaacttcatcgtgggcaacccctgggatgacaagctgatcttcaagctgctgagcggcctgagcaagcctgtgagcagctaccccaacacctttgagtggcagtgcaagctgcctgccatcaagcccaagacagagttccagctgggcagcaagctggtgtatgtgcaccacctgctgggggagggcgcctttgcccaggtgtatgaggccacccagggcgacctgaatgatgccaagaacaagcagaagtttgtgctgaaggtgcagaagccagccaacccctgggagttctacatcggcacccagctgatggagcggctgaagcccagcatgcagcacatgttcatgaagttctacagcgcccacctgttccagaatggatctgtgctggtgggggagctgtacagctatggcaccctgctggatgatgaagatgacctgtctgctggcctggccctgattgacctgggccagagcattgacatgaagctgttccccaagggcaccatcttcaccgccaagtgtgagaccagcggcttccagtgtgtggagatgctgagcaacaagccctggaactaccagattgactactttggagtggccgccaccgtgtactgcatgctgtttggcacctacatgaaggtgaagaatgaaggaggagagtgcaagccagagggcctcttccggcggctgccccacctggacatgtggaatgagttcttccacgtgatgctgaacatcccagactgccaccacctgcccagcctggacctgctgcggcagaagctgaagaaggtgttccagcagcactacaccaacaagatccgggccctgaggaaccggctgattgtgctgctgctggagtgcaagaggagcaggaagtag

SEQ ID NO: 145490 - DNA, 3198 bp, Artificial Sequence
  Description of Artificial Sequence: Synthetic coding sequence
atggacaccccagaaaatgtgctgcagtacatccagtgggtggaggagaacttccctgagaacaaggagtacctgatcaccctgctggagcacctgatgaaggagttcctggacaagaagaagtaccacaatgacccccgcttcatctcctactgcctgaagtttgctgagtacaacagcgacctgcaccagttctttgagttcctgtacaaccacggcatcggcaccctgagcagccccctgtacatcgcctgggccggccacctggaggcccagggcgagctgcagcacgccagcgctgtgctgcagaggggcatccagaaccaggccgagccccgggagttcctgcagcagcagtaccgcctcttccagacccggctgacagagacccacctgcctgcccaggcccggaccagcgagcccctgcacaacgtgcaggtgctgaaccagatgatcaccagcaagagcaaccctggcaacaacatggcctgcatcagcaagaaccagggcagcgagctgagcggggtcatcagcagcgcctgtgacaaggagagcaacatggagaggagggtcatcaccatcagcaagtctgagtacagcgtgcacagcagcctggccagcaaggtggatgtggagcaggtggtgatgtactgcaaggagaagctgatccggggggagagcgagttctcctttgaggagctgcgggcccagaagtacaaccagaggaggaagcatgagcagtgggtgaatgaagatagacactacatgaagaggaaggaggccaatgcctttgaggagcagctgctgaagcagaagatggatgagctgcacaagaagctgcaccaggtggtggagaccagccatgaggacctgcctgccagccaggagaggtctgaggtgaacccagccaggatgggccccagcgtgggcagccagcaggagctgcgggccccctgcctgcctgtgacctaccagcagacccctgtgaacatggagaagaacccccgggaggcccctcctgtggtgccccccctggccaatgccatctctgctgccctggtgtccccagccaccagccagagcatcgcccctcctgtgcccctgaaggcccagacagtgacagacagcatgtttgctgtggccagcaaggatgctggctgtgtgaacaagagcacccatgagttcaagccccagagcggggctgagatcaaggagggctgtgagacccacaaggtggccaacaccagcagcttccacaccacccccaacaccagcctgggcatggtgcaggccacccccagcaaggtgcagcccagccccaccgtgcacaccaaggaggccctgggcttcatcatgaacatgttccaggcccccaccctgcctgacatcagtgatgacaaggatgagtggcagagcctggaccagaatgaagatgcctttgaggcccagttccagaagaatgtgcgcagcagcggggcctggggcgtgaacaagatcatcagcagcctgagcagcgccttccacgtgtttgaagatggcaacaaggagaactacggcctgccccagcccaagaacaagcccaccggggcccggacctttggagagaggtctgtgtcccggctgcccagcaagcccaaggaggaggtgccccacgccgaggagttcctggatgacagcacagtgtggggcatccgctgcaacaagaccctggcccccagccccaagagccctggggacttcaccagcgctgcccagctggccagcacccccttccacaagctgcctgtggagagcgtgcacatcctggaggacaaggaaaatgtggtggccaagcagtgcacccaggccaccctggacagctgtgaggagaacatggtggtgcccagcagagatggcaagttcagccccatccaggagaagagccccaagcaggccctgagcagccacatgtacagcgccagcctgctgcggctgagccagcctgctgctggaggagtgctgacctgtgaggccgagctgggcgtggaggcctgccgcctgacagacacagatgctgccatcgcagaagatcctccagatgccatcgccggcctgcaggccgagtggatgcagatgagcagcctgggcaccgtggatgcccccaacttcatcgtgggcaacccctgggatgacaagctgatcttcaagctgctgagcggcctgagcaagcctgtgagcagctaccccaacacctttgagtggcagtgcaagctgcctgccatcaagcccaagacagagttccagctgggcagcaagctggtgtatgtgcaccacctgctgggggagggcgcctttgcccaggtgtatgaggccacccagggcgacctgaatgatgccaagaacaagcagaagtttgtgctgaaggtgcagaagccagccaacccctgggagttctacatcggcacccagctgatggagcggctgaagcccagcatgcagcacatgttcatgaagttctacagcgcccacctgttccagaatggatctgtgctggtgggggagctgtacagctatggcaccctgctgaatgccatcaacctgtacaagaacaccccagagaaggtgatgccccagggcctggtgatcagctttgccatgaggatgctgtacatgattgagcaggtgcatgactgtgagatcatccatggagacatcaagccagacaacttcatcctgggcaatggcttcctggagcaggatgatgaagatgacctgtctgctggcctggccctgattgacctgggccagagcattgacatgaagctgttccccaagggcaccatcttcaccgccaagtgtgagaccagcggcttccagtgtgtggagatgctgagcaacaagccctggaactaccagattgactactttggagtggccgccaccgtgtactgcatgctgtttggcacctacatgaaggtgaagaatgaaggaggagagtgcaagccagagggcctcttccggcggctgccccacctggacatgtggaatgagttcttccacgtgatgctgaacatcccagactgccaccacctgcccagcctggacctgctgcggcagaagctgaagaaggtgttccagcagcactacaccaacaagatccgggccctgaggaacagactcatcgtgctgctgctggagtgcaagaggagcaggaagtag

SEQ ID NO: 145491 - DNA, 2475 bp, Artificial Sequence
  Description of Artificial Sequence: Synthetic coding sequence
atggacaccccagaaaatgtgctgcagatgctggaggcccacatgcagagctacaagggaaatgaccccctgggggagtgggagcgctacatccagtgggtggaggagaacttccctgagaacaaggagtacctgatcaccctgctggagcacctgatgaaggagttcctggacaagaagaagtaccacaatgacccccgcttcatctcctactgcctgaagtttgctgagtacaacagcgacctgcaccagttctttgagttcctgtacaaccacggcatcggcaccctgagcagccccctgtacatcgcctgggccggccacctggaggcccagggcgagctgcagcacgccagcgctgtgctgcagaggggcatccagaaccaggccgagccccgggagttcctgcagcagcagtaccgcctcttccagacccggctgacagagacccacctgcctgcccaggcccggaccagcgagcccctgcacaacgtgcaggtgctgaaccagatgatcaccagcaagagcaaccctggcaacaacatggcctgcatcagcaagaaccagggcagcgagctgagcggggtcatcagcagcgcctgtgacaaggagagcaacatggagaggagggtcatcaccatcagcaagtctgagtacagcgtgcacagcagcctggccagcaaggtggatgtggagcaggtggtgatgtactgcaaggagaagctgatccggggggagagcgagttctcctttgaggagctgcgggcccagaagtacaaccagaggaggaagcatgagcagtgggtgaatgaagatagacactacatgaagaggaaggaggccaatgcctttgaggagcagctgctgaagcagaagatggatgagctgcacaagaagctgcaccaggtggtggagaccagccatgaggacctgcctgccagccaggagaggtctgaggtgaacccagccaggatgggccccagcgtgggcagccagcaggagctgcgggccccctgcctgcctgtgacctaccagcagacccctgtgaacatggagaagaacccccgggaggcccctcctgtggtgccccccctggccaatgccatctctgctgccctggtgtccccagccaccagccagagcatcgcccctcctgtgcccctgaaggcccagacagtgacagacagcatgtttgctgtggccagcaaggatgctggctgtgtgaacaagagcacccatgagttcaagccccagagcggggctgagatcaaggagggctgtgagacccacaaggtggccaacaccagcagcttccacaccacccccaacaccagcctgggcatggtgcaggccacccccagcaaggtgcagcccagccccaccgtgcacaccaaggaggccctgggcttcatcatgaacatgttccaggcccccaccctgcctgacatcagtgatgacaaggatgagtggcagagcctggaccagaatgaagatgcctttgaggcccagttccagaagaatgtgcgcagcagcggggcctggggcgtgaacaagatcatcagcagcctgagcagcgccttccacgtgtttgaagatggcaacaaggagaactacggcctgccccagcccaagaacaagcccaccggggcccggacctttggagagaggtctgtgtcccggctgcccagcaagcccaaggaggaggtgccccacgccgaggagttcctggatgacagcacagtgtggggcatccgctgcaacaagaccctggcccccagccccaagagccctggggacttcaccagcgctgcccagctggccagcacccccttccacaagctgcctgtggagagcgtgcacatcctggaggacaaggaaaatgtggtggccaagcagtgcacccaggccaccctggacagctgtgaggagaacatggtggtgcccagcagagatggcaagttcagccccatccaggagaagagccccaagcaggccctgagcagccacatgtacagcgccagcctgctgcggctgagccagcctgctgctggaggagtgctgacctgtgaggccgagctgggcgtggaggcctgccgcctgacagacacagatgctgccatcgcagaagatcctccagatgccatcgccggcctgcaggccgagtggatgcagatgagcagcctgggcaccgtggatgcccccaacttcatcgtgggcaacccctgggatgacaagctgatcttcaagctgctgagcggcctgagcaagcctgtgagcagctaccccaacacctttgagtggcagtgcaagctgcctgccatcaagcccaagacagagttccagctgggcagcaagctggtgtatgtgcaccacctgctgggggagggcgcctttgcccaggtgtatgaggccacccagggcgacctgaatgatgccaagaacaagcagaagtttgtgctgaaggtgaagagctag

SEQ ID NO: 145492 - DNA, 981 bp, Artificial Sequence
  Description of Artificial Sequence: Synthetic coding sequence
atgacaggcagcaatgagttcaagctgaaccagcccccagaagatggcatcagctctgtgaagttcagccccaacaccagccagttcctgctggtgtcctcctgggacacctctgtgcggctgtatgatgtgcctgccaacagcatgaggctgaagtaccagcacactggagctgtgctggactgtgccttctatgaccccacccacgcctggagcggcggcctggaccaccagctgaagatgcatgacctgaacacagaccaggagaacctggtgggcacccatgatgcccccatccgctgtgtggagtactgcccagaggtgaatgtgatggtgacaggctcctgggaccagacagtgaagctgtgggaccccaggaccccctgcaatgccggcaccttcagccagcctgagaaggtgtacaccctgtctgtgtctggggaccggctgattgtgggcacagctggaagaagagtgctggtgtgggacctgaggaacatgggctacgtgcagcagaggcgggagagcagcctgaagtaccagacccgctgcatccgggccttccccaacaagcagggctacgtgctgagcagcattgagggccgggtggccgtggagtacctggaccccagccctgaggtgcagaagaagaagtatgccttcaagtgccaccggctgaaggagaacaacatcgagcagatctaccctgtgaatgccatctccttccacaacatccacaacacctttgccactggaggcagtgatggctttgtgaacatctgggaccccttcaacaagaagaggctgtgccagttccaccgctaccccaccagcatcgccagcctggccttcagcaatgatggcaccaccctggccatcgccagcagctacatgtatgagatggatgacacagagcacccagaagatggcatcttcatccggcaggtgacagatgctgagaccaagcccaagagcacctag

SEQ ID NO: 145493 - DNA, 987 bp, Artificial Sequence
  Description of Artificial Sequence: Synthetic coding sequence
atgacaggcagcaatgagttcaagctgaaccagcccccagaagatggcatcagctctgtgaagttcagccccaacaccagccagttcctgctggtgtcctcctgggacacctctgtgcggctgtatgatgtgcctgccaacagcatgaggctgaagtaccagcacactggagctgtgctggactgtgccttctatgaccccacccacgcctggagcggcggcctggaccaccagctgaagatgcatgacctgaacacagaccaggagaacctggtgggcacccatgatgcccccatccgctgtgtggagtactgcccagaggtgaatgtgatggtgacaggctcctgggaccagacagtgaagctgtgggaccccaggaccccctgcaatgccggcaccttcagccagcctgagaaggtgtacaccctgtctgtgtctggggaccggctgattgtgggcacagctggaagaagagtgctggtgtgggacctgaggaacatgggctacgtgcagcagaggcgggagagcagcctgaagtaccagacccgctgcatccgggccttccccaacaagcagggctacgtgctgagcagcattgagggccgggtggccgtggagtacctggaccccagccctgaggtgcagaagaagaagtatgccttcaagtgccaccggctgaaggagaacaacatcgagcagatctaccctgtgaatgccatctccttccacaacatccacaacacctttgccactggaggcagtgatggctttgtgaacatctgggaccccttcaacaagaagaggctgtgccagttccaccgctaccccaccagcatcgccagcctggccttcagcaatgatggcaccaccctggccatcgccagcagctacatgtatgagatggatgacacagagcacccagaagatggcatcttcatccggcaggtgacagatgctgagaccaagcccaagagcccctgcacctag

SEQ ID NO: 145494 - DNA, 747 bp, Artificial Sequence
  Description of Artificial Sequence: Synthetic coding sequence
atgcatgacctgaacacagaccaggagaacctggtgggcacccatgatgcccccatccgctgtgtggagtactgcccagaggtgaatgtgatggtgacaggctcctgggaccagacagtgaagctgtgggaccccaggaccccctgcaatgccggcaccttcagccagcctgagaaggtgtacaccctgtctgtgtctggggaccggctgattgtgggcacagctggaagaagagtgctggtgtgggacctgaggaacatgggctacgtgcagcagaggcgggagagcagcctgaagtaccagacccgctgcatccgggccttccccaacaagcagggctacgtgctgagcagcattgagggccgggtggccgtggagtacctggaccccagccctgaggtgcagaagaagaagtatgccttcaagtgccaccggctgaaggagaacaacatcgagcagatctaccctgtgaatgccatctccttccacaacatccacaacacctttgccactggaggcagtgatggctttgtgaacatctgggaccccttcaacaagaagaggctgtgccagttccaccgctaccccaccagcatcgccagcctggccttcagcaatgatggcaccaccctggccatcgccagcagctacatgtatgagatggatgacacagagcacccagaagatggcatcttcatccggcaggtgacagatgctgagaccaagcccaagagcccctgcacctag

SEQ ID NO: 145495 - DNA, 1164 bp, Artificial Sequence
  Description of Artificial Sequence: Synthetic coding sequence
atggcctgcaccatccagaaggccgaggccctggatggagcccacctgatgcagatcctgtggtatgatgaggaggagagcctgtacccagctgtgtggctgcgggacaactgcccctgcagcgactgctacctggacagcgccaaggccaggaagctgctggtggaggccctggatgtgaacatcggcatcaagggcctcatctttgacaggaagaaggtgtacatcacctggccagatgagcactacagcgagttccaggccgactggctgaagaagcgctgcttcagcaagcaggcccgggccaagctgcagcgggagctgttcttccctgagtgccagtactggggcagcgagctgcagctgcccaccctggactttgaagatgtgctgcgctatgatgagcacgcctacaagtggctgagcaccctgaagaaggtgggcatcgtgcggctgactggagccagtgacaagccaggagaggtgtccaagctgggcaagaggatgggcttcctgtacctgaccttctacggccacacctggcaggtgcaggacaagattgatgccaacaacgtggcctacaccaccgggaagctgtccttccacacagactacccagccctgcaccaccccccaggagtgcagctgctgcactgcatcaagcagacagtgactggaggagacagcgagatcgtggatggcttcaacgtgtgccagaagctgaagaagaacaacccccaggccttccagatcctgagcagcacctttgtggacttcacagacatcggcgtggactactgtgacttctctgtgcagagcaagcacaagatcatcgagctggatgacaagggccaggtggtgcgcatcaacttcaacaatgccacccgggacaccatctttgatgtgcctgtggagcgggtgcagcccttctacgccgccctgaaggagtttgtggacctgatgaacagcaaggagagcaagttcaccttcaagatgaaccctggagatgtgatcacctttgacaactggaggctgctgcatggaagaagaagctatgaggccggcacagagatcagccgccacctggagggcgcctatgctgactgggatgtggtgatgagccggctgcgcatcctgcggcagagggtggagaatggaaattag

SEQ ID NO: 145496 - DNA, 1164 bp, Artificial Sequence; identical to SEQ ID NO: 145495
  Description of Artificial Sequence: Synthetic coding sequence

SEQ ID NO: 145497 - DNA, 1164 bp, Artificial Sequence; identical to SEQ ID NO: 145495
  Description of Artificial Sequence: Synthetic coding sequence

SEQ ID NO: 145498 - DNA, 1164 bp, Artificial Sequence; identical to SEQ ID NO: 145495
  Description of Artificial Sequence: Synthetic coding sequence

SEQ ID NO: 145499 - DNA, 207 bp, Artificial Sequence
  Description of Artificial Sequence: Synthetic coding sequence
atggcctgcaccatccagaaggccgaggccctggatggagcccacctgatgcagatcctgtggtatgatgaggaggagagcctgtacccagctgtgtggctgcgggacaactgcccctgcagcgactgctacctggacagcgccaaggccaggaagctgctggtggaggccctggatgtgaacatcggcatcaagggcctcatctag

SEQ ID NO: 145500 - DNA, 771 bp, Artificial Sequence
  Description of Artificial Sequence: Synthetic coding sequence
atggagcctgctgctgccctgcacttcagcctgcctgccagcctgctgctgctgctgctgctgctgctgctgagcctgtgtgccctggtgtctgcccagttcaccgtggtgggccctgccaaccccatcctggccatggtgggggagaacaccaccctgcgctgccacctgagccctgagaagaatgctgaggacatggaggtgcgctggttccgcagccagttctccccagctgtgtttgtgtacaagggcggccgggagaggacagaggagcagatggaggagtaccggggccgcatcacctttgtgtccaaggacatcaacagaggctctgtggccctggtgatccacaacgtgacagcccaggagaatggcatctaccgctgctacttccaggagggccgctcctatgatgaggccatcctgcggctggtggtggccgagagcttcatgcccagcgccagcccctggatggtggccctggccgtcatcctgacagccagcccctggatggtgtccatgaccgtcatcctggccgtgttcatcatcttcatggctgtgtccatctgctgcatcaagaagctgcagcgggagaagaagatcctgtctggagagaagaaggtggagcaggaggagaaggagatcgcccagcagctgcaggaggagctgcgctggaggaggaccttcctgcacgccggctatgagctgcccggcatccggggccccagctggaagaggcccctgcatggagagccccccagcgccttctag

SEQ ID NO: 145501 - DNA, 942 bp, Artificial Sequence
  Description of Artificial Sequence: Synthetic coding sequence
atggagcctgctgctgccctgcacttcagcctgcctgccagcctgctgctgctgctgctgctgctgctgctgagcctgtgtgccctggtgtctgagagcttcatgcccagcgccagcccctggatggtggccctggccgtcatcctgacagccagcccctggatggtgtccatgaccgtcatcctggccgtgttcatcatcttcatggctgtgtccatctgctgcatcaagaagctgcagcgggagaagaagatcctgtctggagagaagaaggtggagcaggaggagaaggagatcgcccagcagctgcaggaggagctgcgctggaggaggaccttcctgcacgccgcagatgtggtgctggaccctgacacagcccaccctgagctgttcctgtctgaggaccggcgctctgtgcggcggggcccctaccggcagagggtgcctgacaaccctgagagatttgacagccagccctgtgtgctgggctgggagagctttgccagcggcaagcactactgggaggtggaggtggagaatgtgatggtgtggacagtgggcgtgtgccgccacagcgtggagaggaagggggaggtgctgctgatcccccagaatggcttctggaccctggagatgtttggaaaccagtaccgggccctgagcagccctgagcgcatcctgcccctgaaggagagcctgtgccgggtgggcgtcttcctggactatgaggccggagatgtgtccttctacaacatgagggacaggagccacatctacacctgccccaggtctgccttcaccgtgcctgtgcggcccttcttccggctgggcagtgatgacagccccatcttcatctgcccagccctgaccggggccagcggcgtgatggtgcctgaggagggcctgaagctgcaccgggtgggcacccaccagagcctgtag

SEQ ID NO: 145502 - DNA, 1608 bp, Artificial Sequence
  Description of Artificial Sequence: Synthetic coding sequence
atggtgggggaggatgctgacctgccctgccacctgttccccaccatgtctgctgagaccatggagctgcgctgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagtgacagcggcaagtacctgtgctacttccaggatggagacttctatgagaaggccctggtggagctgaaggtggccgccctgggcagtgacctgcacatcgaggtgaagggctatgaagatggcggcatccacctggagtgccgcagcacaggctggtacccccagccccagatcaagtggagcgacaccaagggggagaacatcccagctgtggaggcccctgtggtggctgatggagtgggcctgtatgctgtggccgccagcgtcatcatgaggggcagcagcggcggcggcgtgtcctgcatcatccggaacagcctgctgggcctggagaagacagccagcatcagcattgctgaccccttcttccgcagcgcccagccctggattgctgccctggccggcaccctgcccatcagcctgctgctgctggccggggccagctacttcctgtggaggcagcagaaggagaagatcgccctgagccgggagacagagcgggagcgggagatgaaggagatgggctacgccgccacagagcaggagatcagcctgcgggagtggaggaagatccagtacatggcccggggggagaagagcctggcctaccacgagtggaagatggccctcttcaagccagcagatgtgatcctggaccctgacacagccaatgccatcctgctggtgtctgaggaccagaggtctgtgcagagagctgaggagccccgggacctgcctgacaaccctgagagatttgagtggagatactgtgtgctgggctgtgagaacttcaccagcggccgccactactgggaggtggaggtgggggacaggaaggagtggcacatcggcgtgtgcagcaagaatgtggagaggaagaagggctgggtgaagatgaccccagaaaatggctactggaccatgggcctgacagatggcaacaagtaccgggccctgacagagcccaggaccaacctgaagctgcctgagccccccaggaaggtgggcatcttcctggactatgagaccggggagatctccttctacaatgccacagatggcagccacatctacaccttcccccacgccagcttcagcgagcccctgtaccctgtgttccgcatcctgaccctggagcccacagccctgaccatctgccccatccccaaggaggtggagagcagcccagaccctgacctggtgcctgaccacagcctggagacccccctgaccccaggcctggccaatgaaagtggagagccccaggccgaggtgaccagcctgctgctgcctgcccaccctggagctgaggtgagccccagcgccaccaccaaccagaaccacaagctgcaggccaggacagaggccctgtactag

SEQ ID NO: 145503 - DNA, 1581 bp, Artificial Sequence
  Description of Artificial Sequence: Synthetic coding sequence
atggctgtgttccccagcagcggcctgccccgctgcctgctgaccctcatcctgctgcagctgcccaagctggacagcgccccctttgatgtgattggccccccagagcccatcctggccgtggtgggggaggatgctgagctgccctgccgcctgagccccaatgccagcgctgagcacctggagctgcgctggttcaggaagaaggtgtccccagctgtgctggtgcacagagatggccgggagcaggaggccgagcagatgcctgagtaccggggccgggccaccctggtgcaggacggcatcgccaagggccgggtggccctgcgcatccggggcgtgcgggtgtctgatgatggagagtacacctgcttcttccgggaggatggcagctatgaggaggccctggtgcacctgaaggtggccgccctgggcagtgacccccacatctccatgcaggtgcaggagaatggagagatctgcctggagtgcacctctgtgggctggtacccagagccccaggtgcagtggaggaccagcaaaggagagaagttccccagcaccagcgagagcaggaacccagatgaggagggcctcttcaccgtggccgccagcgtcatcatccgggacaccagcgccaagaatgtgtcctgctacatccagaacctgctgctgggccaggagaagaaggtggagatcagcatcccagccagcagcctgccccggctgaccccctggatcgtggccgtggccgtcatcctgatggtgctgggcctgctgaccatcggcagcatcttcttcacctggaggctgtacaatgaaagaccccgggagaggagaaatgagttcagcagcaaggagcggctgctggaggagctgaagtggaagaaggccaccctgcatgctgtggatgtgaccctggaccctgacacagcccacccccacctgttcctgtatgaggacagcaagtctgtgcggctggaggacagccggcagaagctgcctgagaagacagaaagatttgacagctggccctgtgtgctgggccgggagaccttcaccagcggccgccactactgggaggtggaggtgggggacagaacagactgggccatcggcgtgtgcagagaaaatgtgatgaagaagggctttgaccccatgaccccagaaaatggcttctgggccgtggagctgtatggaaatggctactgggccctgacccccctgcggacccccctgcccctggccggccccccccggcgggtgggcatcttcctggactatgagagcggggacatctccttctacaacatgaatgatggcagtgacatctacaccttcagcaatgtgaccttcagcggccccctgcggcccttcttctgcctgtggagcagcggcaagaagcccctgaccatctgccccatcgcagatggccctgagcgggtgacagtgattgccaatgcccaggacctgagcaaggagatccccctgagccccatgggagaggacagcgcccccagagatgctgacaccctgcacagcaagctgatccccacccagcccagccagggcgccccctag

SEQ ID NO: 145504 - DNA, 1485 bp, Artificial Sequence
  Description of Artificial Sequence: Synthetic coding sequence
atggctgtgttccccagcagcggcctgccccgctgcctgctgaccctcatcctgctgcagctgcccaagctggacagcgccccctttgatgtgattggccccccagagcccatcctggccgtggtgggggaggatgctgagctgccctgccgcctgagccccaatgccagcgctgagcacctggagctgcgctggttcaggaagaaggtgtccccagctgtgctggtgcacagagatggccgggagcaggaggccgagcagatgcctgagtaccggggccgggccaccctggtgcaggacggcatcgccaagggccgggtggccctgcgcatccggggcgtgcgggtgtctgatgatggagagtacacctgcttcttccgggaggatggcagctatgaggaggccctggtgcacctgaaggtggccgccctgggcagtgacccccacatctccatgcaggtgcaggagaatggagagatctgcctggagtgcacctctgtgggctggtacccagagccccaggtgcagtggaggaccagcaaaggagagaagttccccagcaccagcgagagcaggaacccagatgaggagggcctcttcaccgtggccgccagcgtcatcatccgggacaccagcgccaagaatgtgtcctgctacatccagaacctgctgctgggccaggagaagaaggtggagatcagcatcccagccagcagcctgccccggctgaccccctggatcgtggccgtggccgtcatcctgatggtgctgggcctgctgaccatcggcagcatcttcttcacctggaggctgtacaatgaaagaccccgggagaggagaaatgagttcagcagcaaggagcggctgctggaggagctgaagtggaagaaggccaccctgcatgctgtggatgtgaccctggaccctgacacagcccacccccacctgttcctgtatgaggacagcaagtctgtgcggctggaggacagccggcagaagctgcctgagaagacagaaagatttgacagctggccctgtgtgctgggccgggagaccttcaccagcggccgccactactgggaggtggaggtgggggacagaacagactgggccatcggcgtgtgcagagaaaatgtgatgaagaagggctttgaccccatgaccccagaaaatggcttctgggccgtggagctgtatggaaatggctactgggccctgacccccctgcggacccccctgcccctggccggccccccccggcgggtgggcatcttcctggactatgagagcggggacatctccttctacaacatgaatgatggcagtgacatctacaccttcagcaatgtgacagtgattgccaatgcccaggacctgagcaaggagatccccctgagccccatgggagaggacagcgcccccagagatgctgacaccctgcacagcaagctgatccccacccagcccagccagggcgccccctag

SEQ ID NO: 145505 - DNA, 1590 bp, Artificial Sequence
  Description of Artificial Sequence: Synthetic coding sequence
atggagagcgctgctgccctgcacttcagcaggcctgccagcctgctgctgctgctgctgagcctgtgtgccctggtgtctgcccagttcatcgtggtgggccccacagaccccatcctggccaccgtgggggagaacaccaccctgcgctgccacctgagccctgagaagaatgctgaggacatggaggtgcgctggttccgcagccagttctccccagctgtgtttgtgtacaagggcggccgggagaggacagaggagcagatggaggagtaccggggccgcaccacctttgtgtccaaggacatcagccggggctctgtggccctggtgatccacaacatcacagcccaggagaatggcacctaccgctgctacttccaggagggccgctcctatgatgaggccatcctgcacctggtggtggccggcctgggcagcaagcccctcatctccatgaggggccatgaagatggcggcatccggctggagtgcatcagccggggctggtaccccaagcccctgactgtgtggagggacccctacggcggcgtggccccagccctgaaggaggtgtccatgccagatgctgatggcctcttcatggtgaccacagctgtgatcatccgggacaagtctgtgaggaacatgagctgcagcatcaacaacaccctgctgggccagaagaaggagagcgtcatcttcatccctgagagcttcatgcccagcgtgagcccccccatcgctgtgtgcatctactggatcaacaagctgcagaaggagaagaagatcctgagcggggagaaggagtttgagcgggagacccgggagatcgccctgaaggagctggagaaggagcgggtgcagaaggaggaggagctgcaggtgaaggagaagctgcaggaggagctgcgctggaggaggaccttcctgcatgctgtggatgtggtgctggaccctgacacagcccacccagacctcttcctgtctgaagatagaagatctgtgcggcgctgccccttccgccacctgggggagagcgtgcctgacaaccctgagagatttgacagccagccctgtgtgctgggccgggagagctttgccagcggcaagcactactgggaggtggaggtggagaatgtcatcgagtggacagtgggcgtgtgccgggacagcgtggagaggaagggggaggtgctgctgatcccccagaatggcttctggaccctggagatgcacaagggccagtacagagctgtgagcagcccagaccgcatcctgcccctgaaggagagcctgtgccgggtgggcgtcttcctggactatgaggccggagatgtgtccttctacaacatgagggacaggagccacatctacacctgccccaggtctgccttcagcggccctgacaccagccagagcggggaccccccagagcccatcgagagcatcccctggagccacagccacgtggacaagccctggagcagccagcagcccccccacaacacccacctgcctgctgccagcttcacccccaccacagacctgagccccagcttcctgctgctgacccggctgtgcttctag

SEQ ID NO: 145506 - DNA, 1584 bp, Artificial Sequence
  Description of Artificial Sequence: Synthetic coding sequence
atggagagcgctgctgccctgcacttcagcaggcctgccagcctgctgctgctgctgctgagcctgtgtgccctggtgtctgcccagttcatcgtggtgggccccacagaccccatcctggccaccgtgggggagaacaccaccctgcgctgccacctgagccctgagaagaatgctgaggacatggaggtgcgctggttccgcagccagttctccccagctgtgtttgtgtacaagggcggccgggagaggacagaggagcagatggaggagtaccggggccgcaccacctttgtgtccaaggacatcagccggggctctgtggccctggtgatccacaacatcacagcccaggagaatggcacctaccgctgctacttccaggagggccgctcctatgatgaggccatcctgcacctggtggtggccggcctgggcagcaagcccctcatctccatgaggggccatgaagatggcggcatccggctggagtgcatcagccggggctggtaccccaagcccctgactgtgtggagggacccctacggcggcgtggccccagccctgaaggaggtgtccatgccagatgctgatggcctcttcatggtgaccacagctgtgatcatccgggacaagtctgtgaggaacatgagctgcagcatcaacaacaccctgctgggccagaagaaggagagcgtcatcttcatccctgagagcttcatgcccagcgtgagcccctgtgctgtggccctgcccatcatcgtggtgatcctgatgatccccatcgctgtgtgcatctactggatcaacaagctgcagaaggagaagaagatcctgagcggggagaaggagtttgagcgggagacccgggagatcgccctgaaggagctggagaaggagcgggtgcagaaggaggaggagctgcaggtgaaggagaagctgcaggaggagctgcgctggaggaggaccttcctgcatgctgtggatgtggtgctggaccctgacacagcccacccagacctcttcctgtctgaagatagaagatctgtgcggcgctgccccttccgccacctgggggagagcgtgcctgacaaccctgagagatttgacagccagccctgtgtgctgggccgggagagctttgccagcggcaagcactactgggaggtggaggtggagaatgtcatcgagtggacagtgggcgtgtgccgggacagcgtggagaggaagggggaggtgctgctgatcccccagaatggcttctggaccctggagatgcacaagggccagtacagagctgtgagcagcccagaccgcatcctgcccctgaaggagagcctgtgccgggtgggcgtcttcctggactatgaggccggagatgtgtccttctacaacatgagggacaggagccacatctacacctgccccaggtctgccttctctgtgcctgtgcggcccttcttccggctgggctgtgaggacagccccatcttcatctgcccagccctgaccggggccaatggagtgacagtgcctgaggagggcctgaccctgcaccgggtgggcacccaccagagcctgtag

SEQ ID NO: 145507 - DNA, 1005 bp, Artificial Sequence
  Description of Artificial Sequence: Synthetic coding sequence
atggagagcgctgctgccctgcacttcagcaggcctgccagcctgctgctgctgctgctgagcctgtgtgccctggtgtctgcccagttcatcgtggtgggccccacagaccccatcctggccaccgtgggggagaacaccaccctgcgctgccacctgagccctgagaagaatgctgaggacatggaggtgcgctggttccgcagccagttctccccagctgtgtttgtgtacaagggcggccgggagaggacagaggagcagatggaggagtaccggggccgcaccacctttgtgtccaaggacatcagccggggctctgtggccctggtgatccacaacatcacagcccaggagaatggcacctaccgctgctacttccaggagggccgctcctatgatgaggccatcctgcacctggtggtggccggcctgggcagcaagcccctcatctccatgaggggccatgaagatggcggcatccggctggagtgcatcagccggggctggtaccccaagcccctgactgtgtggagggacccctacggcggcgtggccccagccctgaaggaggtgtccatgccagatgctgatggcctcttcatggtgaccacagctgtgatcatccgggacaagtctgtgaggaacatgagctgcagcatcaacaacaccctgctgggccagaagaaggagagcgtcatcttcatccctgagagcttcatgcccagcgtgagcccctgtgctgtggccctgcccatcatcgtggtgatcctgatgatccccatcgctgtgtgcatctactggatcaacaagctgcagaaggagaagaagatcctgagcggggagaaggagtttgagcgggagacccgggagatcgccctgaaggagctggagaaggagcgggtgcagaaggaggaggagctgcaggtgaaggagaagctgcaggaggagctgcgctggaggaggaccttcctgcatgctgagctgcagttcttcagcaactag

SEQ ID NO: 145508 - DNA, 993 bp, Artificial Sequence
  Description of Artificial Sequence: Synthetic coding sequence
atggagagcgctgctgccctgcacttcagcaggcctgccagcctgctgctgctgctgctgagcctgtgtgccctggtgtctgcccagttcatcgtggtgggccccacagaccccatcctggccaccgtgggggagaacaccaccctgcgctgccacctgagccctgagaagaatgctgaggacatggaggtgcgctggttccgcagccagttctccccagctgtgtttgtgtacaagggcggccgggagaggacagaggagcagatggaggagtaccggggccgcaccacctttgtgtccaaggacatcagccggggctctgtggccctggtgatccacaacatcacagcccaggagaatggcacctaccgctgctacttccaggagggccgctcctatgatgaggccatcctgcacctggtggtggccggcctgggcagcaagcccctcatctccatgaggggccatgaagatggcggcatccggctggagtgcatcagccggggctggtaccccaagcccctgactgtgtggagggacccctacggcggcgtggccccagccctgaaggaggtgtccatgccagatgctgatggcctcttcatggtgaccacagctgtgatcatccgggacaagtctgtgaggaacatgagctgcagcatcaacaacaccctgctgggccagaagaaggagagcgtcatcttcatccctgagagcttcatgcccagcgtgagcccctgtgctgtggccctgcccatcatcgtggtgatcctgatgatccccatcgctgtgtgcatctactggatcaacaagctgcagaaggagaagaagatcctgagcggggagaaggagtttgagcgggagacccgggagatcgccctgaaggagctggagaaggagcgggtgcagaaggaggaggagctgcaggtgaaggagaagctgcaggaggagctgcgctggaggaggaccttcctgcatgctggccctgtgtag

SEQ ID NO: 145509 - DNA, 1401 bp, Artificial Sequence
  Description of Artificial Sequence: Synthetic coding sequence
atggaggtgcgctggttccgcagccagttcagccctgctgtgtttgtgtacaagggcggccgggagaggacagaggagcagatggaggagtaccggggccgcaccacctttgtgtccaaggacatcagccggggctctgtggccctggtgatccacaacatcacagcccaggagaatggcacctaccgctgctacttccaggagggccgctcctatgatgaggccatcctgcacctggtggtggccggcctgggcagcaagcccctcatctccatgaggggccatgaagatggcggcatccggctggagtgcatcagccggggctggtaccccaagcccctgactgtgtggagggacccctatggaggagtggccccagccctgaaggaggtgtccatgccagatgctgatggcctcttcatggtgaccacagctgtgatcatccgggacaagtctgtgaggaacatgagctgcagcatcaacaacaccctgctgggccagaagaaggagagcgtcatcttcatccctgagagcttcatgcccagcgtgagcccctgtgctgtggccctgcccatcatcgtggtgatcctgatgatccccatcgctgtgtgcatctactggatcaacaagctgcagaaggagaagaagatcctgtctggagagaaggagtttgagcgggagacccgggagatcgccctgaaggagctggagaaggagcgggtgcagaaggaggaggagctgcaggtgaaggagaagctgcaggaggagctgcgctggaggaggaccttcctgcatgctgtggatgtggtgctggaccctgacacagcccacccagacctcttcctgtctgaggaccggcgctctgtgcggcgctgccccttccgccacctgggggagagcgtgcctgacaaccctgagagatttgacagccagccctgtgtgctgggccgggagagctttgccagcggcaagcactactgggaggtggaggtggagaatgtgattgagtggacagtgggcgtgtgccgggacagcgtggagaggaaaggagaggtgctgctgatcccccagaatggcttctggaccctggagatgcacaagggccagtacagagctgtgagcagcccagaccgcatcctgcccctgaaggagagcctgtgccgggtgggcgtcttcctggactatgaagctggagatgtgtccttctacaacatgagggacaggagccacatctacacctgccccaggtctgccttctctgtgcctgtgcggcccttcttccggctgggctgtgaggacagccccatcttcatctgcccagccctgactggagccaacggggtgacagtgcctgaggagggcctgaccctgcaccgggtgggcacccaccagagcctgtag

SEQ ID NO: 145510 - DNA, 1224 bp, Artificial Sequence
  Description of Artificial Sequence: Synthetic coding sequence
atggagcctgctgctgccctgcacttcagcctgcctgccagcctgctgctgctgctgctgctgctgctgctgagcctgtgtgccctggtgtctggcctgggcagcaagcccctgattgagatcaaggcccaggaggatggcagcatctggctggagtgcatcagcggcggctggtacccagagcccctgactgtgtggagggacccctacggggaggtggtgcctgccctgaaggaggtgtccattgctgatgctgatggcctcttcatggtgaccacagctgtgatcatccgggacaagtatgtgagaaatgtgtcctgcagcgtgaacaacaccctgctgggccaggagaaggagaccgtcatcttcatccctgagagcttcatgcccagcgccagcccctggatggtggccctggccgtcatcctgacagccagcccctggatggtgtccatgaccgtcatcctggccgtgttcatcatcttcatggctgtgtccatctgctgcatcaagaagctgcagcgggagaagaagatcctgtctggagagaagaaggtggagcaggaggagaaggagatcgcccagcagctgcaggaggagctgcgctggaggaggaccttcctgcacgccgcagatgtggtgctggaccctgacacagcccaccctgagctgttcctgtctgaggaccggcgctctgtgcggcggggcccctaccggcagagggtgcctgacaaccctgagagatttgacagccagccctgtgtgctgggctgggagagctttgccagcggcaagcactactgggaggtggaggtggagaatgtgatggtgtggacagtgggcgtgtgccgccacagcgtggagaggaagggggaggtgctgctgatcccccagaatggcttctggaccctggagatgtttggaaaccagtaccgggccctgagcagccctgagcgcatcctgcccctgaaggagagcctgtgccgggtgggcgtcttcctggactatgaggccggagatgtgtccttctacaacatgagggacaggagccacatctacacctgccccaggtctgccttcaccgtgcctgtgcggcccttcttccggctgggcagtgatgacagccccatcttcatctgcccagccctgaccggggccagcggcgtgatggtgcctgaggagggcctgaagctgcaccgggtgggcacccaccagagcctgtag

SEQ ID NO: 145511 - DNA, 1572 bp, Artificial Sequence
  Description of Artificial Sequence: Synthetic coding sequence
atggagcctgctgctgccctgcacttcagcctgcctgccagcctgctgctgctgctgctgctgctgctgctgagcctgtgtgccctggtgtctgcccagttcaccgtggtgggccctgccaaccccatcctggccatggtgggggagaacaccaccctgcgctgccacctgagccctgagaagaatgctgaggacatggaggtgcgctggttccgcagccagttctccccagctgtgtttgtgtacaagggcggccgggagaggacagaggagcagatggaggagtaccggggccgcatcacctttgtgtccaaggacatcaacagaggctctgtggccctggtgatccacaacgtgacagcccaggagaatggcatctaccgctgctacttccaggagggccgctcctatgatgaggccatcctgcggctggtggtggccggcctgggcagcaagcccctgattgagatcaaggcccaggaggatggcagcatctggctggagtgcatcagcggcggctggtacccagagcccctgactgtgtggagggacccctacggggaggtggtgcctgccctgaaggaggtgtccattgctgatgctgatggcctcttcatggtgaccacagctgtgatcatccgggacaagtatgtgagaaatgtgtcctgcagcgtgaacaacaccctgctgggccaggagaaggagaccgtcatcttcatccctgagagcttcatgcccagcgccagcccctggatggtggccctggccgtcatcctgacagccagcccctggatggtgtccatgaccgtcatcctggccgtgttcatcatcttcatggctgtgtccatctgctgcatcaagaagctgcagcgggagaagaagatcctgtctggagagaagaaggtggagcaggaggagaaggagatcgcccagcagctgcaggaggagctgcgctggaggaggaccttcctgcacgccgcagatgtggtgctggaccctgacacagcccaccctgagctgttcctgtctgaggaccggcgctctgtgcggcggggcccctaccggcagagggtgcctgacaaccctgagagatttgacagccagccctgtgtgctgggctgggagagctttgccagcggcaagcactactgggaggtggaggtggagaatgtgatggtgtggacagtgggcgtgtgccgccacagcgtggagaggaagggggaggtgctgctgatcccccagaatggcttctggaccctggagatgtttggaaaccagtaccgggccctgagcagccctgagcgcatcctgcccctgaaggagagcctgtgccgggtgggcgtcttcctggactatgaggccggagatgtgtccttctacaacatgagggacaggagccacatctacacctgccccaggtctgccttcaccgtgcctgtgcggcccttcttccggctgggcagtgatgacagccccatcttcatctgcccagccctgaccggggccagcggcgtgatggtgcctgaggagggcctgaagctgcaccgggtgggcacccaccagagcctgtag

SEQ ID NO: 145512 - DNA, 1572 bp, Artificial Sequence; identical to SEQ ID NO: 145511
  Description of Artificial Sequence: Synthetic coding sequence

SEQ ID NO: 145513 - DNA, 1011 bp, Artificial Sequence
  Description of Artificial Sequence: Synthetic coding sequence
atggagcctgctgctgccctgcacttcagcctgcctgccagcctgctgctgctgctgctgctgctgctgctgagcctgtgtgccctggtgtctgcccagttcaccgtggtgggccctgccaaccccatcctggccatggtgggggagaacaccaccctgcgctgccacctgagccctgagaagaatgctgaggacatggaggtgcgctggttccgcagccagttctccccagctgtgtttgtgtacaagggcggccgggagaggacagaggagcagatggaggagtaccggggccgcatcacctttgtgtccaaggacatcaacagaggctctgtggccctggtgatccacaacgtgacagcccaggagaatggcatctaccgctgctacttccaggagggccgctcctatgatgaggccatcctgcggctggtggtggccggcctgggcagcaagcccctgattgagatcaaggcccaggaggatggcagcatctggctggagtgcatcagcggcggctggtacccagagcccctgactgtgtggagggacccctacggggaggtggtgcctgccctgaaggaggtgtccattgctgatgctgatggcctcttcatggtgaccacagctgtgatcatccgggacaagtatgtgagaaatgtgtcctgcagcgtgaacaacaccctgctgggccaggagaaggagaccgtcatcttcatccctgagagcttcatgcccagcgccagcccctggatggtggccctggccgtcatcctgacagccagcccctggatggtgtccatgaccgtcatcctggccgtgttcatcatcttcatggctgtgtccatctgctgcatcaagaagctgcagcgggagaagaagatcctgtctggagagaagaaggtggagcaggaggagaaggagatcgcccagcagctgcaggaggagctgcgctggaggaggaccttcctgcacgcagatgtgaacctgaccggcctgaggaacacctag

SEQ ID NO: 145514 - DNA, 333 bp, Artificial Sequence
  Description of Artificial Sequence: Synthetic coding sequence
atggagcctgctgctgccctgcacttcagcctgcctgccagcctgctgctgctgctgctgctgctgctgctgagcctgtgtgccctggtgtctggcctgggcagcaagcccctgattgagatcaaggcccaggaggatggcagcatctggctggagtgcatcagcggcggctggtacccagagcccctgactgtgtggagggacccctacggggaggtggtgcctgccctgaaggaggtgtccattgctgatgctgatggcctcttcatggtgaccacagctgtgatcatccgggacaagtatgtgagaaatgtgtcctgcagcgtgaactag

SEQ ID NO: 145515 - DNA, 555 bp, Artificial Sequence
  Description of Artificial Sequence: Synthetic coding sequence
atggagcctgctgctgccctgcacttcagcctgcctgccagcctgctgctgctgctgctgctgctgctgctgagcctgtgtgccctggtgtctggcctgggcagcaagcccctgattgagatcaaggcccaggaggatggcagcatctggctggagtgcatcagcggcggctggtacccagagcccctgactgtgtggagggacccctacggggaggtggtgcctgccctgaaggaggtgtccattgctgatgctgatggcctcttcatggtgaccacagctgtgatcatccgggacaagtatgtgagaaatgtgtcctgcagcgtgaacaacaccctgctgggccaggagaaggagaccgtcatcttcatccctgagagcttcatgcccagcgccagcccctggatggtggccctggccgtcatcctgacagccagcccctggatggtgtccatgaccgtcatcctggccgtgttcatcatcttcatggctgtgtccatctgctgcatcaagaagctgcagcgggagaagaagatcctgtctggagagaagtag

SEQ ID NO: 145516 - DNA, 720 bp, Artificial Sequence
  Description of Artificial Sequence: Synthetic coding sequence
atggagcctgctgctgccctgcacttcagcctgcctgccagcctgctgctgctgctgctgctgctgctgctgagcctgtgtgccctggtgtctgcccagttcaccgtggtgggccctgccaaccccatcctggccatggtgggggagaacaccaccctgcgctgccacctgagccctgagaagaatgctgaggacatggaggtgcgctggttccgcagccagttctccccagctgtgtttgtgtacaagggcggccgggagaggacagaggagcagatggaggagtaccggggccgcatcacctttgtgtccaaggacatcaacagaggctctgtggccctggtgatccacaacgtgacagcccaggagaatggcatctaccgctgctacttccaggagggccgctcctatgatgaggccatcctgcggctggtggtggccggcctgggcagcaagcccctgattgagatcaaggcccaggaggatggcagcatctggctggagtgcatcagcggcggctggtacccagagcccctgactgtgtggagggacccctacggggaggtggtgcctgccctgaaggaggtgtccattgctgatgctgatggcctcttcatggtgaccacagctgtgatcatccgggacaagtatgtgagaaatgtgtcctgcagcgtgaacaacaccctgctgggccaggagaaggagaccgtcatcttctag

SEQ ID NO: 145517 - DNA, 291 bp, Artificial Sequence
  Description of Artificial Sequence: Synthetic coding sequence
atggagcctgctgctgccctgcacttcagcctgcctgccagcctgctgctgctgctgctgctgctgctgctgagcctgtgtgccctggtgtctgcccagttcaccgtggtgggccctgccaaccccatcctggccatggtgggggagaacaccaccctgcgctgccacctgagccctgagaagaatgctgaggacatggaggtgcgctggttccgcagccagttctccccagctgtgtttgtgtacaagggcggccgggagaggacagaggagcagatggaggagtactag

SEQ ID NO: 145518 - DNA, 1542 bp, Artificial Sequence
  Description of Artificial Sequence: Synthetic coding sequence
atgaagatggccagcttcctggccttcctgctgctgaacttccgggtgtgcctgctgctgctgcagctgctgatgccccacagcgcccagttctctgtgctgggccccagcggccccatcctggccatggtgggggaggatgctgacctgccctgccacctgttccccaccatgtctgctgagaccatggagctgaagtgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagtgacagcggcaagtacctgtgctacttccaggatggagacttctatgagaaggccctggtggagctgaaggtggccgccctgggcagtgacctgcacgtggatgtgaagggctacaaggatggcggcatccacctggagtgccgcagcacaggctggtacccccagccccagatccagtggagcaacaacaagggggagaacatccccaccgtggaggcccctgtggtggctgatggagtgggcctgtatgctgtggccgccagcgtcatcatgaggggcagcagcggggagggcgtgtcctgcaccatccgcagcagcctgctgggcctggagaagacagccagcatcagcattgctgaccccttcttccgcagcgcccagcgctggattgctgccctggccggcaccctgcctgtgctgctgctgctgctgggcggggccggctacttcctgtggcagcagcaggaggagaagaagacccagttcaggaagaagaagcgggagcaggagctgcgggagatggcctggagcaccatgaagcaggagcagagcaccagggtgaagctgctggaggagctgcgctggaggagcatccagtatgccagcagaggagagcggcacagcgcctacaatgagtggaagaaggccctcttcaagccagcagatgtgatcctggaccccaagacagccaaccccatcctgctggtgtctgaggaccagaggtctgtgcagagggccaaggagccccaggacctgcctgacaaccctgagcgcttcaactggcactactgtgtgctgggctgtgagagcttcatcagcggccgccactactgggaggtggaggtgggggacaggaaggagtggcacatcggcgtgtgcagcaagaatgtgcagaggaagggctgggtgaagatgaccccagaaaatggcttctggaccatgggcctgacagatggcaacaagtaccgcaccctgacagagcccaggaccaacctgaagctgcccaagccacccaagaaggtgggcgtcttcctggactatgagaccggggacatctccttctacaatgctgtggatggcagccacatccacaccttcctggatgtgtccttcagcgaggccctgtaccctgtgttccgcatcctgaccctggagcccacagccctgaccatctgcccagcctag

SEQ ID NO: 145519 - DNA, 1386 bp, Artificial Sequence
  Description of Artificial Sequence: Synthetic coding sequence
atgaagatggccagcttcctggccttcctgctgctgaacttccgggtgtgcctgctgctgctgcagctgctgatgccccacagcgcccagttctctgtgctgggccccagcggccccatcctggccatggtgggggaggatgctgacctgccctgccacctgttccccaccatgtctgctgagaccatggagctgaagtgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagtgacagcggcaagtacctgtgctacttccaggatggagacttctatgagaaggccctggtggagctgaaggtggctgatggagtgggcctgtatgctgtggccgccagcgtcatcatgaggggcagcagcggggagggcgtgtcctgcaccatccgcagcagcctgctgggcctggagaagacagccagcatcagcattgctgaccccttcttccgcagcgcccagcgctggattgctgccctggccggcaccctgcctgtgctgctgctgctgctgggcggggccggctacttcctgtggcagcagcaggaggagaagaagacccagttcaggaagaagaagcgggagcaggagctgcgggagatggcctggagcaccatgaagcaggagcagagcaccagggtgaagctgctggaggagctgcgctggaggagcatccagtatgccagcagaggagagcggcacagcgcctacaatgagtggaagaaggccctcttcaagccagcagatgtgatcctggaccccaagacagccaaccccatcctgctggtgtctgaggaccagaggtctgtgcagagggccaaggagccccaggacctgcctgacaaccctgagcgcttcaactggcactactgtgtgctgggctgtgagagcttcatcagcggccgccactactgggaggtggaggtgggggacaggaaggagtggcacatcggcgtgtgcagcaagaatgtgcagaggaagggctgggtgaagatgaccccagaaaatggcttctggaccatgggcctgacagatggcaacaagtaccgcaccctgacagagcccaggaccaacctgaagctgcccaagccacccaagaaggtgggcgtcttcctggactatgagaccggggacatctccttctacaatgctgtggatggcagccacatccacaccttcctggatgtgtccttcagcgaggccctgtaccctgtgttccgcatcctgaccctggagcccacagccctgaccatctgcccagcctag

SEQ ID NO: 145520 - DNA, 1137 bp, Artificial Sequence
  Description of Artificial Sequence: Synthetic coding sequence
atgaagatggccagcttcctggccttcctgctgctgaacttccgggtgtgcctgctgctgctgcagctgctgatgccccacagcgcccagttctctgtgctgggccccagcggccccatcctggccatggtgggggaggatgctgacctgccctgccacctgttccccaccatgtctgctgagaccatggagctgaagtgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagtgacagcggcaagtacctgtgctacttccaggatggagacttctatgagaaggccctggtggagctgaaggtggccgccctgggcagtgacctgcacgtggatgtgaagggctacaaggatggcggcatccacctggagtgccgcagcacaggctggtacccccagccccagatccagtggagcaacaacaagggggagaacatccccaccgtggaggcccctgtggtggctgatggagtgggcctgtatgctgtggccgccagcgtcatcatgaggggcagcagcggggagggcgtgtcctgcaccatccgcagcagcctgctgggcctggagaagacagccagcatcagcattgctgaccccttcttccgcagcgcccagcgctggattgctgccctggccggcaccctgcctgtgctgctgctgctgctgggcggggccggctacttcctgtggcagcagcaggaggagaagaagacccagttcaggaagaagaagcgggagcaggagctgcgggagatggcctggagcaccatgaagcaggagcagagcaccagggtgaagctgctggaggagctgcgctggaggagcatccagtatgccagcagaggagagcggcacagcgcctacaatgagtggaagaaggccctcttcaagccaggcccccccatcggccagacccagcagcagacccggggccagggcagccctgtggccctgagccaggagagcgcccagaggacagacagctggggccctgaggagggcggggagagctag

SEQ ID NO: 145521 - DNA, 132 bp, Artificial Sequence
  Description of Artificial Sequence: Synthetic coding sequence
atgaagatggccagcttcctggccttcctgctgctgaacttccgggtgtgcctgctgctgctgcagctgctgatgccccacagcgcccagttctctgtgctgggccccagcggccccatcctggccatgtag

SEQ ID NO: 145522 - DNA, 360 bp, Artificial Sequence
  Description of Artificial Sequence: Synthetic coding sequence
atgaagatggccagcttcctggccttcctgctgctgaacttccgggtgtgcctgctgctgctgcagctgctgatgccccacagcgcccagttctctgtgctgggccccagcggccccatcctggccatggtgggggaggatgctgacctgccctgccacctgttccccaccatgtctgctgagaccatggagctgaagtgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagctag

SEQ ID NO: 145523 - DNA, 1059 bp, Artificial Sequence
  Description of Artificial Sequence: Synthetic coding sequence
atgaagatggccagcttcctggccttcctgctgctgaacttccgggtgtgcctgctgctgctgcagctgctgatgccccacagcgcccagttctctgtgctgggccccagcggccccatcctggccatggtgggggaggatgctgacctgccctgccacctgttccccaccatgtctgctgagaccatggagctgaagtgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagtgacagcggcaagtacctgtgctacttccaggatggagacttctatgagaaggccctggtggagctgaaggtggccgccctgggcagtgacctgcacgtggatgtgaagggctacaaggatggcggcatccacctggagtgccgcagcacaggctggtacccccagccccagatccagtggagcaacaacaagggggagaacatccccaccgtggaggcccctgtggtggctgatggagtgggcctgtatgctgtggccgccagcgtcatcatgaggggcagcagcggggagggcgtgtcctgcaccatccgcagcagcctgctgggcctggagaagacagccagcatcagcattgctgaccccttcttccgcagcgcccagcgctggattgctgccctggccggcaccctgcctgtgctgctgctgctgctgggcggggccggctacttcctgtggcagcagcaggaggagaagaagacccagttcaggaagaagaagcgggagcaggagctgcgggagatggcctggagcaccatgaagcaggagcagagcaccagggtgaagctgctggaggagctgcgctggaggagcatccagtatgccagcagaggagagcggcacagcgcctacaatgagtggaagaaggccctcttcaagccaggagaggagatgctgcagatgaggctgcactttgtgaagtag

SEQ ID NO: 145524 - DNA, 279 bp, Artificial Sequence
  Description of Artificial Sequence: Synthetic coding sequence
atgaagatggccagcttcctggccttcctgctgctgaacttccgggtgtgcctgctgctgctgcagctgctgatgccccacagcgcccagttctctgtgctgggccccagcggccccatcctggccatggtgggggaggatgctgacctgccctgccacctgttccccaccatgtctgctgagaccatggagctgaagtgggtgagcagcagcctgcggcaggtggtgaatgtgtatgcagatggcaaggaggtggaggaccggcagagcgccccctag

SEQ ID NO: 145525 - DNA, 1005 bp, Artificial Sequence
  Description of Artificial Sequence: Synthetic coding sequence
atgaagatggccagcagcctggccttcctgctgctgaacttccacgtgtccctgctgctggtgcagctgctgaccccctgcagcgcccagttctctgtgctgggccccagcggccccatcctggccatggtgggggaggatgctgacctgccctgccacctgttccccaccatgtctgctgagaccatggagctgaagtgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagtgacagcggcaagtacctgtgctacttccaggatggagacttctatgagaaggccctggtggagctgaaggtggccgccctgggcagcaacctgcacgtggaggtgaagggctatgaagatggcggcatccacctggagtgccgcagcacaggctggtacccccagccccagatccagtggagcaatgccaagggggagaacatcccagctgtggaggcccctgtggtggctgatggagtgggcctgtatgaggtggccgccagcgtcatcatgaggggcggcagcggggagggcgtgtcctgcatcatccggaacagcctgctgggcctggagaagacagccagcatcagcattgctgaccccttcttccgcagcgcccagccctggattgctgccctggccggcaccctgcccatcctgctgctgctgctggccggggccagctacttcctgtggaggcagcagaaggagatcacagccctgagcagcgagattgagagcgagcaggagatgaaggagatgggctacgccgccacagagcgggagatcagcctgcgggagagcctgcaggaggagctgaagaggaagaagatccagtacctgaccagaggagaggagagcagcagtgacaccaacaagagcgcctag

SEQ ID NO: 145526 - DNA, 1005 bp, Artificial Sequence; identical to SEQ ID NO: 145525
  Description of Artificial Sequence: Synthetic coding sequence

SEQ ID NO: 145527 - DNA, 936 bp, Artificial Sequence
  Description of Artificial Sequence: Synthetic coding sequence
atgggcatcccccgggcccagttctctgtgctgggccccagcggccccatcctggccatggtgggagaagatgctgacctgccctgccacctgttccccaccatgtctgctgagaccatggagctgaagtgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagtgacagcggcaagtacctgtgctacttccaggatggagacttctatgagaaggccctggtggagctgaaggtggccgccctgggcagcaacctgcacgtggaggtgaagggctatgaagatggcggcatccacctggagtgccgcagcacaggctggtacccccagccccagatccagtggagcaatgccaagggggagaacatcccagctgtggaggcccctgtggtggctgatggagtgggcctgtatgaggtggccgccagcgtcatcatgagaggaggcagcggggagggcgtgtcctgcatcatccggaacagcctgctgggcctggagaagacagccagcatcagcattgctgaccccttcttccgcagcgcccagccctggattgctgccctggccggcaccctgcccatcctgctgctgctgctggccggggccagctacttcctgtggaggcagcagaaggagatcacagccctgagcagcgagattgaaagtgagcaggagatgaaggagatgggctatgctgccacagagcgggagatcagcctgcgggagagcctgcaggaggagctgaagaggaagaagatccagtacctgaccagaggagaggagagcagcagtgacaccaacaagagcgcctag

SEQ ID NO: 145528 - DNA, 1005 bp, Artificial Sequence; identical to SEQ ID NO: 145525
  Description of Artificial Sequence: Synthetic coding sequence

SEQ ID NO: 145529 - DNA, 879 bp, Artificial Sequence
  Description of Artificial Sequence: Synthetic coding sequence
atggtgggggaggatgctgacctgccctgccacctgttccccaccatgtctgctgagaccatggagctgaagtgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagtgacagcggcaagtacctgtgctacttccaggatggagacttctatgagaaggccctggtggagctgaaggtggccgccctgggcagcaacctgcacgtggaggtgaagggctatgaagatggcggcatccacctggagtgccgcagcacaggctggtacccccagccccagatccagtggagcaatgccaagggggagaacatcccagctgtggaggcccctgtggtggctgatggagtgggcctgtatgaggtggccgccagcgtcatcatgaggggcggcagcggggagggcgtgtcctgcatcatccggaacagcctgctgggcctggagaagacagccagcatcagcattgctgaccccttcttccgcagcgcccagccctggattgctgccctggccggcaccctgcccatcctgctgctgctgctggccggggccagctacttcctgtggaggcagcagaaggagatcacagccctgagcagcgagattgagagcgagcaggagatgaaggagatgggctacgccgccacagagcgggagatcagcctgcgggagagcctgcaggaggagctgaagaggaagaagatccagtacctgaccagaggagaggagagcagcagtgacaccaacaagagcgcctag

SEQ ID NO: 145530 - DNA, 1005 bp, Artificial Sequence; identical to SEQ ID NO: 145525
  Description of Artificial Sequence: Synthetic coding sequence

SEQ ID NO: 145531 - DNA, 960 bp, Artificial Sequence
  Description of Artificial Sequence: Synthetic coding sequence
atgaagatggccagcagcctggccttcctgctgctgaacttccacgtgtccctgctgctggtgcagctgctgaccccctgcagcgcccagttctctgtgctgggccccagcggccccatcctggccatggtgggggaggatgctgacctgccctgccacctgttccccaccatgtctgctgagaccatggagctgaagtgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagtgacagcggcaagtacctgtgctacttccaggatggagacttctatgagaaggccctggtggagctgaaggtggccgccctgggcagcaacctgcacgtggaggtgaagggctatgaagatggcggcatccacctggagtgccgcagcacaggctggtacccccagccccagatccagtggagcaatgccaagggggagaacatcccagctgtggaggcccctgtggtggctgatggagtgggcctgtatgaggtggccgccagcgtcatcatgaggggcggcagcggggagggcgtgtcctgcatcatccggaacagcctgctgggcctggagaagacagccagcatcagcattgctgaccccttcttccgcagcgcccagccctggattgctgccctggccggcaccctgcccatcctgctgctgctgctggccggggccagctacttcctgtggaggcagcagaaggagatcacagccctgagcagcgagattgagagcgagcaggagatgaaggagatgggctacgccgccacagagcgggagatcagcctgcgggagagcctgcaggaggagctgaagaggaagaagagcagcacctag

SEQ ID NO: 145532 - DNA, 1755 bp, Artificial Sequence
  Description of Artificial Sequence: Synthetic coding sequence
atgaagatggccagcagcctggccttcctgctgctgaacttccacgtgtccctcttcctggtgcagctgctgaccccctgcagcgcccagttctctgtgctgggccccagcggccccatcctggccatggtgggggaggatgctgacctgccctgccacctgttccccaccatgtctgctgagaccatggagctgcgctgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagtgacagcggcaagtacctgtgctacttccaggatggagacttctatgagaaggccctggtggagctgaaggtggccgccctgggcagtgacctgcacatcgaggtgaagggctatgaagatggcggcatccacctggagtgccgcagcacaggctggtacccccagccccagatcaagtggagcgacaccaagggggagaacatcccagctgtggaggcccctgtggtggctgatggagtgggcctgtatgctgtggccgccagcgtcatcatgaggggcagcagcggcggcggcgtgtcctgcatcatccggaacagcctgctgggcctggagaagacagccagcatcagcattgctgaccccttcttccgcagcgcccagccctggattgctgccctggccggcaccctgcccatcagcctgctgctgctggccggggccagctacttcctgtggaggcagcagaaggagaagatcgccctgagccgggagacagagcgggagcgggagatgaaggagatgggctacgccgccacagagcaggagatcagcctgcgggagaagctgcaggaggagctgaagtggaggaagatccagtacatggcccggggggagaagagcctggcctaccacgagtggaagatggccctcttcaagccagcagatgtgatcctggaccctgacacagccaatgccatcctgctggtgtctgaggaccagaggtctgtgcagagagctgaggagccccgggacctgcctgacaaccctgagagatttgagtggagatactgtgtgctgggctgtgagaacttcaccagcggccgccactactgggaggtggaggtgggggacaggaaggagtggcacatcggcgtgtgcagcaagaatgtggagaggaagaagggctgggtgaagatgaccccagaaaatggctactggaccatgggcctgacagatggcaacaagtaccgggccctgacagagcccaggaccaacctgaagctgcctgagccccccaggaaggtgggcatcttcctggactatgaaacaggagagatctccttctacaatgccacagatggcagccacatctacaccttcccccacgccagcttcagcgagcccctgtaccctgtgttccgcatcctgaccctggagcccacagccctgaccatctgccccatccccaaggaggtggagagcagcccagaccctgacctggtgcctgaccacagcctggagacccccctgaccccaggcctggccaatgaaagtggagagccccaggccgaggtgaccagcctgctgctgcctgcccaccctggagctgaggtgagccccagcgccaccaccaaccagaaccacaagctgcaggccaggacagaggccctgtactag

SEQ ID NO: 145533 - DNA, 1629 bp, Artificial Sequence
  Description of Artificial Sequence: Synthetic coding sequence
atggtgggggaggatgctgacctgccctgccacctgttccccaccatgtctgctgagaccatggagctgcgctgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagtgacagcggcaagtacctgtgctacttccaggatggagacttctatgagaaggccctggtggagctgaaggtggccgccctgggcagtgacctgcacatcgaggtgaagggctatgaagatggcggcatccacctggagtgccgcagcacaggctggtacccccagccccagatcaagtggagcgacaccaagggggagaacatcccagctgtggaggcccctgtggtggctgatggagtgggcctgtatgctgtggccgccagcgtcatcatgaggggcagcagcggcggcggcgtgtcctgcatcatccggaacagcctgctgggcctggagaagacagccagcatcagcattgctgaccccttcttccgcagcgcccagccctggattgctgccctggccggcaccctgcccatcagcctgctgctgctggccggggccagctacttcctgtggaggcagcagaaggagaagatcgccctgagccgggagacagagcgggagcgggagatgaaggagatgggctacgccgccacagagcaggagatcagcctgcgggagaagctgcaggaggagctgaagtggaggaagatccagtacatggcccggggggagaagagcctggcctaccacgagtggaagatggccctcttcaagccagcagatgtgatcctggaccctgacacagccaatgccatcctgctggtgtctgaggaccagaggtctgtgcagagagctgaggagccccgggacctgcctgacaaccctgagagatttgagtggagatactgtgtgctgggctgtgagaacttcaccagcggccgccactactgggaggtggaggtgggggacaggaaggagtggcacatcggcgtgtgcagcaagaatgtggagaggaagaagggctgggtgaagatgaccccagaaaatggctactggaccatgggcctgacagatggcaacaagtaccgggccctgacagagcccaggaccaacctgaagctgcctgagccccccaggaaggtgggcatcttcctggactatgaaacaggagagatctccttctacaatgccacagatggcagccacatctacaccttcccccacgccagcttcagcgagcccctgtaccctgtgttccgcatcctgaccctggagcccacagccctgaccatctgccccatccccaaggaggtggagagcagcccagaccctgacctggtgcctgaccacagcctggagacccccctgaccccaggcctggccaatgaaagtggagagccccaggccgaggtgaccagcctgctgctgcctgcccaccctggagctgaggtgagccccagcgccaccaccaaccagaaccacaagctgcaggccaggacagaggccctgtactag

SEQ ID NO: 145534 - DNA, 417 bp, Artificial Sequence
  Description of Artificial Sequence: Synthetic coding sequence
atgaagatggccagcagcctggccttcctgctgctgaacttccacgtgtccctcttcctggtgcagctgctgaccccctgcagcgcccagttctctgtgctgggccccagcggccccatcctggccatggtgggggaggatgctgacctgccctgccacctgttccccaccatgtctgctgagaccatggagctgcgctgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagtgacagcggcaagtacctgtgctacttccaggatggagacttctatgagaaggccctgtag

SEQ ID NO: 145535 - DNA, 717 bp, Artificial Sequence
  Description of Artificial Sequence: Synthetic coding sequence
atgaagatggccagcagcctggccttcctgctgctgaacttccacgtgtccctcttcctggtgcagctgctgaccccctgcagcgcccagttctctgtgctgggccccagcggccccatcctggccatggtgggggaggatgctgacctgccctgccacctgttccccaccatgtctgctgagaccatggagctgcgctgggtgagcagcagcctgcggcaggtggtgaatgtgtatgcagatggcaaggaggtggaggaccggcagagcgccccctaccggggccgcaccagcatcctgagagatggcatcacagctgggaaggccgccctgcgcatccacaacgtgacagccagtgacagcggcaagtacctgtgctacttccaggatggagacttctatgagaaggccctggtggagctgaaggtggccgccctgggcagtgacctgcacatcgaggtgaagggctatgaagatggcggcatccacctggagtgccgcagcacaggctggtacccccagccccagatcaagtggagcgacaccaagggggagaacatcccagctgtggaggcccctgtggtggctgatggagtgggcctgtatgctgtggccgccagcgtcatcatgaggggcagcagcggcggcggcgtgtcctgcatcatccggaacagcctgctgggcctggagaagacagccagcatcagcatcgcctag

SEQ ID NO: 145536 - DNA, 1368 bp, Artificial Sequence
  Description of Artificial Sequence: Synthetic coding sequence
atggtggacttccctggctacaacctgagcggggctgtggccagcttcctgttcatcctgctgaccatgaagcagagcgaggacttccgggtcatcggccctgcccaccccatcctggccggcgtgggggaggatgccctgctgacctgccagctgctgcccaagaggaccaccatgcacgtggaggtgcgctggtacagaagtgagcccagcacccctgtgtttgtgcacagagatggagtggaggtgacagagatgcagatggaggagtaccggggctgggtggagtggattgaaaatggcatcgccaagggaaatgtggccctgaagatccacaacatccagcccagcgacaatggccagtactggtgccacttccaggacggcaactactgtggggagaccagcctgctgctgaaggtggccggcctgggcagcgcccccagcatccacatggagggccctggagagagcggcgtgcagctggtgtgcacagcccggggctggttccctgagccccaggtgtactgggaggacatccggggggagaagctgctggccgtgtctgagcaccgcatccaggacaaggatggcctcttctacgccgaggccaccctggtggtgagaaatgccagcgctgagagcgtgtcctgcctggtgcacaaccctgtgctgacagaggagaagggcagcgtcatcagcctgcctgagaagctgcagacagagctggccagcctgaaggtgaatggccccagccagcccatcctggtgcgggtgggggaggacatccagctgacctgctacctgagccccaaggccaatgcccagagcatggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgtccctgggcagcagccccctcatcaccgtggagggccaggaggatggagagatgcagcccatgtgcagcagtgatggctggttcccccagccccacgtgccctggagggacatggagggcaagaccatccccagcagcagccaggccctgacccagggcagccacggcctcttccacgtgcagaccctgctgcgggtgaccaacatctctgctgtggatgtgacctgcagcatcagcatccccttcctgggggaggagaagatcgccaccttcagcctgagcggctggtag

SEQ ID NO: 145537 - DNA, 1167 bp, Artificial Sequence
  Description of Artificial Sequence: Synthetic coding sequence
atggtggacttccctggctacaacctgagcggggctgtggccagcttcctgttcatcctgctgaccatgaagcagagcgaggacttccgggtcatcggccctgcccaccccatcctggccggcgtgggggaggatgccctgctgacctgccagctgctgcccaagaggaccaccatgcacgtggaggtgcgctggtacagaagtgagcccagcacccctgtgtttgtgcacagagatggagtggaggtgacagagatgcagatggaggagtaccggggctgggtggagtggattgaaaatggcatcgccaagggaaatgtggccctgaagatccacaacatccagcccagcgacaatggccagtactggtgccacttccaggacggcaactactgtggggagaccagcctgctgctgaaggtggccgagaagctgctggccgtgctgagcagcctgaaggtgaatggccccagccagcccatcctggtgcgggtgggggaggacatccagctgacctgctacctgagccccaaggccaatgcccagagcatggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgtccctgggcagcagccccctcatcaccgtggagggccaggaggatggagagatgcagcccatgtgcagcagtgatggctggttcccccagccccacgtgccctggagggacatggagggcaagaccatccccagcagcagccaggccctgacccagggcagccacggcctcttccacgtgcagaccctgctgcgggtgaccaacatctctgctgtggatgtgacctgcagcatcagcatccccttcctgggggaggagaagatcgccaccttcagcctgtctgagagcaggatgaccttcctgtggaagaccctgctggtgtggggcctgctgctggccgtggccgtgggcctgcccaggaagaggagctag

SEQ ID NO: 145538 - DNA, 738 bp, Artificial Sequence
  Description of Artificial Sequence: Synthetic coding sequence
atggtggacttccctggctacaacctgagcggggctgtggccagcttcctgttcatcctgctgaccatgaagcagagcgagaagctgcagacagagctggccagcctgaaggtgaatggccccagccagcccatcctggtgcgggtgggggaggacatccagctgacctgctacctgagccccaaggccaatgcccagagcatggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgtccctgggcagcagccccctcatcaccgtggagggccaggaggatggagagatgcagcccatgtgcagcagtgatggctggttcccccagccccacgtgccctggagggacatggagggcaagaccatccccagcagcagccaggccctgacccagggcagccacggcctcttccacgtgcagaccctgctgcgggtgaccaacatctctgctgtggatgtgacctgcagcatcagcatccccttcctgggggaggagaagatcgccaccttcagcctgagcggctggtag

SEQ ID NO: 145539 - DNA, 327 bp, Artificial Sequence
  Description of Artificial Sequence: Synthetic coding sequence
atggtggacttccctggctacaacctgagcggggctgtggccagcttcctgttcatcctgctgaccatgaagcagagcgacttccgggtgattggccctgcccaccccatcctggccggcgtgggagaagatgccctgctgacctgccagctgctgcccaagaggaccaccatgcacgtggaggtgcgctggtacagaagtgagcccagcacccctgtgtttgtgcacagagatggagtggaggtgacagagatgcagatggaggagtaccggggctgggtggagtggattgaaaatggaattgccaagggaaatgtggccctgtag

SEQ ID NO: 145540 - DNA, 780 bp, Artificial Sequence
  Description of Artificial Sequence: Synthetic coding sequence
atggtggacttccctggctacaacctgagcggggctgtggccagcttcctgttcatcctgctgaccatgaagcagagcgaggacttccgggtcatcggccctgcccaccccatcctggccggcgtgggggaggatgccctgctgacctgccagctgctgcccaagaggaccaccatgcacgtggaggtgcgctggtacagaagtgagcccagcacccctgtgtttgtgcacagagatggagtggaggtgacagagatgcagatggaggagtaccggggctgggtggagtggattgaaaatggcatcgccaagggaaatgtggccctgaagatccacaacatccagcccagcgacaatggccagtactggtgccacttccaggacggcaactactgtggggagaccagcctgctgctgaaggtggccggcctgggcagcgcccccagcatccacatggagggccctggagagagcggcgtgcagctggtgtgcacagcccggggctggttccctgagccccaggtgtactgggaggacatccggggggagaagctgctggccgtgtctgagcaccgcatccaggatgaagatggcctcttctacgccgaggccaccctggtggtgagaaatgccagcgctgagagcgtgtcctgcctggtgcacaaccctgtgctgacagaggagaagggcagcgtcatcagcctgcctgagaagctgcagacagagctgggcaagtatgaggtgctggcccacacctgtggcggcagcctgtgcccctag

SEQ ID NO: 145541 - DNA, 780 bp, Artificial Sequence
  Description of Artificial Sequence: Synthetic coding sequence
atggtggacttccctggctacaacctgagcggggctgtggccagcttcctgttcatcctgctgaccatgaagcagagcgaggacttccgggtcatcggccctgcccaccccatcctggccggcgtgggggaggatgccctgctgacctgccagctgctgcccaagaggaccaccatgcacgtggaggtgcgctggtacagaagtgagcccagcacccctgtgtttgtgcacagagatggagtggaggtgacagagatgcagatggaggagtaccggggctgggtggagtggattgaaaatggcatcgccaagggaaatgtggccctgaagatccacaacatccagcccagcgacaatggccagtactggtgccacttccaggacggcaactactgtggggagaccagcctgctgctgaaggtggccggcctgggcagcgcccccagcatccacatggagggccctggagagagcggcgtgcagctggtgtgcacagcccggggctggttccctgagccccaggtgtactgggaggacatccggggggagaagctgctggccgtgtctgagcaccgcatccaggacaaggatggcctcttctacgccgaggccaccctggtggtgagaaatgccagcgctgagagcgtgtcctgcctggtgcacaaccctgtgctgacagaggagaagggcagcgtcatcagcctgcctgagaagctgcagacagagctgggcaagtatgaggtgctggcccacacctgtggcggcagcctgtgcccctag

SEQ ID NO: 145542 - DNA, 636 bp, Artificial Sequence
  Description of Artificial Sequence: Synthetic coding sequence
aaggccaatgcccagagcatggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgtccctgggcagcagccccctcatcaccgtggagggccaggaggatggagagatgcagcccatgtgcagcagtgatggctggttcccccagccccacgtgccctggagggacatggagggcaagaccatccccagcagcagccaggccctgacccagggcagccacggcctcttccacgtgcagaccctgctgcgggtgaccaacatctctgctgtggatgtgacctgcagcatcagcatccccttcctgggggaggagaagatcgccaccttcagcctgtctgagagcaggatgaccttcctgtggaagaccctgctggtgtggggcctgctgctggccgtggccgtgggcctgcccaggaagaggagctag

SEQ ID NO: 145543 - DNA, 780 bp, Artificial Sequence; identical to SEQ ID NO: 145541
  Description of Artificial Sequence: Synthetic coding sequence

SEQ ID NO: 145544 - DNA, 327 bp, Artificial Sequence; identical to SEQ ID NO: 145539
  Description of Artificial Sequence: Synthetic coding sequence

SEQ ID NO: 145545 - DNA, 327 bp, Artificial Sequence; identical to SEQ ID NO: 145539
  Description of Artificial Sequence: Synthetic coding sequence

SEQ ID NO: 145546 - DNA, 636 bp, Artificial Sequence
  Description of Artificial Sequence: Synthetic coding sequence
aaggccaatgcccagagcatggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgggcctgggcagcagccccctcatcaccgtggagggccaggaggatggagagatgcagcccatgtgcagcagtgatggctggttcccccagccccacgtgccctggagggacatggagggcaagaccatccccagcagcagccaggccctgacccagggcagccacggcctcttccacgtgcagaccctgctgcgggtgaccaacatctctgctgtggatgtgacctgcagcatcagcatccccttcctgggggaggagaagatcgccaccttcagcctgtctgagagcaggatgaccttcctgtggaagaccctgctggtgtggggcctgctgctggccgtggccgtgggcctgcccaggaagaggagctag

SEQ ID NO: 145547 - DNA, 816 bp, Artificial Sequence
  Description of Artificial Sequence: Synthetic coding sequence
atggtggacttccctggctacaacctgagcggggctgtggccagcttcctgttcatcctgctgaccatgaagcagagcgaggacttccgggtcatcggccctgcccaccccatcctggccggcgtgggggaggatgccctgctgacctgccagctgctgcccaagaggaccaccatgcacgtggaggtgcgctggtacagaagtgagcccagcacccctgtgtttgtgcacagagatggagtggaggtgacagagatgcagatggaggagtaccggggctgggtggagtggattgaaaatggcatcgccaagggaaatgtggccctgaagatccacaacatccagcccagcgacaatggccagtactggtgccacttccaggacggcaactactgtggggagaccagcctgctgctgaaggtggccgctgtgctgagagatgacatcatcgccagcctgaaggtgaatggccccagccagcccatcctggtgcgggtgggggaggacatccagctgacctgctacctgagccccaaggccaatgcccagagcatggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgtgggtgctgccccactag

SEQ ID NO: 145548 - DNA, 327 bp, Artificial Sequence; identical to SEQ ID NO: 145539
  Description of Artificial Sequence: Synthetic coding sequence

SEQ ID NO: 145549 - DNA, 780 bp, Artificial Sequence; identical to SEQ ID NO: 145540
  Description of Artificial Sequence: Synthetic coding sequence

SEQ ID NO: 145550 - DNA, 327 bp, Artificial Sequence; identical to SEQ ID NO: 145539
  Description of Artificial Sequence: Synthetic coding sequence

SEQ ID NO: 145551 - DNA, 636 bp, Artificial Sequence; identical to SEQ ID NO: 145546
  Description of Artificial Sequence: Synthetic coding sequence

SEQ ID NO: 145552 - DNA, 780 bp, Artificial Sequence; identical to SEQ ID NO: 145540
  Description of Artificial Sequence: Synthetic coding sequence

SEQ ID NO: 145553 - DNA, 780 bp, Artificial Sequence; identical to SEQ ID NO: 145541
  Description of Artificial Sequence: Synthetic coding sequence

SEQ ID NO: 145554 - DNA, 327 bp, Artificial Sequence; identical to SEQ ID NO: 145539
  Description of Artificial Sequence: Synthetic coding sequence

SEQ ID NO: 145555 - DNA, 780 bp, Artificial Sequence; identical to SEQ ID NO: 145541
  Description of Artificial Sequence: Synthetic coding sequence

SEQ ID NO: 145556 - DNA, 636 bp, Artificial Sequence; identical to SEQ ID NO: 145546
  Description of Artificial Sequence: Synthetic coding sequence

SEQ ID NO: 145557 - DNA, 636 bp, Artificial Sequence; identical to SEQ ID NO: 145542
  Description of Artificial Sequence: Synthetic coding sequence

SEQ ID NO: 145558 - DNA, 636 bp, Artificial Sequence; identical to SEQ ID NO: 145542
  Description of Artificial Sequence: Synthetic coding sequence

SEQ ID NO: 145559 - DNA, 327 bp, Artificial Sequence; identical to SEQ ID NO: 145539
  Description of Artificial Sequence: Synthetic coding sequence

SEQ ID NO: 145560 - DNA, 636 bp, Artificial Sequence; identical to SEQ ID NO: 145542
  Description of Artificial Sequence: Synthetic coding sequence

SEQ ID NO: 145561 - DNA, 1449 bp, Artificial Sequence
  Description of Artificial Sequence: Synthetic coding sequence
atggtggacttccctggctacaacctgagcggggctgtggccagcttcctgttcatcctgctgaccatgaagcagagcgaggacttccgggtcatcggccctgcccaccccatcctggccggcgtgggggaggatgccctgctgacctgccagctgctgcccaagaggaccaccatgcacgtggaggtgcgctggtacagaagtgagcccagcacccctgtgtttgtgcacagagatggagtggaggtgacagagatgcagatggaggagtaccggggctgggtggagtggattgaaaatggcatcgccaagggaaatgtggccctgaagatccacaacatccagcccagcgacaatggccagtactggtgccacttccaggacggcaactactgtggggagaccagcctgctgctgaaggtggccggcctgggcagcgcccccagcatccacatggagggccctggagagagcggcgtgcagctggtgtgcacagcccggggctggttccctgagccccaggtgtactgggaggacatccggggggagaagctgctggccgtgtctgagcaccgcatccaggacaaggatggcctcttctacgccgaggccaccctggtggtgagaaatgccagcgctgagagcgtgtcctgcctggtgcacaaccctgtgctgacagaggagaagggcagcgtcatcagcctgcctgagaagctgcagacagagctggccagcctgaaggtgaatggccccagccagcccatcctggtgcgggtgggggaggacatccagctgacctgctacctgagccccaaggccaatgcccagagcatggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgtccctgggcagcagccccctcatcaccgtggagggccaggaggatggagagatgcagcccatgtgcagcagtgatggctggttcccccagccccacgtgccctggagggacatggagggcaagaccatccccagcagcagccaggccctgacccagggcagccacggcctcttccacgtgcagaccctgctgcgggtgaccaacatctctgctgtggatgtgacctgcagcatcagcatccccttcctgggggaggagaagatcgccaccttcagcctgtctgagagcaggatgaccttcctgtggaagaccctgctggtgtggggcctgctgctggccgtggccgtgggcctgcccaggaagaggagctag

SEQ ID NO: 145562 - DNA, 738 bp, Artificial Sequence
  Description of Artificial Sequence: Synthetic coding sequence
atggtggacttccctggctacaacctgagcggggctgtggccagcttcctgttcatcctgctgaccatgaagcagagcgaccggctggacacccccaaggccagcctgaaggtgaatggccccagccagcccatcctggtgcgggtgggggaggacatccagctgacctgctacctgagccccaaggccaatgcccagagcatggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgtccctgggcagcagccccctcatcaccgtggagggccaggaggatggagagatgcagcccatgtgcagcagtgatggctggttcccccagccccacgtgccctggagggacatggagggcaagaccatccccagcagcagccaggccctgacccagggcagccacggcctcttccacgtgcagaccctgctgcgggtgaccaacatctctgctgtggatgtgacctgcagcatcagcatccccttcctgggggaggagaagatcgccaccttcagcctgagcggctggtag

SEQ ID NO: 145563 - DNA, 537 bp, Artificial Sequence
  Description of Artificial Sequence: Synthetic coding sequence
atggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgtccctgggcagcagccccctcatcaccgtggagggccaggaggatggagagatgcagcccatgtgcagcagtgatggctggttcccccagccccacgtgccctggagggacatggagggcaagaccatccccagcagcagccaggccctgacccagggcagccacggcctcttccacgtgcagaccctgctgcgggtgaccaacatctctgctgtggatgtgacctgcagcatcagcatccccttcctgggggaggagaagatcgccaccttcagcctgagcggctggtag

SEQ ID NO: 145564 - DNA, 1167 bp, Artificial Sequence; identical to SEQ ID NO: 145537
  Description of Artificial Sequence: Synthetic coding sequence

SEQ ID NO: 145565 - DNA, 1167 bp, Artificial Sequence
  Description of Artificial Sequence: Synthetic coding sequence
atggtggacttccctggctacaacctgagcggggctgtggccagcttcctgttcatcctgctgaccatgaagcagagcgaggacttccgggtcatcggccctgcccaccccatcctggccggcgtgggggaggatgccctgctgacctgccagctgctgcccaagaggaccaccatgcacgtggaggtgcgctggtacagaagtgagcccagcacccctgtgtttgtgcacagagatggagtggaggtgacagagatgcagatggaggagtaccggggctgggtggagtggattgaaaatggcatcgccaagggaaatgtggccctgaagatccacaacatccagcccagcgacaatggccagtactggtgccacttccaggacggcaactactgtggggagaccagcctgctgctgaaggtggccgagaagctgctggccgtgctgagcagcctgaaggtgaatggccccagccagcccatcctggtgcgggtgggggaggacatccagctgacctgctacctgagccccaaggccaatgcccagagcatggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgggcctgggcagcagccccctcatcaccgtggagggccaggaggatggagagatgcagcccatgtgcagcagtgatggctggttcccccagccccacgtgccctggagggacatggagggcaagaccatccccagcagcagccaggccctgacccagggcagccacggcctcttccacgtgcagaccctgctgcgggtgaccaacatctctgctgtggatgtgacctgcagcatcagcatccccttcctgggggaggagaagatcgccaccttcagcctgtctgagagcaggatgaccttcctgtggaagaccctgctggtgtggggcctgctgctggccgtggccgtgggcctgcccaggaagaggagctag

SEQ ID NO: 145566 - DNA, 1167 bp, Artificial Sequence; identical to SEQ ID NO: 145537
  Description of Artificial Sequence: Synthetic coding sequence

SEQ ID NO: 145567 - DNA, 738 bp, Artificial Sequence
  Description of Artificial Sequence: Synthetic coding sequence
atggtggacttccctggctacaacctgagcggggctgtggccagcttcctgttcatcctgctgaccatgaagcagagcgaccggctggacacccccaaggccagcctgaaggtgaatggccccagccagcccatcctggtgcgggtgggggaggacatccagctgacctgctacctgagccccaaggccaatgcccagagcatggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgggcctgggcagcagccccctcatcaccgtggagggccaggaggatggagagatgcagcccatgtgcagcagtgatggctggttcccccagccccacgtgccctggagggacatggagggcaagaccatccccagcagcagccaggccctgacccagggcagccacggcctcttccacgtgcagaccctgctgcgggtgaccaacatctctgctgtggatgtgacctgcagcatcagcatccccttcctgggggaggagaagatcgccaccttcagcctgagcggctggtag

SEQ ID NO: 145568 - DNA, 738 bp, Artificial Sequence; identical to SEQ ID NO: 145562
  Description of Artificial Sequence: Synthetic coding sequence

SEQ ID NO: 145569 - DNA, 1167 bp, Artificial Sequence; identical to SEQ ID NO: 145537
  Description of Artificial Sequence: Synthetic coding sequence

SEQ ID NO: 145570 - DNA, 816 bp, Artificial Sequence; identical to SEQ ID NO: 145547
  Description of Artificial Sequence: Synthetic coding sequence

SEQ ID NO: 145571 - DNA, 738 bp, Artificial Sequence
  Description of Artificial Sequence: Synthetic coding sequence
atggtggacttccctggctacaacctgagcggggctgtggccagcttcctgttcatcctgctgaccatgaagcagagcgagaagctgcagacagagctggccagcctgaaggtgaatggccccagccagcccatcctggtgcgggtgggggaggacatccagctgacctgctacctgagccccaaggccaatgcccagagcatggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgggcctgggcagcagccccctcatcaccgtggagggccaggaggatggagagatgcagcccatgtgcagcagtgatggctggttcccccagccccacgtgccctggagggacatggagggcaagaccatccccagcagcagccaggccctgacccagggcagccacggcctcttccacgtgcagaccctgctgcgggtgaccaacatctctgctgtggatgtgacctgcagcatcagcatccccttcctgggggaggagaagatcgccaccttcagcctgagcggctggtag

SEQ ID NO: 145572 - DNA, 537 bp, Artificial Sequence
  Description of Artificial Sequence: Synthetic coding sequence
atggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgggcctgggcagcagccccctcatcaccgtggagggccaggaggatggagagatgcagcccatgtgcagcagtgatggctggttcccccagccccacgtgccctggagggacatggagggcaagaccatccccagcagcagccaggccctgacccagggcagccacggcctcttccacgtgcagaccctgctgcgggtgaccaacatctctgctgtggatgtgacctgcagcatcagcatccccttcctgggggaggagaagatcgccaccttcagcctgagcggctggtag

SEQ ID NO: 145573 - DNA, 738 bp, Artificial Sequence; identical to SEQ ID NO: 145562
  Description of Artificial Sequence: Synthetic coding sequence

SEQ ID NO: 145574 - DNA, 1368 bp, Artificial Sequence
  Description of Artificial Sequence: Synthetic coding sequence
atggtggacttccctggctacaacctgagcggggctgtggccagcttcctgttcatcctgctgaccatgaagcagagcgaggacttccgggtcatcggccctgcccaccccatcctggccggcgtgggggaggatgccctgctgacctgccagctgctgcccaagaggaccaccatgcacgtggaggtgcgctggtacagaagtgagcccagcacccctgtgtttgtgcacagagatggagtggaggtgacagagatgcagatggaggagtaccggggctgggtggagtggattgaaaatggcatcgccaagggaaatgtggccctgaagatccacaacatccagcccagcgacaatggccagtactggtgccacttccaggacggcaactactgtggggagaccagcctgctgctgaaggtggccggcctgggcagcgcccccagcatccacatggagggccctggagagagcggcgtgcagctggtgtgcacagcccggggctggttccctgagccccaggtgtactgggaggacatccggggggagaagctgctggccgtgtctgagcaccgcatccaggatgaagatggcctcttctacgccgaggccaccctggtggtgagaaatgccagcgctgagagcgtgtcctgcctggtgcacaaccctgtgctgacagaggagaagggcagcgtcatcagcctgcctgagaagctgcagacagagctggccagcctgaaggtgaatggccccagccagcccatcctggtgcgggtgggggaggacatccagctgacctgctacctgagccccaaggccaatgcccagagcatggaggtgcgctgggacaggagccaccgctacccagctgtgcacgtgtacatggatggagaccacgtggccggggagcagatggccgagtaccggggccgcacagtgctggtgtctgatgccattgatgagggccgcctgaccctgcagatcctgagcgcccggcccagtgatgatggccagtaccgctgcctgtttgagaaggatgatgtgtaccaggaggccagcctggacctgaaggtggtgggcctgggcagcagccccctcatcaccgtggagggccaggaggatggagagatgcagcccatgtgcagcagtgatggctggttcccccagccccacgtgccctggagggacatggagggcaagaccatccccagcagcagccaggccctgacccagggcagccacggcctcttccacgtgcagaccctgctgcgggtgaccaacatctctgctgtggatgtgacctgcagcatcagcatccccttcctgggggaggagaagatcgccaccttcagcctgagcggctggtag

SEQ ID NO: 145575 - DNA, 816 bp, Artificial Sequence; identical to SEQ ID NO: 145547
  Description of Artificial Sequence: Synthetic coding sequence

SEQ ID NO: 145576 - DNA, 816 bp, Artificial Sequence; identical to SEQ ID NO: 145547
  Description of Artificial Sequence: Synthetic coding sequence

SEQ ID NO: 145577 - DNA, 738 bp, Artificial Sequence; identical to SEQ ID NO: 145562
  Description of Artificial Sequence: Synthetic coding sequence

SEQ ID NO: 145578 - DNA, 816 bp, Artificial Sequence; identical to SEQ ID NO: 145547
  Description of Artificial Sequence: Synthetic coding sequence

SEQ ID NO: 145579 - DNA, 738 bp, Artificial Sequence; identical to SEQ ID NO: 145567
  Description of Artificial Sequence: Synthetic coding sequence

SEQ ID NO: 145580 - DNA, 738 bp, Artificial Sequence; identical to SEQ ID NO: 145562
  Description of Artificial Sequence: Synthetic coding sequence

SEQ ID NO: 145581 - DNA, 1368 bp, Artificial Sequence; identical to SEQ ID NO: 145536
  Description of Artificial Sequence: Synthetic coding sequence

SEQ ID NO: 145582 - DNA, 1368 bp, Artificial Sequence; identical to SEQ ID NO: 145536
  Description of Artificial Sequence: Synthetic coding sequence

SEQ ID NO: 145583 - DNA, 537 bp, Artificial Sequence; identical to SEQ ID NO: 145563
  Description of Artificial Sequence: Synthetic coding sequence

SEQ ID NO: 145584 - DNA, 1368 bp, Artificial Sequence; identical to SEQ ID NO: 145536
  Description of Artificial Sequence: Synthetic coding sequence

SEQ ID NO: 145585 - DNA, 816 bp, Artificial Sequence; identical to SEQ ID NO: 145547
  Description of Artificial Sequence: Synthetic coding sequence

SEQ ID NO: 145586 - DNA, 1368 bp, Artificial Sequence; identical to SEQ ID NO: 145574
  Description of Artificial Sequence: Synthetic coding sequence

SEQ ID NO: 145587 - DNA, 1368 bp, Artificial Sequence; identical to SEQ ID NO: 145574
  Description of Artificial Sequence: Synthetic coding sequence

SEQ ID NO: 145588 - DNA, 816 bp, Artificial Sequence; identical to SEQ ID NO: 145547
  Description of Artificial Sequence: Synthetic coding sequence

SEQ ID NO: 145589 - DNA, 537 bp, Artificial Sequence; identical to SEQ ID NO: 145572
  Description of Artificial Sequence: Synthetic coding sequence

SEQ ID NO: 145590 - DNA, 738 bp, Artificial Sequence; identical to SEQ ID NO: 145571
  Description of Artificial Sequence: Synthetic coding sequence

SEQ ID NO: 145591 - DNA, 738 bp, Artificial Sequence; identical to SEQ ID NO: 145538
  Description of Artificial Sequence: Synthetic coding sequence

SEQ ID NO: 145592 - DNA, 1167 bp, Artificial Sequence; identical to SEQ ID NO: 145537
  Description of Artificial Sequence: Synthetic coding sequence

SEQ ID NO: 145593 - DNA, 1368 bp, Artificial Sequence; identical to SEQ ID NO: 145536
  Description of Artificial Sequence: Synthetic coding sequence

SEQ ID NO: 145594 - DNA, 1167 bp, Artificial Sequence; identical to SEQ ID NO: 145565
  Description of Artificial Sequence: Synthetic coding sequence

SEQ ID NO: 145595 - DNA, 738 bp, Artificial Sequence; identical to SEQ ID NO: 145567
  Description of Artificial Sequence: Synthetic coding sequence

SEQ ID NO: 145596 - DNA, 816 bp, Artificial Sequence; identical to SEQ ID NO: 145547
  Description of Artificial Sequence: Synthetic coding sequence

SEQ ID NO: 145597 - DNA, 1167 bp, Artificial Sequence; identical to SEQ ID NO: 145565
  Description of Artificial Sequence: Synthetic coding sequence

SEQ ID NO: 145598 - DNA, 1401 bp, Artificial Sequence
  Description of Artificial Sequence: Synthetic coding sequence
atggcctttgtgctgatcctggtgctgtccttctatgagctggtgtctggccagtggcaggtgacaggccctgggaagtttgtgcaggccctggtgggggaggatgctgtgttcagctgcagcctcttccctgagaccagcgctgaggccatggaggtgcgcttcttcaggaaccagttccacgctgtggtgcacctgtacagagatggagaggactgggagagcaagcagatgccccagtaccggggccgcacagaatttgtgaaggacagcattgctgggggccgggtgtccctgcggctgaagaacatcacccccagcgacatcggcctgtatggctgctggttcagcagccagatctatgatgaggaggccacctgggagctgcgggtggccgccctgggcagcctgcccctcatcagcatcgtgggctacgtggatggcggcatccagctgctgtgcctgagcagcggctggttcccccagcccacagccaagtggaagggcccccagggccaggacctgagcagtgacagccgggccaatgctgatggctacagcctgtatgatgtggagatcagcatcatcgtgcaggagaatgccggcagcatcctgtgcagcatccacctggccgagcagagccatgaggtggagagcaaggtgctgattggagagaccttcttccagcccagcccctggaggctggccagcatcctgctgggcctgctgtgtggggccctgtgtggggtggtgatgggcatgatcatcgtgttcttcaagagcaagggcaagatccaggccgagctggactggaggaggaagcacggccaggccgagctgagagatgccaggaagcatgctgtggaggtgaccctggaccctgagacagcccaccccaagctgtgtgtgtctgacctgaagacagtgacccacaggaaggccccccaggaggtgccccacagcgagaagcgcttcaccaggaagtctgtggtggccagccagggcttccaggccggcaagcactactgggaggtggatgtgggccagaatgtgggctggtacgtgggcgtgtgcagagatgatgtggaccggggcaagaacaacgtgaccctgagccccaacaacggctactgggtgctgcggctgaccacagagcacctgtacttcaccttcaacccccacttcatcagcctgccccccagcaccccacccaccagggtgggcgtcttcctggactatgaaggaggcaccatctccttcttcaacaccaatgaccagagcctcatctacaccctgctgacctgccagtttgagggcctgctgcggccctacatccagcacgccatgtatgatgaggagaagggcacccccatcttcatctgccctgtgtcctggggctag

SEQ ID NO: 145599 - DNA, 1299 bp, Artificial Sequence
  Description of Artificial Sequence: Synthetic coding sequence
atggcctttgtgctgatcctggtgctgtccttctatgagctggtgtctggccagtggcaggtgacaggccctgggaagtttgtgcaggccctggtgggggaggatgctgtgttcagctgcagcctcttccctgagaccagcgctgaggccatggaggtgcgcttcttcaggaaccagttccacgctgtggtgcacctgtacagagatggagaggactgggagagcaagcagatgccccagtaccggggccgcacagaatttgtgaaggacagcattgctgggggccgggtgtccctgcggctgaagaacatcacccccagcgacatcggcctgtatggctgctggttcagcagccagatctatgatgaggaggccacctgggagctgcgggtggccgccctgggcagcctgcccctcatcagcatcgtgggctacgtggatggcggcatccagctgctgtgcctgagctctgtgcagcccagcccctggaggctggccagcatcctgctgggcctgctgtgtggggccctgtgtggggtggtgatgggcatgatcatcgtgttcttcaagagcaagggcaagatccaggccgagctgggcatgtgccacgtgctgagcctgccccacatggtgctgcccggccccagcctcatccacagcctgagcctgtggaccaccctggccgccggctggacaggcagcacagactggaggaggaagcacggccaggccgagctgagagatgccaggaagcatgctgtggaggtgaccctggaccctgagacagcccaccccaagctgtgtgtgtctgacctgaagacagtgacccacaggaaggccccccaggaggtgccccacagcgagaagcgcttcaccaggaagtctgtggtggccagccagggcttccaggccggcaagcactactgggaggtggatgtgggccagaatgtgggctggtacgtgggcgtgtgcagagatgatgtggaccggggcaagaacaacgtgaccctgagccccaacaacggctactgggtgctgcggctgaccacagagcacctgtacttcaccttcaacccccacttcatcagcctgccccccagcaccccacccaccagggtgggcgtcttcctggactatgaaggaggcaccatctccttcttcaacaccaatgaccagagcctcatctacaccctgctgacctgccagtttgagggcctgctgcggccctacatccagcacgccatgtatgatgaggagaagggcacccccatcttcatctgccctgtgtcctggggctag

SEQ ID NO: 145600 - DNA, 1809 bp, Artificial Sequence
  Description of Artificial Sequence: Synthetic coding sequence
atgcacagcaaggtgaccatcatctgcatccgcttcctgttctggttcctgctgctgtgcatgctgattggcaagagccacacagaagatgacatcatcatcgccaccaagaatggcaaggtgcggggcatgaacctgactgtgtttggaggcaccgtgacagccttcctgggcatcccctatgcccagccccccctgggccgcctgcgcttcaagaagccccagagcctgaccaagtggagcgacatctggaatgccaccaagtatgccaacagctgctgccagaacatcgaccagagcttccctggcttccacggcagcgagatgtggaaccccaacacagacctgtctgaggactgcctgtacctgaatgtgtggatcccagcccccaagcccaagaatgccaccgtgctgatctggatctacggcggcggcttccagacaggcaccagcagcctgcacgtgtatgatggcaagttcctggcccgggtggagagggtcatcgtggtgtccatgaactacagagtgggcgccctgggcttcctggccctgcccggcaaccctgaggcccctggcaacatgggcctgtttgaccagcagctggccctgcagtgggtgcagaagaacattgctgcctttggaggcaaccccaagtctgtgaccctgtttggagagagcgctggagctgcctctgtgtccctgcacctgctgagccctggcagccacagcctcttcacccgggccatcctgcagagcggcagcttcaatgccccctgggccgtgaccagcctgtatgaggccaggaacagaaccctgaacctggccaagctgaccggctgcagcagagaaaatgaaacagagatcatcaagtgcctgaggaacaaggacccccaggagatcctgctgaatgaggcctttgtggtgccctacggcacccccctgtctgtgaactttggccccaccgtggatggagacttcctgacagacatgccagacatcctgctggagctgggccagttcaagaagacccagatcctggtgggcgtgaacaaggatgagggcacagccttcctggtgtatggagcccctggcttcagcaaggacaacaacagcatcatcaccaggaaggagttccaggagggcctgaagatcttcttccctggggtgtctgaatttgggaaggagagcatcctcttccactacacagactgggtggatgaccagaggcctgagaactaccgggaggccctgggagatgtggtgggggactacaacttcatctgcccagccctggagttcaccaagaagttcagcgagtggggcaacaatgccttcttctactactttgagcacaggagcagcaagctgccctggccagagtggatgggcgtgatgcacggctatgaaattgaatttgtgtttggcctgcccctggagcggcgggacaactacaccaaggccgaggagatcctgagccgcagcatcgtgaagcgctgggccaactttgccaagtatggcaaccccaatgagacccagaacaacagcacctcctggcctgtgttcaagagcacagagcagaagtacctgaccctgaacacagagagcacccgcatcatgaccaagctgcgggcccagcagtgccgcttctggaccagcttcttccccaaggtgctggagatgactggaaatattgatgaagctgagtgggagtggaaggccggcttccaccgctggaacaactacatgatggactggaagaaccagttcaatgactacaccagcaagaaggagagctgtgtgggcctgtag

SEQ ID NO: 145601 - DNA, 399 bp, Artificial Sequence
  Description of Artificial Sequence: Synthetic coding sequence
gctgtgcagttcaccggctggagcagcagctgcatcctgcacttccctgaggtgctgcatgacttccacagcctgcagaccctgcccagcctgctgcagagaattggcaaccccaatgagacccagaacaacagcacctcctggcctgtgttcaagagcacagagcagaagtacctgaccctgaacacagagagcacccgcatcatgaccaagctgcgggcccagcagtgccgcttctggaccagcttcttccccaaggtgctggagatgactggaaatattgatgaagctgagtgggagtggaaggccggcttccaccgctggaacaactacatgatggactggaagaaccagttcaatgactacaccagcaagaaggagagctgtgtgggcctgtag

SEQ ID NO: 145602 - DNA, 195 bp, Artificial Sequence
  Description of Artificial Sequence: Synthetic coding sequence
atgaccaagctgcgggcccagcagtgccgcttctggaccagcttcttccccaaggtgctggagatgactggaaatattgatgaagctgagtgggagtggaaggccggcttccaccgctggaacaactacatgatggactggaagaaccagttcaatgactacaccagcaagaaggagagctgtgtgggcctgtag

SEQ ID NO: 145603 - DNA, 1431 bp, Artificial Sequence
  Description of Artificial Sequence: Synthetic coding sequence
atggccagcagaattggcctgaggatgcagctgatgagggagcaggcccagcaggaggagcagcgggagaggatgcagcagcaggccgtgatgcactacatgcagcagcagcagcagcagcagcagcagcagctgggcggcccccccaccccagccatcaacacccctgtgcacttccagagccccccacctgtgcctggagaggtgctgaaggtgcagagctacctggagaaccccaccagctaccacctgcagcagagccagcaccagaaggtgcgggagtacctgtctgagacctacggcaacaagtttgctgcccacatcagccctgcccagggcagccccaagcccccacctgctgccagccctggggtgcgggccggccacgtgctgagcagcagcgctggcaacagcgcccccaacagccccatggccatgctgcacatcggcagcaaccctgagcgggagctggatgatgtgattgacaacatcatgaggctggatgatgtgctgggctacatcaaccctgagatgcagatgcccaacaccctgcccctgagcagcagccacctgaatgtgtacagcagtgacccccaggtgacagccagcctggtgggcgtgaccagcagcagctgcccagctgacctgacccagaagcgggagctgacagatgctgagagccgggccctggccaaggagcggcagaagaaggacaaccacaacctgattgaaagaagaagacgcttcaacatcaatgaccgcatcaaggagctgggcatgctgatccccaaggccaatgacctggatgtgcgctggaacaagggcaccatcctgaaggcctctgtggactacatccggaggatgcagaaggacctgcagaagagccgggagctggagaaccacagccggcggctggagatgaccaacaagcagctgtggctgcgcatccaggagctggagatgcaggcccgggtgcacggcctgcccaccaccagccccagcggcatgaacatggccgagctggcccagcaggtggtgaagcaggagctgcccagcgaggagggccctggagaggccctgatgctgggcgctgaggtgcctgaccctgagcccctgcctgccctgcccccccaggcccccctgcccctgcccacccagccccccagccccttccaccacctggacttcagccacagcctgagctttggaggccgggaggatgagggccccccaggctacccagagcccctggcccctggccacggcagccccttccccagcctgagcaagaaggacctggacctgatgctgctggatgacagcctgctgcccctggccagtgaccccctgctgagcaccatgagccctgaggccagcaaggccagcagccgccgcagcagcttctccatggaggagggagatgtgctgtag

SEQ ID NO: 145604 - DNA, 426 bp, Artificial Sequence
  Description of Artificial Sequence: Synthetic coding sequence
atggccggggaggagatcaatgaagactaccctgtggagatccacgagtacctgagcgcctttgagaacagcattggagctgtggatgagatgctgaagaccatgatgtctgtgtccagaaatgagctgctgcagaagctggaccccctggagcaggccaaggtggacctggtgtctgcctacaccctgaacagcatgttctgggtgtacctggccacccagggcgtgaaccccaaggagcaccctgtgaagcaggagctggagcgcatccgggtgtacatgaacagagtgaaggagatcacagacaagaagaaggccggcaagctggacagaggagctgccagcagatttgtgaagaatgccctgtgggagcccaagagcaagaatgccagcaaggtggccaacaagggcaagagcaagagctag

SEQ ID NO: 145605 - DNA, 543 bp, Artificial Sequence
  Description of Artificial Sequence: Synthetic coding sequence
atgcccagccccagcgtgtccaccagcgctgcctctgtgctggagggcgtgtgtggccgggcccggagcacctaccgcaccccagaggagggggaggagcagagctggagcgccatcatggccggggaggagatcaatgaagactaccctgtggagatccacgagtacctgagcgcctttgaaaattccatcggggctgtggatgagatgctgaagaccatgatgtctgtgtccagaaatgagctgctgcagaagctggaccccctggagcaggccaaggtggacctggtgtctgcctacaccctgaacagcatgttctgggtgtacctggccacccagggcgtgaaccccaaggagcaccctgtgaagcaggagctggagcgcatccgggtgtacatgaacagagtgaaggagatcacagacaagaagaaggccggcaagctggacagaggagctgccagcagatttgtgaagaatgccctgtgggagcccaagagcaagaatgccagcaaggtggccaacaagggcaagagcaagagctag

SEQ ID NO: 145606 - DNA, 426 bp, Artificial Sequence; identical to SEQ ID NO: 145604
  Description of Artificial Sequence: Synthetic coding sequence

SEQ ID NO: 145607 - DNA, 426 bp, Artificial Sequence; identical to SEQ ID NO: 145604
  Description of Artificial Sequence: Synthetic coding sequence

SEQ ID NO: 145608 - DNA, 957 bp, Artificial Sequence
  Description of Artificial Sequence: Synthetic coding sequence
atgctgtctgagagcagcagcttcctgaagggcgtgatgctgggcagcatcttctgtgccctgatcaccatgctgggccacatccgcatcggccacggcaacaggatgcaccaccacgagcaccaccacctgcaggcccccaacaaggaggacatcctgaagatcagtgaagatgagaggatggagctgagcaagagcttccgggtgtactgcatcatcctggtgaagcccaaggatgtgtccctgtgggccgctgtgaaggagacctggaccaagcactgtgacaaggccgagttcttcagcagtgaaaatgtgaaggtgtttgagagcatcaacatggacaccaatgacatgtggctgatgatgaggaaggcctacaagtatgcctttgacaagtacagagaccagtacaactggttcttcctggcccggcccaccacctttgccatcatcgagaacctgaagtacttcctgctgaagaaggaccccagccagcccttctacctgggccacaccatcaagagcggggacctggagtatgtgggcatggagggcggcatcgtgctgtctgtggagagcatgaagaggctgaacagcctgctgaacatccctgagaagtgcccagagcagggcggcatgatctggaagatcagcgaggacaagcagctggccgtgtgcctgaagtatgctggggtgtttgctgaaaatgcagaagatgctgatggcaaggatgtgttcaacaccaagtctgtgggcctgagcatcaaggaggccatgacctaccaccccaaccaggtggtggagggctgctgcagcgacatggctgtgaccttcaacggcctgacccccaaccagatgcacgtgatgatgtatggagtgtaccgcctgcgggccttcggccacatcttcaatgatgccctggtgttcctgcccccaaatggaagtgacaatgactag

SEQ ID NO: 145609 - DNA, 957 bp, Artificial Sequence; identical to SEQ ID NO: 145608
  Description of Artificial Sequence: Synthetic coding sequence

SEQ ID NO: 145610 - DNA, 732 bp, Artificial Sequence
  Description of Artificial Sequence: Synthetic coding sequence
atgaggcccctgctggtgctgctgctgctgggcctggccgccggcagcccccccctggatgacaacaagatccccagcctgtgccccggccaccctggcctgcccggcaccccaggccaccacggcagccagggcctgcccggcagagatggaagagatggaagagatggagcccctggggcccctggagagaagggggagggcggccggcccggcctgcccggccccaggggggaccccggccccagaggagaggccggccctgctggccccaccggccctgctggagaatgttctgtgcccccaagaagtgccttcagcgccaagaggtctgagagccgggtgcccccacccagtgatgcccccctgccctttgacagagtgctggtgaatgagcagggccactatgatgctgtgacaggcaagttcacctgccaggtgcctggggtgtactactttgctgtgcacgccaccgtgtaccgggccagcctgcagtttgacctggtgaagaatggagagagcatcgccagcttcttccagttcttcggcggctggcccaagccagccagcctgagcggcggggccatggtgcggctggagcctgaggaccaggtgtgggtgcaggtgggcgtgggggactacatcggcatctatgccagcatcaagacagacagcaccttcagcggcttcctggtgtacagcgactggcacagcagccctgtgtttgcctag

SEQ ID NO: 145611 - DNA, 732 bp, Artificial Sequence; identical to SEQ ID NO: 145610
  Description of Artificial Sequence: Synthetic coding sequence

SEQ ID NO: 145612 - DNA, 759 bp, Artificial Sequence
  Description of Artificial Sequence: Synthetic coding sequence
atggccgccccagccctgctgctgctggccctgctgctgcctgtgggcgcctggccaggcctgccccggcggccctgtgtgcactgctgcaggcctgcctggcccccaggcccctatgcccgggtgtctgaccgggacctgtggaggggggacctgtggaggggcctgccccgggtgcggcccaccattgatattgagatcctgaagggggagaagggggaggccggcgtgcggggccgggccggccgcagcggcaaggagggccccccaggggcccggggcctgcagggccggcggggccagaagggccaggtgggccccccaggggccgcctgcagaagagcctatgctgccttctctgtgggcagaagagagggcctgcacagcagtgaccacttccaggccgtgccctttgacacagagctggtgaacctggatggagcctttgacctggccgccggccgcttcctgtgcaccgtgcctggggtgtacttcctgagcctgaatgtgcacacctggaactacaaggagacctacctgcacatcatgctgaacagaagacctgctgctgtgctgtatgcccagcccagcgagaggtctgtgatgcaggcccagagcctgatgctgctgctggccgctggagatgctgtgtgggtgaggatgttccagagggaccgggacaatgccatctatggagagcacggggacctgtacatcaccttcagcggccacctggtgaagccagctgctgagctgtag

SEQ ID NO: 145613 - DNA, 1002 bp, Artificial Sequence
  Description of Artificial Sequence: Synthetic coding sequence
atgaggatctggtggctgctgctggccatcgagatctgcaccggcaacatcaacagccaggacacctgccggcagggccaccctggcatccctggcaaccctggccacaacggcctgcccggcagagatggaagagatggagccaagggggacaagggagatgctggggagcccggccggcccggcagccctgggaaggatggcaccagcggggagaagggggagagaggagcagatggcaaggtggaggccaagggcatcaagggggaccagggcagccggggcagccctgggaagcacggccccaagggcctggccggccccatgggagagaagggcctgcggggggagaccggcccccagggccagaagggcaacaagggagatgtgggccccactggacctgagggcccccggggcaacatcggccccctgggccccaccggcctgcccggccccatgggccccatcggcaagccaggccccaagggggaggccggccccaccggcccccagggcgagcccggggtgcggggcatccggggctggaagggggacagaggagagaagggcaagattggagagaccctggtgctgcccaagagcgccttcaccgtgggcctgactgtgctgagcaagttccccagcagtgacatgcccatcaagtttgacaagatcctgtacaatgagttcaaccactatgacacagctgctgggaagttcacctgccacatcgccggcgtgtactacttcacctaccacatcaccgtcttcagcagaaatgtgcaggtgtccctggtgaagaatggagtgaagatcctgcacaccaaggatgcctacatgagcagcgaggaccaggccagcggcggcatcgtgctgcagctgaagctgggagatgaggtgtggctgcaggtgactggaggagagcgcttcaacggcctgtttgctgatgaagatgatgacaccaccttcaccggcttcctgctcttcagcagcccctag

SEQ ID NO: 145614 - DNA, 1002 bp, Artificial Sequence; identical to SEQ ID NO: 145613
  Description of Artificial Sequence: Synthetic coding sequence

SEQ ID NO: 145615 - DNA, 300 bp, Artificial Sequence
  Description of Artificial Sequence: Synthetic coding sequence
atgaggatctggtggctgctgctggccatcgagatctgcaccggcaacatcaacagccaggacacctgccggcagggccaccctggcatccctggcaaccctggccacaacggcctgcccggcagagatggaagagatggagccaagggggacaagggagatgctggggagcccggctgccccggcagccctgggaaggatggcaccagcggggagaagggggagagaggagcagatggcaaggtggaggccaagggcatcaagggcatgttccgctgcctgtggagcaagacagaatag

SEQ ID NO: 145616 - DNA, 1002 bp, Artificial Sequence
  Description of Artificial Sequence: Synthetic coding sequence
atgaggatctggtggctgctgctggccatcgagatctgcaccggcaacatcaacagccaggacacctgccggcagggccaccctggcatccctggcaaccctggccacaacggcctgcccggcagagatggaagagatggagccaagggggacaagggagatgctggggagcccggctgccccggcagccctgggaaggatggcaccagcggggagaagggggagagaggagcagatggcaaggtggaggccaagggcatcaagggggaccagggcagccggggcagccctgggaagcacggccccaagggcctggccggccccatgggagagaagggcctgcggggggagaccggcccccagggccagaagggcaacaagggagatgtgggccccactggacctgagggcccccggggcaacatcggccccctgggccccaccggcctgcccggccccatgggccccatcggcaagccaggccccaagggggaggccggccccaccggcccccagggcgagcccggggtgcggggcatccggggctggaagggggacagaggagagaagggcaagattggagagaccctggtgctgcccaagagcgccttcaccgtgggcctgactgtgctgagcaagttccccagcagtgatgtgcccatcaagtttgacaagatcctgtacaatgagttcaaccactatgacacagctgtgggcaagttcacctgccacatcgccggcgtgtactacttcacctaccacatcaccgtcttcagcagaaatgtgcaggtgtccctggtgaagaatggagtgaagatcctgcacaccagagatgcctacgtgtcctctgaggaccaggccagcggcagcatcgtgctgcagctgaagctgggagatgagatgtggctgcaggtgactggaggagagcgcttcaacggcctgtttgctgatgaagatgatgacaccaccttcaccggcttcctgctcttcagcagccagtag

SEQ ID NO: 145617 - DNA, 1002 bp, Artificial Sequence; identical to SEQ ID NO: 145616
  Description of Artificial Sequence: Synthetic coding sequence

SEQ ID NO: 145618 - DNA, 150 bp, Artificial Sequence
  Description of Artificial Sequence: Synthetic coding sequence
gtgggccccaccggccctgagggcccccggggcaacatcggccccctgggccccaccggcctgcccggccccatgggccccatcggcaagccaggccccaagggggaggccggccccaccggcccccaggtgttccccttctgcatctag

SEQ ID NO: 145619 - DNA, 1110 bp, Artificial Sequence
  Description of Artificial Sequence: Synthetic coding sequence
atgtggtgcctggagcggctgcggctgggccctgagtgcctgcggcgcagcggggactggctgctgcccggccgggcccggggggccaagagcaggaccacagctgcctgtgccaacgtgctgaccccagaccgcatccctgagttctgcatccccccccggctgatgccccggctggccctggccgccctgagaaattcctgggtggaggaggccggcatggatgaaggagctggccgcacagactgggaccccaggagccaggccgccctgagcctgccccacctgccccgggtgaggacagcctacggcttctgtgccctgctggagagcccccacaccaggaggaaggagagcctgctgctgggcggccccccagccccccggccccgggcccacacctatggaggcggcggcggcccagatgccctgctgggcaccctgcgggtgccccgggcccctggccctgccaccccagctgcccctggctgccccaggcctccccaggatgccctggcccggcggccccggggctgccgcctgctgcgggtgcctgatggcctgctgagccgggccctgcgggccggccgcagccggcggctgaccagggtgcgctctgtgtcctctggaaatgaagacaaggagcggcgggccggcagccagagccctgcccgggcccccagcaccagcccccccagcagccgggtgcccttccctgagcggctggaggccgagggcaccgtggccctgggccgggctggagatgccctgcggctggccgctgagtactgccccggcaccggccgcctgcggctgcggctgctgcgggcagagagccctgctggaggagcccctggccccagggctgtgtcctgccgcctgagcctggtgctgcggcccccaggcacagccctgcggcagtgcagcacagtggtgggccgcagcaggaaggccagctttgaccaggacttctgctttgatggcctgtctgaagatgaggtgcggcggctggccgtgcgggtgaaggccagagatgagggccggggccgggagcggggccgcctgctgggccagggcgagctgagcctgggcgccctgctgctgctgtag

SEQ ID NO: 145620 - DNA, 1095 bp, Artificial Sequence
  Description of Artificial Sequence: Synthetic coding sequence
atgaggctgctggagaagctgtgcagcagcgctgctggcagcagcgcccccaagccagcctttgccaaggtgctgacccccaaccgcatccctgagttctgcatccccccccggctgcctgccccctgcaccctggagagccccatccgggctgctgctgtgccccggcgctgtgccgctgagagtgacctgtggcccagggctgctgatgaagatgctggccgcacagactgggaccccaggagccaggccgccctgagcctgccccacctgccccgggtgaggaccacctacggcttctgtgccctgctggagagcccccacaccaggaggaaggagagcctgctgctgggcggccccccagccccccggccccgggcccacagctgtggcggcggcggcggcccagatgcccccctgggcaccctgtgtggcccccggggccctggccctgccaccccagctgcccctgggggcccccggctgccccaggatgccctggccgccggcccccggcgctgccgcctgctgcgggtgcctgatggcctgctgagccgggccctgcgggccggccgcagccggcggctggcccgggtgcgctctgtgtcctctggaaatgaagatgaggagaggagagctggcagcgagagccctgcccgggcccccagcagcagccccctgagcagccgggcccccctgcctgagcggctggaggccaagggcaccgtggccctgggccgggctggagatgccctgcggctggccgctgagtactgccccggcacccggcggctgcggctgcggctgctgcgggcagagagcctgtttggaggagcccctggccccagggctgtgcgctgccgcctgagcctggtgctgcggcccccaggcacagcccgctggcagtgcagcgctgtggtgggccgcagcaggaaggccagctttgaccaggacttctgctttgatggcctgtctgaagatgaggtgcggcggctggccgtgcgggtgaaggccagagatgagggccggggccgggaccggggccgcctgctgggccagggcgagctgagcctgggcgccctgctgctgctgtag

SEQ ID NO: 145621 - DNA, 1266 bp, Artificial Sequence
  Description of Artificial Sequence: Synthetic coding sequence
atgaggaagaccaacatgtggttcctggagcggctgcggggcagcggagaaaatggagctgcccggggcgtgggcagcgaggccggggacaaggccagcaagggccccctgtacagcaatgtgctgaccccagacaagatcccagacttcttcatcccccccaagctgcccagcggccctgctgagggggagggccaggccgccctgggccccagcaccagcgagcagaacctggccagcgctgccccccggcagacccccaggagcccccggctgcctgccaagctggccgctgagagcaagagcctgctgaaggccgccaccaggcatgtgatccagatcgagagcgctgaggactggctgtctgaggaggccacagatgctgacccccaggcccagggcgccatgagcctgcccagcgtgcccaaggcccagaccagctatggctttgccatgctggccgagagcccccacaccaggaggaaggagagcctcttccacagcgagcacggggccctggcccaggtgggcagccctggagctggaagaagaagagctgctgccaaggccaatggaggagatggcggcccccgggaggccggcggggccctgatgagccctggccgctacttcagcggcggggagagtgacaccggcagcagcgctgagagcagccccttcggcagccccctgctgagccgctctgtgtccctgctgaagggctttgcccaggacagccaggccaaggtgtcccagctgcggcacagcgtgggccgccacggcagcctgtctgcagatgacagcaccccagatgccagccctggcagcagaagaaggctgacccggcgggcccctcctgagcccggccctgagagcggccaggcccggggggagcacacagtgcacgtgggcccccggggctctgtgcggctgctggccgagtatgaagctggccaggcccggctgcgggtgcacctgctggccgctgagggcctgtatgaccggctgtgtgatgcccggagcatcaactgctgcgtgggcctgtgcctggtgcctgggaagctgcagaagcagaggagcaccatcgtgaagaacagcagaagacctgtgttcaatgaagacttcttctttgatggcctgggccctgcctctgtgaggaagctggccctgcgcatcaaggtggtgaacaagggcagcagcctgaagagggacaccctgctgggggagaaggagctgcccctgaccagcctgctgcccttcctgtag

SEQ ID NO: 145622 - DNA, 3945 bp, Artificial Sequence
  Description of Artificial Sequence: Synthetic coding sequence
atgctggaccccagcagcagcgaggaggagagtgatgagatcgtggaggaggagagcggcaaggaggtgctgggcagcgcccccagcggggcccggctgagccccagcaggaccagcgagggcagcgctggcagcgctggcctgggcggcggcggggccggggccggggccggcgtgggcgccggcggcggcggcggcagcggggccagcagcggcggcggggccggcggcctgcagcccagcagccgggccggcggcggccggcccagcagccccagccccagcgtggtgtctgagaaggagaaggaggagctggagcggctgcagaaggaggaggaggagaggaagaagaggctgcagctgtatgtgtttgtgatgcgctgcatcgcctaccccttcaatgccaagcagcccacagacatggcccggcggcagcagaagatcagcaagcagcagctgcagacagtgaaggaccgcttccaggccttcctgaatggagagacccagatcatggctgatgaggccttcatgaatgctgtgcagagctactatgaggtgttcctgaagagtgacagagtggccaggatggtgcagagcggcggctgcagcgccaatgacagccgggaggtgttcaagaagcacatcgagaagagggtgcgcagcctgcctgagattgatggcctgagcaaggagaccgtgctgagctcctggatggccaagtttgatgccatctacagaggagaggaggaccccaggaagcagcaggccaggatgacagccagcgctgccagcgagctgatcctgagcaaggagcagctgtatgagatgttccagaacatcctgggcatcaagaagtttgagcaccagctgctgtacaatgcctgccagctggacaacccagatgagcaggccgcccagatccggcgggagctggatggccgcctgcagatggctgaccagatcgcccgggagaggaagttccccaagtttgtgtccaaggagatggagaacatgtacatcgaggagctgaagagctctgtgaacctgctgatggccaacctggagagcatgcctgtgtccaaaggaggagagttcaagctgcagaagctgaagaggagccacaatgccagcatcatcgacatgggagaggagagcgagaaccagctgagcaagagtgatgtggtgctgtccttcagcctggaggtggtgatcatggaggtgcagggcctgaagagcctggcccccaaccgcatcgtgtactgcaccatggaggtggagggcggggagaagctgcagacagaccaggccgaggccagcaagcccacctggggcacccagggcgacttcagcaccacccacgccctgcctgctgtgaaggtgaagctgttcacagagagcactggagtgctggccctggaggacaaggagctgggccgggtcatcctgcaccccacccccaacagccccaagcagagcgagtggcacaagatgacagtgtccaagaactgcccagaccaggacctgaagatcaagctggccgtgaggatggacaagccccagaacatgaagcacagcggctacctgtgggccatcggcaagaatgtgtggaagcgctggaagaagcgcttctttgtgctggtgcaggtgtcccagtacacctttgccatgtgcagctaccgggagaagaaggccgagccccaggagctgctgcagctggatggctacacagtggactacacagacccccagcccggcctggagggcggccgggccttcttcaatgctgtgaaggagggggacaccgtcatctttgccagtgatgatgagcaggaccgcatcctgtgggtgcaggccatgtaccgggccaccggccagagccacaagcctgtgccccccacccaggtgcagaagctgaatgccaagggcggcaatgtgccccagctggatgcccccatcagccagttctatgctgaccgggcccagaagcacggcatggatgagttcatcagcagcaacccctgcaactttgaccacgccagcctgtttgagatggtgcagaggctgaccctggaccaccggctgaatgacagctacagctgcctgggctggttcagccctggccaggtgtttgtgctggatgagtactgtgccagaaatggagtgcggggctgccaccgccacctgtgctacctgcgggacctgctggagcgggcagaaaatggagccatgattgaccccaccctgctgcactacagctttgccttctgtgccagccacgtgcacggcaacagaccagatggcatcggcaccgtgacagtggaggagaaggagagatttgaggagatcaaggagcggctgcgggtgctgctggagaaccagatcacccacttccgctactgcttccccttcggccggcctgagggcgccctgaaggccaccctgagcctgctggagcgggtgctgatgaaggacatcgtgacccctgtgccccaggaggaggtgaagacagtcatcaggaagtgcctggagcaggccgccctggtgaactacagccggctgtctgaatatgccaagattgagggcaagaagcgggagatgtatgagcaccctgtgttctgcctggccagccaggtgatggacctgaccatccagaatgtgggccgcctcatcaccccagccaagaagctggaggacaccatccggctggccgagctggtgattgaggtgctgcagcagaatgaggagcaccacgccgaggcctttgcctggtggagcgacctgatggtggagcacgccgagaccttcctgagcctgtttgctgtggacatggatgctgccctggaggtgcagcccccagacacctgggacagcttccccctcttccagctgctgaatgacttcctgaggacagactacaacctgtgcaatggcaagttccacaagcacctgcaggacctgtttgcccccctggtggtgcgctacgtggacctgatggagagcagcatcgcccagagcatccaccggggctttgagcgggagagctgggagcctgtgaacaacggcagcggcaccagcgaggacctcttctggaagctggatgccctgcagaccttcatccgggacctgcactggccagaggaggagtttgggaagcacctggagcagaggctgaagctgatggccagtgacatgattgagagctgtgtgaagaggacccgcatcgcctttgaggtgaagctgcagaagaccagccgcagcacagacttccgggtgccccagagcatctgcaccatgttcaacgtgatggtggatgccaaggcccagagcaccaagctgtgcagcatggagatgggccaggagcaccagtaccacagcaagattgatgagctgattgaggagaccgtgaaggagatgatcaccctgctggtggccaagtttgtgaccatcctggagggcgtgctggccaagctgagccgctatgatgagggcaccctcttcagcagcttcctgtccttcaccgtgaaggccgccagcaaatatgtggatgtgcccaagccaggcatggatgtggctgatgcctacgtgacctttgtgcgccacagccaggatgtgctgcgggacaaggtgaatgaggagatgtacatcgagcggctgtttgaccagtggtacaacagctccatgaatgtcatctgcacctggctgacagacaggatggacctgcagctgcacatctaccagctgaagaccctcatccgcatggtgaagaagacctacagagacttccggctgcagggcgtgctggacagcaccctgaacagcaagacctatgagaccatccggaaccggctgactgtggaggaggccacagcctctgtgtctgagggcggcggcctgcagggcatctccatgaaggacagtgatgaagaagatgaggaggatgactag

SEQ ID NO: 145623 - DNA, 3825 bp, Artificial Sequence
  Description of Artificial Sequence: Synthetic coding sequence
atgctggaccccagcagcagcgaggaggagagtgatgagatcgtggaggaggagagcggcaaggaggtgctgggcagcgcccccagcggggcccggctgagccccagcaggaccagcgagggcagcgctggcagcgctggcctgggcggcggcggggccggggccggggccggcgtgggcgccggcggcggcggcggcagcggggccagcagcggcggcggggccggcggcctgcagcccagcagccgggccggcggcggccggcccagcagccccagccccagcgtggtgtctgagaaggagaaggaggagctggagcggctgcagaaggaggaggaggagaggaagaagaggctgcagctgtatgtgtttgtgatgcgctgcatcgcctaccccttcaatgccaagcagcccacagacatggcccggcggcagcagaagatcagcaagcagcagctgcagacagtgaaggaccgcttccaggccttcctgaatggagagacccagatcatggctgatgaggccttcatgaatgctgtgcagagctactatgaggtgttcctgaagagtgacagagtggccaggatggtgcagagcggcggctgcagcgccaatgacagccgggaggtgttcaagaagcacatcgagaagagggtgcgcagcctgcctgagattgatggcctgagcaaggagaccgtgctgagctcctggatggccaagtttgatgccatctacagaggagaggaggaccccaggaagcagcaggccaggatgacagccagcgctgccagcgagctgatcctgagcaaggagcagctgtatgagatgttccagaacatcctgggcatcaagaagtttgagcaccagctgctgtacaatgcctgccagctggacaacccagatgagcaggccgcccagatccggcgggagctggatggccgcctgcagatggctgaccagatcgcccgggagaggaagttccccaagtttgtgtccaaggagatggagaacatgtacatcgaggagctgaagagctctgtgaacctgctgatggccaacctggagagcatgcctgtgtccaaaggaggagagttcaagctgcagaagctgaagaggagccacaatgccagcatcatcgacatgggagaggagagcgagaaccagctgagcaagagtgatgtggtgctgtccttcagcctggaggtggtgatcatggaggtgcagggcctgaagagcctggcccccaaccgcatcgtgtactgcaccatggaggtggagggcggggagaagctgcagacagaccaggccgaggccagcaagcccacctggggcacccagggcgacttcagcaccacccacgccctgcctgctgtgaaggtgaagctgttcacagagagcactggagtgctggccctggaggacaaggagctgggccgggtcatcctgcaccccacccccaacagccccaagcagagcgagtggcacaagatgacagtgtccaagaactgcccagaccaggacctgaagatcaagctggccgtgaggatggacaagccccagaacatgaagcacagcggctacctgtgggccatcggcaagaatgtgtggaagcgctggaagaagcgcttctttgtgctggtgcaggtgtcccagtacacctttgccatgtgcagctaccgggagaagaaggccgagccccaggagctgctgcagctggatggctacacagtggactacacagacccccagcccggcctggagggcggccgggccttcttcaatgctgtgaaggagggggacaccgtcatctttgccagtgatgatgagcaggaccgcatcctgtgggtgcaggccatgtaccgggccaccggccagagccacaagcctgtgccccccacccaggtgcagaagctgaatgccaagggcggcaatgtgccccagctggatgcccccatcagccagttctatgctgaccgggcccagaagcacggcatggatgagttcatcagcagcaacccctgcaactttgaccacgccagcctgtttgagatgggctggttcagccctggccaggtgtttgtgctggatgagtactgtgccagaaatggagtgcggggctgccaccgccacctgtgctacctgcgggacctgctggagcgggcagaaaatggagccatgattgaccccaccctgctgcactacagctttgccttctgtgccagccacgtgcacggcaacagaccagatggcattggaacagtgacagtggaggagaaggagagatttgaggagatcaaggagcggctgcgggtgctgctggagaaccagatcacccacttccgctactgcttccccttcggccggcctgagggcgccctgaaggccaccctgagcctgctggagcgggtgctgatgaaggacatcgtgacccctgtgccccaggaggaggtgaagacagtcatcaggaagtgcctggagcaggccgccctggtgaactacagccggctgtctgaatatgccaagattgaggagaatgtgggccgcctcatcaccccagccaagaagctggaggacaccatccggctggccgagctggtgattgaggtgctgcagcagaatgaggagcaccacgccgaggcctttgcctggtggagcgacctgatggtggagcacgccgagaccttcctgagcctgtttgctgtggacatggatgctgccctggaggtgcagcccccagacacctgggacagcttccccctcttccagctgctgaatgacttcctgaggacagactacaacctgtgcaatggcaagttccacaagcacctgcaggacctgtttgcccccctggtggtgcgctacgtggacctgatggagagcagcatcgcccagagcatccaccggggctttgagcgggagagctgggagcctgtgaacaacggcagcggcaccagcgaggacctcttctggaagctggatgccctgcagaccttcatccgggacctgcactggccagaggaggagtttgggaagcacctggagcagaggctgaagctgatggccagtgacatgattgagagctgtgtgaagaggacccgcatcgcctttgaggtgaagctgcagaagaccagccgcagcacagacttccgggtgccccagagcatctgcaccatgttcaacgtgatggtggatgccaaggcccagagcaccaagctgtgcagcatggagatgggccaggagcaccagtaccacagcaagattgatgagctgattgaggagaccgtgaaggagatgatcaccctgctggtggccaagtttgtgaccatcctggagggcgtgctggccaagctgagccgctatgatgagggcaccctcttcagcagcttcctgtccttcaccgtgaaggccgccagcaaatatgtggatgtgcccaagccaggcatggatgtggctgatgcctacgtgacctttgtgcgccacagccaggatgtgctgcgggacaaggtgaatgaggagatgtacatcgagcggctgtttgaccagtggtacaacagctccatgaatgtcatctgcacctggctgacagacaggatggacctgcagctgcacatctaccagctgaagaccctcatccgcatggtgaagaagacctacagagacttccggctgcagggcgtgctggacagcaccctgaacagcaagacctatgagaccatccggaaccggctgactgtggaggaggccacagcctctgtgtctgagggcggcggcctgcagggcatctccatgaaggacagtgatgaagaagatgaggaggatgactag

SEQ ID NO: 145624 - DNA, 4080 bp, Artificial Sequence
  Description of Artificial Sequence: Synthetic coding sequence
atgctggaccccagcagcagcgaggaggagagtgatgagatcgtggaggaggagagcggcaaggaggtgctgggcagcgcccccagcggggcccggctgagccccagcaggaccagcgagggcagcgctggcagcgctggcctgggcggcggcggggccggggccggggccggcgtgggcgccggcggcggcggcggcagcggggccagcagcggcggcggggccggcggcctgcagcccagcagccgggccggcggcggccggcccagcagccccagccccagcgtggtgtctgagaaggagaaggaggagctggagcggctgcagaaggaggaggaggagaggaagaagaggctgcagctgtatgtgtttgtgatgcgctgcatcgcctaccccttcaatgccaagcagcccacagacatggcccggcggcagcagaagatcagcaagcagcagctgcagacagtgaaggaccgcttccaggccttcctgaatggagagacccagatcatggctgatgaggccttcatgaatgctgtgcagagctactatgaggtgttcctgaagagtgacagagtggccaggatggtgcagagcggcggctgcagcgccaatgacagccgggaggtgttcaagaagcacatcgagaagagggtgcgcagcctgcctgagattgatggcctgagcaaggagaccgtgctgagctcctggatggccaagtttgatgccatctacagaggagaggaggaccccaggaagcagcaggccaggatgacagccagcgctgccagcgagctgatcctgagcaaggagcagctgtatgagatgttccagaacatcctgggcatcaagaagtttgagcaccagctgctgtacaatgcctgccagctggacaacccagatgagcaggccgcccagatccggcgggagctggatggccgcctgcagatggctgaccagatcgcccgggagaggaagttccccaagtttgtgtccaaggagatggagaacatgtacatcgaggagctgaagagctctgtgaacctgctgatggccaacctggagagcatgcctgtgtccaaaggaggagagttcaagctgcagaagctgaagaggagccacaatgccagcatcatcgacatgggagaggagagcgagaaccagctgagcaagagtgatgtggtgctgtccttcagcctggaggtggtgatcatggaggtgcagggcctgaagagcctggcccccaaccgcatcgtgtactgcaccatggaggtggagggcggggagaagctgcagacagaccaggccgaggccagcaagcccacctggggcacccagggcgacttcagcaccacccacgccctgcctgctgtgaaggtgaagctgttcacagagagcactggagtgctggccctggaggacaaggagctgggccgggtcatcctgcaccccacccccaacagccccaagcagagcgagtggcacaagatgacagtgtccaagaactgcccagaccaggacctgaagatcaagctggccgtgaggatggacaagccccagaacatgaagcacagcggctacctgtgggccatcggcaagaatgtgtggaagcgctggaagaagcgcttctttgtgctggtgcaggtgtcccagtacacctttgccatgtgcagctaccgggagaagaaggccgagccccaggagctgctgcagctggatggctacacagtggactacacagacccccagcccggcctggagggcggccgggccttcttcaatgctgtgaaggagggggacaccgtcatctttgccagtgatgatgagcaggaccgcatcctgtgggtgcaggccatgtaccgggccaccggccagagccacaagcctgtgccccccacccaggtgcagaagctgaatgccaagggcggcaatgtgccccagctggatgcccccatcagccagttctatgctgaccgggcccagaagcacggcatggatgagttcatcagcagcaacccctgcaactttgaccacgccagcctgtttgagatggtgcagaggctgaccctggaccaccggctgaatgacagctacagctgcctgggctggttcagccctggccaggtgtttgtgctggatgagtactgtgccagaaatggagtgcggggctgccaccgccacctgtgctacctgcgggacctgctggagcgggcagaaaatggagccatgattgaccccaccctgctgcactacagctttgccttctgtgccagccacgtgcacggcaacagaccagatggcatcggcaccgtgacagtggaggagaaggagagatttgaggagatcaaggagcggctgcgggtgctgctggagaaccagatcacccacttccgctactgcttccccttcggccggcctgagggcgccctgaaggccaccctgagcctgctggagcgggtgctgatgaaggacatcgtgacccctgtgccccaggaggaggtgaagacagtcatcaggaagtgcctggagcaggccgccctggtgaactacagccggctgtctgaatatgccaagattgaggccaacagctgcaccacagaaaatgtgggccgcctcatcaccccagccaagaagctggaggacaccatccggctggccgagctggtgattgaggtgctgcagcagaatgaggagcaccacgccgagccccacgtggacaagggggaggcctttgcctggtggagcgacctgatggtggagcacgccgagaccttcctgagcctgtttgctgtggacatggatgctgccctggaggtgcagcccccagacacctgggacagcttccccctcttccagctgctgaatgacttcctgaggacagactacaacctgtgcaatggcaagttccacaagcacctgcaggacctgtttgcccccctggtggtgcgctacgtggacctgatggagagcagcatcgcccagagcatccaccggggctttgagcgggagagctgggagcctgtgaagagcctgaccagcaacctgcccaacgtgaacctgcccaacgtgaacctgcccaaggtgcccaacctgcctgtgaacatccccctgggcatcccccagatgcccaccttcagcgcccccagctggatggccgccatctatgatgctgacaatggaagtggcaccagtgaagatctcttctggaagctggatgccctgcagaccttcatccgggacctgcactggccagaggaggagtttgggaagcacctggagcagaggctgaagctgatggccagtgacatgattgagagctgtgtgaagaggaccagaattgcctttgaggtgaagctgcagaagaccagccgcagcacagacttccgggtgccccagagcatctgcaccatgtttaatgtgatggtggatgccaaggcccagagcaccaagctgtgcagcatggagatgggccaggagaagtacaagaagatgaggcaccagtaccacagcaagattgatgagctgattgaggagaccgtgaaggagatgatcaccctgctggtggccaagtttgtgaccatcctggagggcgtgctggccaagctgagccgctatgatgagggcaccctcttcagcagcttcctgtccttcaccgtgaaggccgccagcaaatatgtggatgtgcccaagccaggcatggatgtggctgatgcctacgtgacctttgtgcgccacagccaggatgtgctgcgggacaaggtgaatgaggagatgtacatcgagcggctgtttgaccagtggtacaacagctccatgaatgtcatctgcacctggctgacagacaggatggacctgcagctgcacatctaccagctgaagaccctcatccgcatggtgaagaagacctacagagacttccggctgcagggcgtgctggacagcaccctgaacagcaagacctatgagaccatccggaaccggctgactgtggaggaggccacagcctctgtgtctgagggcggcggcctgcagggcatctccatgaaggacagtgatgaggaggatgaagaagatgactag

SEQ ID NO: 145625 - DNA, 4062 bp, Artificial Sequence
  Description of Artificial Sequence: Synthetic coding sequence
atgctggaccccagcagcagcgaggaggagagtgatgagatcgtggaggaggagagcggcaaggaggtgctgggcagcgcccccagcggggcccggctgagccccagcaggaccagcgagggcagcgctggcagcgctggcctgggcggcggcggggccggggccggggccggcgtgggcgccggcggcggcggcggcagcggggccagcagcggcggcggggccggcggcctgcagcccagcagccgggccggcggcggccggcccagcagccccagccccagcgtggtgtctgagaaggagaaggaggagctggagcggctgcagaaggaggaggaggagaggaagaagaggctgcagctgtatgtgtttgtgatgcgctgcatcgcctaccccttcaatgccaagcagcccacagacatggcccggcggcagcagaagatcagcaagcagcagctgcagacagtgaaggaccgcttccaggccttcctgaatggagagacccagatcatggctgatgaggccttcatgaatgctgtgcagagctactatgaggtgttcctgaagagtgacagagtggccaggatggtgcagagcggcggctgcagcgccaatgacagccgggaggtgttcaagaagcacatcgagaagagggtgcgcagcctgcctgagattgatggcctgagcaaggagaccgtgctgagctcctggatggccaagtttgatgccatctacagaggagaggaggaccccaggaagcagcaggccaggatgacagccagcgctgccagcgagctgatcctgagcaaggagcagctgtatgagatgttccagaacatcctgggcatcaagaagtttgagcaccagctgctgtacaatgcctgccagctggacaacccagatgagcaggccgcccagatccggcgggagctggatggccgcctgcagatggctgaccagatcgcccgggagaggaagttccccaagtttgtgtccaaggagatggagaacatgtacatcgaggagctgaagagctctgtgaacctgctgatggccaacctggagagcatgcctgtgtccaaaggaggagagttcaagctgcagaagctgaagaggagccacaatgccagcatcatcgacatgggagaggagagcgagaaccagctgagcaagagtgatgtggtgctgtccttcagcctggaggtggtgatcatggaggtgcagggcctgaagagcctggcccccaaccgcatcgtgtactgcaccatggaggtggagggcggggagaagctgcagacagaccaggccgaggccagcaagcccacctggggcacccagggcgacttcagcaccacccacgccctgcctgctgtgaaggtgaagctgttcacagagagcactggagtgctggccctggaggacaaggagctgggccgggtcatcctgcaccccacccccaacagccccaagcagagcgagtggcacaagatgacagtgtccaagaactgcccagaccaggacctgaagatcaagctggccgtgaggatggacaagccccagaacatgaagcacagcggctacctgtgggccatcggcaagaatgtgtggaagcgctggaagaagcgcttctttgtgctggtgcaggtgtcccagtacacctttgccatgtgcagctaccgggagaagaaggccgagccccaggagctgctgcagctggatggctacacagtggactacacagacccccagcccggcctggagggcggccgggccttcttcaatgctgtgaaggagggggacaccgtcatctttgccagtgatgatgagcaggaccgcatcctgtgggtgcaggccatgtaccgggccaccggccagagccacaagcctgtgccccccacccaggtgcagaagctgaatgccaagggcggcaatgtgccccagctggatgcccccatcagccagttctatgctgaccgggcccagaagcacggcatggatgagttcatcagcagcaacccctgcaactttgaccacgccagcctgtttgagatggtgcagaggctgaccctggaccaccggctgaatgacagctacagctgcctgggctggttcagccctggccaggtgtttgtgctggatgagtactgtgccagaaatggagtgcggggctgccaccgccacctgtgctacctgcgggacctgctggagcgggcagaaaatggagccatgattgaccccaccctgctgcactacagctttgccttctgtgccagccacgtgcacggcaacagaccagatggcatcggcaccgtgacagtggaggagaaggagagatttgaggagatcaaggagcggctgcgggtgctgctggagaaccagatcacccacttccgctactgcttccccttcggccggcctgagggcgccctgaaggccaccctgagcctgctggagcgggtgctgatgaaggacatcgtgacccctgtgccccaggaggaggtgaagacagtcatcaggaagtgcctggagcaggccgccctggtgaactacagccggctgtctgaatatgccaagattgaggagaaccagaaggatgctgaaaatgtgggccgcctcatcaccccagccaagaagctggaggacaccatccggctggccgagctggtgattgaggtgctgcagcagaatgaggagcaccacgccgagccccacgtggacaagggggaggcctttgcctggtggagcgacctgatggtggagcacgccgagaccttcctgagcctgtttgctgtggacatggatgctgccctggaggtgcagcccccagacacctgggacagcttccccctcttccagctgctgaatgacttcctgaggacagactacaacctgtgcaatggcaagttccacaagcacctgcaggacctgtttgcccccctggtggtgcgctacgtggacctgatggagagcagcatcgcccagagcatccaccggggctttgagcgggagagctgggagcctgtgaagagcctgaccagcaacctgcccaacgtgaacctgcccaacgtgaacctgcccaaggtgcccaacctgcctgtgaacatccccctgggcatcccccagatgcccaccttcagcgcccccagctggatggccgccatctatgatgctgacaatggaagtggcaccagtgaagatctcttctggaagctggatgccctgcagaccttcatccgggacctgcactggccagaggaggagtttgggaagcacctggagcagaggctgaagctgatggccagtgacatgattgagagctgtgtgaagaggaccagaattgcctttgaggtgaagctgcagaagaccagccgcagcacagacttccgggtgccccagagcatctgcaccatgtttaatgtgatggtggatgccaaggcccagagcaccaagctgtgcagcatggagatgggccaggagcaccagtaccacagcaagattgatgagctgattgaggagaccgtgaaggagatgatcaccctgctggtggccaagtttgtgaccatcctggagggcgtgctggccaagctgagccgctatgatgagggcaccctcttcagcagcttcctgtccttcaccgtgaaggccgccagcaaatatgtggatgtgcccaagccaggcatggatgtggctgatgcctacgtgacctttgtgcgccacagccaggatgtgctgcgggacaaggtgaatgaggagatgtacatcgagcggctgtttgaccagtggtacaacagctccatgaatgtcatctgcacctggctgacagacaggatggacctgcagctgcacatctaccagctgaagaccctcatccgcatggtgaagaagacctacagagacttccggctgcagggcgtgctggacagcaccctgaacagcaagacctatgagaccatccggaaccggctgactgtggaggaggccacagcctctgtgtctgagggcggcggcctgcagggcatctccatgaaggacagtgatgaggaggatgaagaagatgactag

SEQ ID NO: 145626 - DNA, 1038 bp, Artificial Sequence
  Description of Artificial Sequence: Synthetic coding sequence
tgactgcccaacgtgaacctgcccaacgtgaacctgcccaaggtgcccaacctgcctgtgaacatccccctgggcatcccccagatgcccaccttcagcgcccccagctggatggccgccatctatgatgctgacaatggcagcggcaccagcgaggacctcttctggaagctggatgccctgcagaccttcatccgggacctgcactggccagaggaggagtttgggaagcacctggagcagaggctgaagctgatggccagtgacatgattgagagctgtgtgaagaggacccgcatcgcctttgaggtgaagctgcagaagaccagccgcagcacagacttccgggtgccccagagcatctgcaccatgttcaacgtgatggtggatgccaaggcccagagcaccaagctgtgcagcatggagatgggccaggagtttgccaagatgtggcaccagtaccacagcaagattgatgagctgattgaggagaccgtgaaggagatgatcaccctgctggtggccaagtttgtgaccatcctggagggcgtgctggccaagctgagccgctatgatgagggcaccctcttcagcagcttcctgtccttcaccgtgaaggccgccagcaaatatgtggatgtgcccaagccaggcatggatgtggctgatgcctacgtgacctttgtgcgccacagccaggatgtgctgcgggacaaggtgaatgaggagatgtacatcgagcggctgtttgaccagtggtacaacagctccatgaatgtcatctgcacctggctgacagacaggatggacctgcagctgcacatctaccagctgaagaccctcatccgcatggtgaagaagacctacagagacttccggctgcagggcgtgctggacagcaccctgaacagcaagacctatgagaccatccggaaccggctgactgtggaggaggccacagcctctgtgtctgagggcggcggcctgcagggcatctccatgaaggacagtgatgaggaggatgaagaagatgactag

SEQ ID NO: 145627 - DNA, 3768 bp, Artificial Sequence
  Description of Artificial Sequence: Synthetic coding sequence
atgctggaccccagcagcagcgaggaggagagtgatgagggcctggaggaggagagcagagatgtgctggtggccgccggcagcagccagagggcccccccagcccccacccgggagggcagaagagatgcccctggccgggccggcggcggcggggccgcccggtctgtgagccccagccccagcgtgctgtctgagggcagagatgagccccagaggcagctggatgatgagcaggagcggcgcatccggctgcagctgtatgtgtttgtggtgcgctgcatcgcctaccccttcaatgccaagcagcccacagacatggcccggcggcagcagaagctgaacaagcagcagctgcagctgctgaaggagcgcttccaggccttcctgaatggagagacccagatcgtggctgatgaggccttctgcaatgctgtgcgcagctactatgaggtgttcctgaagagtgacagagtggccaggatggtgcagagcggcggctgcagcgccaatgacttccgggaggtgttcaagaagaacatcgagaagagggtgcgcagcctgcctgagattgatggcctgagcaaggagaccgtgctgagctcctggatcgccaagtatgatgccatctacagaggagaggaggacctgtgcaagcagcccaacaggatggccctgtctgctgtgtctgagctgatcctgagcaaggagcagctgtatgagatgttccagcagatcctgggcatcaagaagctggagcaccagctgctgtacaatgcctgccagctggacaatgctgatgagcaggccgcccagatccggcgggagctggatggccgcctgcagctggccgacaagatggccaaggagaggaagttccccaagttcatcgccaaggacatggagaacatgtacatcgaggagctgcggagctctgtgaacctgctgatggccaacctggagagcctgcctgtgtccaaaggaggccctgagttcaagctgcagaagctgaagaggagccagaacagcgccttcctggacattggagatgaaaatgagatccagctgagcaagagtgatgtggtgctgtccttcaccctggagatcgtcatcatggaggtgcagggcctgaagtctgtggcccccaacagaattgtgtactgcaccatggaggtggagggggagaagctgcagacagaccaggccgaggccagccggccccagtggggcacccagggcgacttcaccaccacccaccccaggcctgtggtgaaggtgaagctgttcacagagagcactggagtgctggccctggaggacaaggagctgggccgggtcatcctgtaccccaccagcaacagcagcaagtctgctgagctgcacaggatggtggtgcccaagaacagccaggacagcgacctgaagatcaagctggccgtgaggatggacaagccagcccacatgaagcacagcggctacctgtatgccctgggccagaaggtgtggaagcgctggaagaagcgctactttgtgctggtgcaggtgtcccagtacacctttgccatgtgcagctaccgggagaagaagtctgagccccaggagctgatgcagctggagggctacacagtggactacacagacccccaccctggcctgcagggcggctgcatgttcttcaatgctgtgaaggagggggacaccgtcatctttgccagtgatgatgagcaggaccgcatcctgtgggtgcaggccatgtaccgggccaccggccagagctacaagcctgtgcctgccatccagacccagaagctgaaccccaagggcggcaccctgcatgctgatgcccagctgtatgctgaccgcttccagaagcacggcatggatgagttcatcagcgccaacccctgcaagctggaccacgccttcctgttccgcatcctgcagaggcagaccctggaccaccggctgaatgacagctacagctgcctgggctggttcagccctggccaggtgtttgtgctggatgagtactgtgcccgctatggagtgcggggctgccaccgccacctgtgctacctggccgagctgatggagcacagtgaaaatggagctgtgattgaccccaccctgctgcactacagctttgccttctgtgccagccacgtgcacggcaacagaccagatggcatcggcaccgtgtctgtggaggagaaggagagatttgaggagatcaaggagcggctgagcagcctgctggagaaccagatcagccacttccgctactgcttccccttcggccggcctgagggcgccctgaaggccaccctgagcctgctggagcgggtgctgatgaaggacatcgccacccccatcccagctgaggaggtgaagaaggtggtgaggaagtgcctggagaaggccgccctgatcaactacacccggctgacagaatatgccaagattgaggagaccatgaaccaggccagccctgccaggaagctggaggagatcctgcacctggccgagctgtgcatcgaggtgctgcagcagaatgaggagcaccacgccgaggcctttgcctggtggccagacctgctggccgagcacgccgagaagttctgggccctcttcaccgtggacatggacacagccctggaggcccagccccaggacagctgggacagcttccccctcttccagctgctgaacaacttcctgagaaatgacaccctgctgtgcaatggcaagttccacaagcacctgcaggagatctttgtgcccctggtggtgcgctacgtggacctgatggagagcagcatcgcccagagcatccaccggggctttgagcaggagacctggcagcctgtgaacaacggcagcgccaccagcgaggacctcttctggaagctggatgccctgcagatgtttgtgtttgacctgcactggccagagcaggagtttgcccaccacctggagcagaggctgaagctgatggccagtgacatgctggaggcctgtgtgaagaggaccaggacagcctttgagctgaagctgcagaaggccagcaagaccacagacctgcgcatcccagcctctgtgtgcaccatgttcaacgtgctggtggatgccaagaagcagagcaccaagctgtgtgccctggatggcggccaggaggtgtgccgcatcttccagcagtaccacagcaagattgatgacctgattgacaacagcgtgaaggagatcatcagcctgctggtgtccaagtttgtgtctgtgctggagggcgtgctgagcaagctgagccgctatgatgagggcaccttcttcagcagcatcctgtccttcaccgtgaaggccgccgccaagtatgtggatgtgcccaagccaggcatggacctggccgacacctacatcatgtttgtgcggcagaaccaggacatcctgcgggagaaggtgaatgaggagatgtacatcgagaagctgtttgaccagtggtacagcagctccatgaaggtgatctgtgtgtggctgacagaccggctggacctgcagctgcacatctaccagctgaagaccctcatcaagatcgtgaagaagacctacagagacttccggctgcagggcgtgctggagggcaccctgaacagcaagacctatgacacagtgcaccggcggctgactgtggaggaggccacagcctctgtgtctgagggcggcggcctgcagggcatcaccatgaaggacagtgatgaggaggaggagggctag

SEQ ID NO: 145628 - DNA, 3885 bp, Artificial Sequence
  Description of Artificial Sequence: Synthetic coding sequence
atgctggaccccagcagcagcgaggaggagagtgatgagggcctggaggaggagagcagagatgtgctggtggccgccggcagcagccagagggcccccccagcccccacccgggagggcagaagagatgcccctggccgggccggcggcggcggggccgcccggtctgtgagccccagccccagcgtgctgtctgagggcagagatgagccccagaggcagctggatgatgagcaggagcggcgcatccggctgcagctgtatgtgtttgtggtgcgctgcatcgcctaccccttcaatgccaagcagcccacagacatggcccggcggcagcagaagctgaacaagcagcagctgcagctgctgaaggagcgcttccaggccttcctgaatggagagacccagatcgtggctgatgaggccttctgcaatgctgtgcgcagctactatgaggtgttcctgaagagtgacagagtggccaggatggtgcagagcggcggctgcagcgccaatgacttccgggaggtgttcaagaagaacatcgagaagagggtgcgcagcctgcctgagattgatggcctgagcaaggagaccgtgctgagctcctggatcgccaagtatgatgccatctacagaggagaggaggacctgtgcaagcagcccaacaggatggccctgtctgctgtgtctgagctgatcctgagcaaggagcagctgtatgagatgttccagcagatcctgggcatcaagaagctggagcaccagctgctgtacaatgcctgccagctggacaatgctgatgagcaggccgcccagatccggcgggagctggatggccgcctgcagctggccgacaagatggccaaggagaggaagttccccaagttcatcgccaaggacatggagaacatgtacatcgaggagctgcggagctctgtgaacctgctgatggccaacctggagagcctgcctgtgtccaaaggaggccctgagttcaagctgcagaagctgaagaggagccagaacagcgccttcctggacattggagatgaaaatgagatccagctgagcaagagtgatgtggtgctgtccttcaccctggagatcgtcatcatggaggtgcagggcctgaagtctgtggcccccaacagaattgtgtactgcaccatggaggtggagggggagaagctgcagacagaccaggccgaggccagccggccccagtggggcacccagggcgacttcaccaccacccaccccaggcctgtggtgaaggtgaagctgttcacagagagcactggagtgctggccctggaggacaaggagctgggccgggtcatcctgtaccccaccagcaacagcagcaagtctgctgagctgcacaggatggtggtgcccaagaacagccaggacagcgacctgaagatcaagctggccgtgaggatggacaagccagcccacatgaagcacagcggctacctgtatgccctgggccagaaggtgtggaagcgctggaagaagcgctactttgtgctggtgcaggtgtcccagtacacctttgccatgtgcagctaccgggagaagaagtctgagccccaggagctgatgcagctggagggctacacagtggactacacagacccccaccctggcctgcagggcggctgcatgttcttcaatgctgtgaaggagggggacaccgtcatctttgccagtgatgatgagcaggaccgcatcctgtgggtgcaggccatgtaccgggccaccggccagagctacaagcctgtgcctgccatccagacccagaagctgaaccccaagggcggcaccctgcatgctgatgcccagctgtctgagttcacagatgctgaccgcttccagaagcacggcatggatgagttcatcagcgccaacccctgcaagctggaccacgccttcctgttccgcatcctgcagaggcagaccctggaccaccggctgaatgacagctacagctgcctgggctggttcagccctggccaggtgtttgtgctggatgagtactgtgcccgctatggagtgcggggctgccaccgccacctgtgctacctggccgagctgatggagcacagtgaaaatggagctgtgattgaccccaccctgctgcactacagctttgccttctgtgccagccacgtgcacggcaacagaccagatggcatcggcaccgtgtctgtggaggagaaggagagatttgaggagatcaaggagcggctgagcagcctgctggagaaccagatcagccacttccgctactgcttccccttcggccggcctgagggcgccctgaaggccaccctgagcctgctggagcgggtgctgatgaaggacatcgccacccccatcccagctgaggaggtgaagaaggtggtgaggaagtgcctggagaaggccgccctgatcaactacacccggctgacagaatatgccaagattgaggagaccatgaaccaggccagccctgccaggaagctggaggagatcctgcacctggccgagctgtgcatcgaggtgctgcagcagaatgaggagcaccacgccgaggcctttgcctggtggccagacctgctggccgagcacgccgagaagttctgggccctcttcaccgtggacatggacacagccctggaggcccagccccaggacagctgggacagcttccccctcttccagctgctgaacaacttcctgagaaatgacaccctgctgtgcaatggcaagttccacaagcacctgcaggagatctttgtgcccctggtggtgcgctacgtggacctgatggagagcagcatcgcccagagcatccaccggggctttgagcaggagacctggcagcctgtgaagaacatcgccaacagcctgcccaacgtggccctgcccaaggtgcccagcctgcccctgaacctgccccagatccccaacatcagcacagcctcctggatgcccagcctgtatgagagcaccaacggcagcgccaccagcgaggacctcttctggaagctggatgccctgcagatgtttgtgtttgacctgcactggccagagcaggagtttgcccaccacctggagcagaggctgaagctgatggccagtgacatgctggaggcctgtgtgaagaggaccaggacagcctttgagctgaagctgcagaaggccagcaagaccacagacctgcgcatcccagcctctgtgtgcaccatgttcaacgtgctggtggatgccaagaagcagagcaccaagctgtgtgccctggatggcggccaggagcagcagtaccacagcaagattgatgacctgattgacaacagcgtgaaggagatcatcagcctgctggtgtccaagtttgtgtctgtgctggagggcgtgctgagcaagctgagccgctatgatgagggcaccttcttcagcagcatcctgtccttcaccgtgaaggctgctgccaagtatgtggatgtgcccaagccaggcatggacctggccgacacctacatcatgtttgtgcggcagaaccaggacatcctgcgggagaaggtgaatgaggagatgtacatcgagaagctgtttgaccagtggtacagcagctccatgaaggtgatctgtgtgtggctgacagaccggctggacctgcagctgcacatctaccagctgaagaccctcatcaagatcgtgaagaagacctacagagacttccggctgcagggcgtgctggagggcaccctgaacagcaagacctatgacacagtgcaccggcggctgactgtggaggaggccacagcctctgtgtctgagggcggcggcctgcagggcatcaccatgaaggacagtgatgaggaggaggagggctag

SEQ ID NO: 145629 - DNA, 1410 bp, Artificial Sequence
  Description of Artificial Sequence: Synthetic coding sequence
atgaaccaggccagccctgccaggaagctggaggagatcctgcacctggccgagctgtgcatcgaggtgctgcagcagaatgaggagcaccacgccgagctgcggcatgcctttgcctggtggccagacctgctggccgagcacgccgagaagttctgggccctcttcaccgtggacatggacacagccctggaggcccagccccaggacagctgggacagcttccccctcttccagctgctgaacaacttcctgagaaatgacaccctgctgtgcaatggcaagttccacaagcacctgcaggagatctttgtgcccctggtggtgcgctacgtggacctgatggagagcagcatcgcccagagcatccaccggggctttgagcaggagacctggcagcctgtgaagaacatcgccaacagcctgcccaacgtggccctgcccaaggtgcccagcctgcccctgaacctgccccagatccccaacatcagcacagcctcctggatgcccagcctgtatgagagcaccaatggaagtgccaccagtgaagatctcttctggaagctggatgccctgcagatgtttgtgtttgacctgcactggccagagcaggagtttgcccaccacctggagcagaggctgaagctgatggccagtgacatgctggaggcctgtgtgaagaggaccaggacagcctttgagctgaagctgcagaaggccagcaagaccacagacctgcgcatcccagcctctgtgtgcaccatgtttaatgtgctggtggatgccaagaagcagagcaccaagctgtgtgccctggatggcggccaggagcagcagtaccacagcaagattgatgacctgattgacaacagcgtgaaggagatcatcagcctgctggtgtccaagtttgtgtctgtgctggagggcgtgctgagcaagctgagccgctatgatgagggcaccttcttcagcagcatcctgtccttcaccgtgaaggccgccgccaagtatgtggatgtgcccaagccaggcatggacctggccgacacctacatcatgtttgtgcggcagaaccaggacatcctgcgggagaaggtgaatgaggagatgtacatcgagaagctgtttgaccagtggtacagcagctccatgaaggtgatctgtgtgtggctgacagaccggctggacctgcagctgcacatctaccagctgaagaccctcatcaagatcgtgaagaagacctacagagacttccggctgcagggcgtgctggagggcaccctgaacagcaagacctatgacacagtgcaccggcggctgactgtggaggaggccacagcctctgtgtctgagggcggcggcctgcagggcatcaccatgaaggacagtgatgaggaggaggagggctag

SEQ ID NO: 145630 - DNA, 2700 bp, Artificial Sequence
  Description of Artificial Sequence: Synthetic coding sequence
tgagaaatccagctgagcaagagtgatgtggtgctgtccttcaccctggagatcgtcatcatggaggtgcagggcctgaagtctgtggcccccaaccgcatcgtgtactgcaccatggaggtggagggggagaagctgcagacagaccaggccgaggccagccggccccagtggggcacccagggcgacttcaccaccacccaccccaggcctgtggtgaaggtgaagctgttcacagagagcactggagtgctggccctggaggacaaggagctgggccgggtcatcctgtaccccaccagcaacagcagcaagtctgctgagctgcacaggatggtggtgcccaagaacagccaggacagcgacctgaagatcaagctggccgtgaggatggacaagccagcccacatgaagcacagcggctacctgtatgccctgggccagaaggtgtggaagcgctggaagaagcgctactttgtgctggtgcaggtgtcccagtacacctttgccatgtgcagctaccgggagaagaagtctgagccccaggagctgatgcagctggagggctacacagtggactacacagacccccaccctggcctgcagggcggctgcatgttcttcaatgctgtgaaggagggggacaccgtcatctttgccagtgatgatgagcaggaccgcatcctgtgggtgcaggccatgtaccgggccaccggccagagctacaagcctgtgcctgccatccagacccagaagctgaaccccaagggcggcaccctgcacgcagatgcccagctgtatgctgaccgcttccagaagcacggcatggatgagttcatcagcgccaacccctgcaagctggaccacgccttcctgttccgcatcctgcagaggcagaccctggaccaccggctgaatgacagctacagctgcctgggctggttcagccctggccaggtgtttgtgctggatgagtactgtgcccgctatggagtgcggggctgccaccgccacctgtgctacctggccgagctgatggagcacagtgaaaatggagctgtgattgaccccaccctgctgcactacagctttgccttctgtgccagccacgtgcacggcaacagaccagatggcattggaacagtgtctgtggaggagaaggagagatttgaggagatcaaggagcggctgagcagcctgctggagaaccagatcagccacttccgctactgcttccccttcggccggcctgagggcgccctgaaggccaccctgagcctgctggagcgggtgctgatgaaggacatcgccacccccatcccagctgaggaggtgaagaaggtggtgaggaagtgcctggagaaggccgccctgatcaactacacccggctgacagaatatgccaagattgaggagaccatgaaccaggccagccctgccaggaagctggaggagatcctgcacctggccgagctgtgcatcgaggtgctgcagcagaatgaggagcaccacgccgaggcctttgcctggtggccagacctgctggccgagcacgccgagaagttctgggccctcttcaccgtggacatggacacagccctggaggcccagccccaggacagctgggacagcttccccctcttccagctgctgaacaacttcctgagaaatgacaccctgctgtgcaatggcaagttccacaagcacctgcaggagatctttgtgcccctggtggtgcgctacgtggacctgatggagagcagcatcgcccagagcatccaccggggctttgagcaggagacctggcagcctgtgaacaatggaagtgccaccagtgaagatctcttctggaagctggatgccctgcagatgtttgtgtttgacctgcactggccagagcaggagtttgcccaccacctggagcagaggctgaagctgatggccagtgacatgctggaggcctgtgtgaagaggaccaggacagcctttgagctgaagctgcagaaggccagcaagaccacagacctgcgcatcccagcctctgtgtgcaccatgtttaatgtgctggtggatgccaagaagcagagcaccaagctgtgtgccctggatggcggccaggagcagcagtaccacagcaagattgatgacctgattgacaacagcgtgaaggagatcatcagcctgctggtgtccaagtttgtgtctgtgctggagggcgtgctgagcaagctgagccgctatgatgagggcaccttcttcagcagcatcctgtccttcaccgtgaaggccgccgccaagtatgtggatgtgcccaagccaggcatggacctggccgacacctacatcatgtttgtgcggcagaaccaggacatcctgcgggagaaggtgaatgaggagatgtacatcgagaagctgtttgaccagtggtacagcagctccatgaaggtgatctgtgtgtggctgacagaccggctggacctgcagctgcacatctaccagctgaagaccctcatcaagatcgtgaagaagacctacagagacttccggctgcagggcgtgctggagggcaccctgaacagcaagacctatgacacagtgcaccggcggctgactgtggaggaggccacagcctctgtgtctgagggcggcggcctgcagggcatcaccatgaaggacagtgatgaggaggaggagggctag

SEQ ID NO: 145631 - DNA, 3768 bp, Artificial Sequence
  Description of Artificial Sequence: Synthetic coding sequence
atgctggaccccagcagcagcgaggaggagagtgatgagggcctggaggaggagagcagagatgtgctggtggccgccggcagcagccagagggcccccccagcccccacccgggagggcagaagagatgcccctggccgggccggcggcggcggggccgcccggtctgtgagccccagccccagcgtgctgtctgagggcagagatgagccccagaggcagctggatgatgagcaggagcggcgcatccggctgcagctgtatgtgtttgtggtgcgctgcatcgcctaccccttcaatgccaagcagcccacagacatggcccggcggcagcagaagctgaacaagcagcagctgcagctgctgaaggagcgcttccaggccttcctgaatggagagacccagatcgtggctgatgaggccttctgcaatgctgtgcgcagctactatgaggtgttcctgaagagtgacagagtggccaggatggtgcagagcggcggctgcagcgccaatgacttccgggaggtgttcaagaagaacatcgagaagagggtgcgcagcctgcctgagattgatggcctgagcaaggagaccgtgctgagctcctggatcgccaagtatgatgccatctacagaggagaggaggacctgtgcaagcagcccaacaggatggccctgtctgctgtgtctgagctgatcctgagcaaggagcagctgtatgagatgttccagcagatcctgggcatcaagaagctggagcaccagctgctgtacaatgcctgccagctggacaatgctgatgagcaggccgcccagatccggcgggagctggatggccgcctgcagctggccgacaagatggccaaggagaggaagttccccaagttcatcgccaaggacatggagaacatgtacatcgaggagctgcggagctctgtgaacctgctgatggccaacctggagagcctgcctgtgtccaaaggaggccctgagttcaagctgcagaagctgaagaggagccagaacagcgccttcctggacattggagatgaaaatgagatccagctgagcaagagtgatgtggtgctgtccttcaccctggagatcgtcatcatggaggtgcagggcctgaagtctgtggcccccaacagaattgtgtactgcaccatggaggtggagggggagaagctgcagacagaccaggccgaggccagccggccccagtggggcacccagggcgacttcaccaccacccaccccaggcctgtggtgaaggtgaagctgttcacagagagcactggagtgctggccctggaggacaaggagctgggccgggtcatcctgtaccccaccagcaacagcagcaagtctgctgagctgcacaggatggtggtgcccaagaacagccaggacagcgacctgaagatcaagctggccgtgaggatggacaagccagcccacatgaagcacagcggctacctgtatgccctgggccagaaggtgtggaagcgctggaagaagcgctactttgtgctggtgcaggtgtcccagtacacctttgccatgtgcagctaccgggagaagaagtctgagccccaggagctgatgcagctggagggctacacagtggactacacagacccccaccctggcctgcagggcggctgcatgttcttcaatgctgtgaaggagggggacaccgtcatctttgccagtgatgatgagcaggaccgcatcctgtgggtgcaggccatgtaccgggccaccggccagagctacaagcctgtgcctgccatccagacccagaagctgaaccccaagggcggcaccctgcatgctgatgcccagctgtatgctgaccgcttccagaagcacggcatggatgagttcatcagcgccaacccctgcaagctggaccacgccttcctgttccgcatcctgcagaggcagaccctggaccaccggctgaatgacagctacagctgcctgggctggttcagccctggccaggtgtttgtgctggatgagtactgtgcccgctatggagtgcggggctgccaccgccacctgtgctacctggccgagctgatggagcacagtgaaaatggagctgtgattgaccccaccctgctgcactacagctttgccttctgtgccagccacgtgcacggcaacagaccagatggcatcggcaccgtgtctgtggaggagaaggagagatttgaggagatcaaggagcggctgagcagcctgctggagaaccagatcagccacttccgctactgcttccccttcggccggcctgagggcgccctgaaggccaccctgagcctgctggagcgggtgctgatgaaggacatcgccacccccatcccagctgaggaggtgaagaaggtggtgaggaagtgcctggagaaggccgccctgatcaactacacccggctgacagaatatgccaagattgaggagaccatgaaccaggccagccctgccaggaagctggaggagatcctgcacctggccgagctgtgcatcgaggtgctgcagcagaatgaggagcaccacgccgaggcctttgcctggtggccagacctgctggccgagcacgccgagaagttctgggccctcttcaccgtggacatggacacagccctggaggcccagccccaggacagctgggacagcttccccctcttccagctgctgaacaacttcctgagaaatgacaccctgctgtgcaatggcaagttccacaagcacctgcaggagatctttgtgcccctggtggtgcgctacgtggacctgatggagagcagcatcgcccagagcatccaccggggctttgagcaggagacctggcagcctgtgaacaacggcagcgccaccagcgaggacctcttctggaagctggatgccctgcagatgtttgtgtttgacctgcactggccagagcaggagtttgcccaccacctggagcagaggctgaagctgatggccagtgacatgctggaggcctgtgtgaagaggaccaggacagcctttgagctgaagctgcagaaggccagcaagaccacagacctgcgcatcccagcctctgtgtgcaccatgttcaacgtgctggtggatgccaagaagcagagcaccaagctgtgtgccctggatggcggccaggagtttggcagccagtggcagcagtaccacagcaagattgatgacctgattgacaacagcgtgaaggagatcatcagcctgctggtgtccaagtttgtgtctgtgctggagggcgtgctgagcaagctgagccgctatgatgagggcaccttcttcagcagcatcctgtccttcaccgtgaaggccgccgccaagtatgtggatgtgcccaagccaggcatggacctggccgacacctacatcatgtttgtgcggcagaaccaggacatcctgcgggagaaggtgaatgaggagatgtacatcgagaagctgtttgaccagtggtacagcagctccatgaaggtgatctgtgtgtggctgacagaccggctggacctgcagctgcacatctaccagctgaagaccctcatcaagatcgtgaagaagacctacagagacttccggctgcagggcgtgctggagggcaccctgaacagcaagacctatgacacagtgcaccggcggctgactgtggaggaggccacagcctctgtgtctgagggcggcggcctgcagggcatcaccatgaaggacagtgatgaggaggaggagggctag

SEQ ID NO: 145632 - DNA, 3906 bp, Artificial Sequence
  Description of Artificial Sequence: Synthetic coding sequence
atgctggaccccagcagcagcgaggaggagagtgatgagggcctggaggaggagagcagagatgtgctggtggccgccggcagcagccagagggcccccccagcccccacccgggagggcagaagagatgcccctggccgggccggcggcggcggggccgcccggtctgtgagccccagccccagcgtgctgtctgagggcagagatgagccccagaggcagctggatgatgagcaggagcggcgcatccggctgcagctgtatgtgtttgtggtgcgctgcatcgcctaccccttcaatgccaagcagcccacagacatggcccggcggcagcagaagctgaacaagcagcagctgcagctgctgaaggagcgcttccaggccttcctgaatggagagacccagatcgtggctgatgaggccttctgcaatgctgtgcgcagctactatgaggtgttcctgaagagtgacagagtggccaggatggtgcagagcggcggctgcagcgccaatgacttccgggaggtgttcaagaagaacatcgagaagagggtgcgcagcctgcctgagattgatggcctgagcaaggagaccgtgctgagctcctggatcgccaagtatgatgccatctacagaggagaggaggacctgtgcaagcagcccaacaggatggccctgtctgctgtgtctgagctgatcctgagcaaggagcagctgtatgagatgttccagcagatcctgggcatcaagaagctggagcaccagctgctgtacaatgcctgccagctggacaatgctgatgagcaggccgcccagatccggcgggagctggatggccgcctgcagctggccgacaagatggccaaggagaggaagttccccaagttcatcgccaaggacatggagaacatgtacatcgaggagctgcggagctctgtgaacctgctgatggccaacctggagagcctgcctgtgtccaaaggaggccctgagttcaagctgcagaagctgaagaggagccagaacagcgccttcctggacattggagatgaaaatgagatccagctgagcaagagtgatgtggtgctgtccttcaccctggagatcgtcatcatggaggtgcagggcctgaagtctgtggcccccaacagaattgtgtactgcaccatggaggtggagggggagaagctgcagacagaccaggccgaggccagccggccccagtggggcacccagggcgacttcaccaccacccaccccaggcctgtggtgaaggtgaagctgttcacagagagcactggagtgctggccctggaggacaaggagctgggccgggtcatcctgtaccccaccagcaacagcagcaagtctgctgagctgcacaggatggtggtgcccaagaacagccaggacagcgacctgaagatcaagctggccgtgaggatggacaagccagcccacatgaagcacagcggctacctgtatgccctgggccagaaggtgtggaagcgctggaagaagcgctactttgtgctggtgcaggtgtcccagtacacctttgccatgtgcagctaccgggagaagaagtctgagccccaggagctgatgcagctggagggctacacagtggactacacagacccccaccctggcctgcagggcggctgcatgttcttcaatgctgtgaaggagggggacaccgtcatctttgccagtgatgatgagcaggaccgcatcctgtgggtgcaggccatgtaccgggccaccggccagagctacaagcctgtgcctgccatccagacccagaagctgaaccccaagggcggcaccctgcatgctgatgcccagctgtctgagttcacagatgctgaccgcttccagaagcacggcatggatgagttcatcagcgccaacccctgcaagctggaccacgccttcctgttccgcatcctgcagaggcagaccctggaccaccggctgaatgacagctacagctgcctgggctggttcagccctggccaggtgtttgtgctggatgagtactgtgcccgctatggagtgcggggctgccaccgccacctgtgctacctggccgagctgatggagcacagtgaaaatggagctgtgattgaccccaccctgctgcactacagctttgccttctgtgccagccacgtgcacggcaacagaccagatggcatcggcaccgtgtctgtggaggagaaggagagatttgaggagatcaaggagcggctgagcagcctgctggagaaccagatcagccacttccgctactgcttccccttcggccggcctgagggcgccctgaaggccaccctgagcctgctggagcgggtgctgatgaaggacatcgccacccccatcccagctgaggaggtgaagaaggtggtgaggaagtgcctggagaaggccgccctgatcaactacacccggctgacagaatatgccaagattgagggccctgctgagaaggagacagagaccatgaaccaggccagccctgccaggaagctggaggagatcctgcacctggccgagctgtgcatcgaggtgctgcagcagaatgaggagcaccacgccgaggcctttgcctggtggccagacctgctggccgagcacgccgagaagttctgggccctcttcaccgtggacatggacacagccctggaggcccagccccaggacagctgggacagcttccccctcttccagctgctgaacaacttcctgagaaatgacaccctgctgtgcaatggcaagttccacaagcacctgcaggagatctttgtgcccctggtggtgcgctacgtggacctgatggagagcagcatcgcccagagcatccaccggggctttgagcaggagacctggcagcctgtgaagaacatcgccaacagcctgcccaacgtggccctgcccaaggtgcccagcctgcccctgaacctgccccagatccccaacatcagcacagcctcctggatgcccagcctgtatgagagcaccaatggaagtgccaccagtgaagatctcttctggaagctggatgccctgcagatgtttgtgtttgacctgcactggccagagcaggagtttgcccaccacctggagcagaggctgaagctgatggccagtgacatgctggaggcctgtgtgaagaggaccaggacagcctttgagctgaagctgcagaaggccagcaagaccacagacctgcgcatcccagcctctgtgtgcaccatgtttaatgtgctggtggatgccaagaagcagagcaccaagctgtgtgccctggatggcggccaggagcagcagtaccacagcaagattgatgacctgattgacaacagcgtgaaggagatcatcagcctgctggtgtccaagtttgtgtctgtgctggagggcgtgctgagcaagctgagccgctatgatgagggcaccttcttcagcagcatcctgtccttcaccgtgaaggccgccgccaagtatgtggatgtgcccaagccaggcatggacctggccgacacctacatcatgtttgtgcggcagaaccaggacatcctgcgggagaaggtgaatgaggagatgtacatcgagaagctgtttgaccagtggtacagcagctccatgaaggtgatctgtgtgtggctgacagaccggctggacctgcagctgcacatctaccagctgaagaccctcatcaagatcgtgaagaagacctacagagacttccggctgcagggcgtgctggagggcaccctgaacagcaagacctatgacacagtgcaccggcggctgactgtggaggaggccacagcctctgtgtctgagggcggcggcctgcagggcatcaccatgaaggacagtgatgaggaggaggagggctag

SEQ ID NO: 145633 - DNA, 3891 bp, Artificial Sequence
  Description of Artificial Sequence: Synthetic coding sequence
atgctggaccccagcagcagcgaggaggagagtgatgagggcctggaggaggagagcagagatgtgctggtggccgccggcagcagccagagggcccccccagcccccacccgggagggcagaagagatgcccctggccgggccggcggcggcggggccgcccggtctgtgagccccagccccagcgtgctgtctgagggcagagatgagccccagaggcagctggatgatgagcaggagcggcgcatccggctgcagctgtatgtgtttgtggtgcgctgcatcgcctaccccttcaatgccaagcagcccacagacatggcccggcggcagcagaagctgaacaagcagcagctgcagctgctgaaggagcgcttccaggccttcctgaatggagagacccagatcgtggctgatgaggccttctgcaatgctgtgcgcagctactatgaggtgttcctgaagagtgacagagtggccaggatggtgcagagcggcggctgcagcgccaatgacttccgggaggtgttcaagaagaacatcgagaagagggtgcgcagcctgcctgagattgatggcctgagcaaggagaccgtgctgagctcctggatcgccaagtatgatgccatctacagaggagaggaggacctgtgcaagcagcccaacaggatggccctgtctgctgtgtctgagctgatcctgagcaaggagcagctgtatgagatgttccagcagatcctgggcatcaagaagctggagcaccagctgctgtacaatgcctgccagctggacaatgctgatgagcaggccgcccagatccggcgggagctggatggccgcctgcagctggccgacaagatggccaaggagaggaagttccccaagttcatcgccaaggacatggagaacatgtacatcgaggagctgcggagctctgtgaacctgctgatggccaacctggagagcctgcctgtgtccaaaggaggccctgagttcaagctgcagaagctgaagaggagccagaacagcgccttcctggacattggagatgaaaatgagatccagctgagcaagagtgatgtggtgctgtccttcaccctggagatcgtcatcatggaggtgcagggcctgaagtctgtggcccccaacagaattgtgtactgcaccatggaggtggagggggagaagctgcagacagaccaggccgaggccagccggccccagtggggcacccagggcgacttcaccaccacccaccccaggcctgtggtgaaggtgaagctgttcacagagagcactggagtgctggccctggaggacaaggagctgggccgggtcatcctgtaccccaccagcaacagcagcaagtctgctgagctgcacaggatggtggtgcccaagaacagccaggacagcgacctgaagatcaagctggccgtgaggatggacaagccagcccacatgaagcacagcggctacctgtatgccctgggccagaaggtgtggaagcgctggaagaagcgctactttgtgctggtgcaggtgtcccagtacacctttgccatgtgcagctaccgggagaagaagtctgagccccaggagctgatgcagctggagggctacacagtggactacacagacccccaccctggcctgcagggcggctgcatgttcttcaatgctgtgaaggagggggacaccgtcatctttgccagtgatgatgagcaggaccgcatcctgtgggtgcaggccatgtaccgggccaccggccagagctacaagcctgtgcctgccatccagacccagaagctgaaccccaagggcggcaccctgcatgctgatgcccagctgagcggcaaggatgctgaccgcttccagaagcacggcatggatgagttcatcagcgccaacccctgcaagctggaccacgccttcctgttccgcatcctgcagaggcagaccctggaccaccggctgaatgacagctacagctgcctgggctggttcagccctggccaggtgtttgtgctggatgagtactgtgcccgctatggagtgcggggctgccaccgccacctgtgctacctggccgagctgatggagcacagtgaaaatggagctgtgattgaccccaccctgctgcactacagctttgccttctgtgccagccacgtgcacggcaacagaccagatggcattggaacagtgtctgtggaggagaaggagagatttgaggagatcaaggagcggctgagcagcctgctggagaaccagatcagccacttccgctactgcttccccttcggccggcctgagggcgccctgaaggccaccctgagcctgctggagcgggtgctgatgaaggacatcgccacccccatcccagctgaggaggtgaagaaggtggtgaggaagtgcctggagaaggccgccctgatcaactacacccggctgacagaatatgccaagattgaggagaccatgaaccaggccagccctgccaggaagctggaggagatcctgcacctggccgagctgtgcatcgaggtgctgcagcagaatgaggagcaccacgccgagggccgggaggcctttgcctggtggccagacctgctggccgagcacgccgagaagttctgggccctcttcaccgtggacatggacacagccctggaggcccagccccaggacagctgggacagcttccccctcttccagctgctgaacaacttcctgagaaatgacaccctgctgtgcaatggcaagttccacaagcacctgcaggagatctttgtgcccctggtggtgcgctacgtggacctgatggagagcagcatcgcccagagcatccaccggggctttgagcaggagacctggcagcctgtgaagaacatcgccaacagcctgcccaacgtggccctgcccaaggtgcccagcctgcccctgaacctgccccagatccccaacatcagcacagcctcctggatgcccagcctgtatgagagcaccaacggcagcgccaccagcgaggacctcttctggaagctggatgccctgcagatgtttgtgtttgacctgcactggccagagcaggagtttgcccaccacctggagcagaggctgaagctgatggccagtgacatgctggaggcctgtgtgaagaggaccaggacagcctttgagctgaagctgcagaaggccagcaagaccacagacctgcgcatcccagcctctgtgtgcaccatgttcaacgtgctggtggatgccaagaagcagagcaccaagctgtgtgccctggatggcggccaggagcagcagtaccacagcaagattgatgacctgattgacaacagcgtgaaggagatcatcagcctgctggtgtccaagtttgtgtctgtgctggagggcgtgctgagcaagctgagccgctatgatgagggcaccttcttcagcagcatcctgtccttcaccgtgaaggctgctgccaagtatgtggatgtgcccaagccaggcatggacctggccgacacctacatcatgtttgtgcggcagaaccaggacatcctgcgggagaaggtgaatgaggagatgtacatcgagaagctgtttgaccagtggtacagcagctccatgaaggtgatctgtgtgtggctgacagaccggctggacctgcagctgcacatctaccagctgaagaccctcatcaagatcgtgaagaagacctacagagacttccggctgcagggcgtgctggagggcaccctgaacagcaagacctatgacacagtgcaccggcggctgactgtggaggaggccacagcctctgtgtctgagggcggcggcctgcagggcatcaccatgaaggacagtgatgaggaggaggagggctag

SEQ ID NO: 145634 - DNA, 1473 bp, Artificial Sequence
  Description of Artificial Sequence: Synthetic coding sequence
tgatacacccggctgacagaatatgccaagattgagggccctgctgagaaggagacagagaccatgaaccaggccagccctgccaggaagctggaggagatcctgcacctggccgagctgtgcatcgaggtgctgcagcagaatgaggagcaccacgccgagggccgggaggcctttgcctggtggccagacctgctggccgagcacgccgagaagttctgggccctcttcaccgtggacatggacacagccctggaggcccagccccaggacagctgggacagcttccccctcttccagctgctgaacaacttcctgagaaatgacaccctgctgtgcaatggcaagttccacaagcacctgcaggagatctttgtgcccctggtggtgcgctacgtggacctgatggagagcagcatcgcccagagcatccaccggggctttgagcaggagacctggcagcctgtgaagaacatcgccaacagcctgcccaacgtggccctgcccaaggtgcccagcctgcccctgaacctgccccagatccccaacatcagcacagcctcctggatgcccagcctgtatgagagcaccaacggcagcgccaccagcgaggacctcttctggaagctggatgccctgcagatgtttgtgtttgacctgcactggccagagcaggagtttgcccaccacctggagcagaggctgaagctgatggccagtgacatgctggaggcctgtgtgaagaggaccaggacagcctttgagctgaagctgcagaaggccagcaagaccacagacctgcgcatcccagcctctgtgtgcaccatgttcaacgtgctggtggatgccaagaagcagagcaccaagctgtgtgccctggatggcggccaggagcagcagtaccacagcaagattgatgacctgattgacaacagcgtgaaggagatcatcagcctgctggtgtccaagtttgtgtctgtgctggagggcgtgctgagcaagctgagccgctatgatgagggcaccttcttcagcagcatcctgtccttcaccgtgaaggctgctgccaagtatgtggatgtgcccaagccaggcatggacctggccgacacctacatcatgtttgtgcggcagaaccaggacatcctgcgggagaaggtgaatgaggagatgtacatcgagaagctgtttgaccagtggtacagcagctccatgaaggtgatctgtgtgtggctgacagaccggctggacctgcagctgcacatctaccagctgaagaccctcatcaagatcgtgaagaagacctacagagacttccggctgcagggcgtgctggagggcaccctgaacagcaagacctatgacacagtgcaccggcggctgactgtggaggaggccacagcctctgtgtctgagggcggcggcctgcagggcatcaccatgaaggacagtgatgaggaggaggagggctag

SEQ ID NO: 145635 - DNA, 3669 bp, Artificial Sequence
  Description of Artificial Sequence: Synthetic coding sequence
atgctggaccccagcagcagcgaggaggagagtgatgagggcctggaggaggagagcagagatgtgctggtggccgccggcagcagccagagggcccccccagcccccacccgggagggccagctggatgatgagcaggagcggcgcatccggctgcagctgtatgtgtttgtggtgcgctgcatcgcctaccccttcaatgccaagcagcccacagacatggcccggcggcagcagaagctgaacaagcagcagctgcagctgctgaaggagcgcttccaggccttcctgaatggagagacccagatcgtggctgatgaggccttctgcaatgctgtgcgcagctactatgaggtgttcctgaagagtgacagagtggccaggatggtgcagagcggcggctgcagcgccaatgacttccgggaggtgttcaagaagaacatcgagaagagggtgcgcagcctgcctgagattgatggcctgagcaaggagaccgtgctgagctcctggatcgccaagtatgatgccatctacagaggagaggaggacctgtgcaagcagcccaacaggatggccctgtctgctgtgtctgagctgatcctgagcaaggagcagctgtatgagatgttccagcagatcctgggcatcaagaagctggagcaccagctgctgtacaatgcctgccagctggacaatgctgatgagcaggccgcccagatcagaagagagctggatggccgcctgcagctggccgacaagatggccaaggagaggaagttccccaagttcatcgccaaggacatggagaacatgtacatcgaggagctgcggagctctgtgaacctgctgatggccaacctggagagcctgcctgtgtccaagggcggccctgagttcaagctgcagaagctgaagaggagccagaacagcgccttcctggacattggagatgaaaatgagatccagctgagcaagagtgatgtggtgctgtccttcaccctggagatcgtcatcatggaggtgcagggcctgaagtctgtggcccccaaccgcatcgtgtactgcaccatggaggtggagggggagaagctgcagacagaccaggccgaggccagccggccccagtggggcacccagggcgacttcaccaccacccaccccaggcctgtggtgaaggtgaagctgttcacagagagcactggagtgctggccctggaggacaaggagctgggccgggtcatcctgtaccccaccagcaacagcagcaagtctgctgagctgcacaggatggtggtgcccaagaacagccaggacagcgacctgaagatcaagctggccgtgaggatggacaagccagcccacatgaagcacagcggctacctgtatgccctgggccagaaggtgtggaagcgctggaagaagcgctactttgtgctggtgcaggtgtcccagtacacctttgccatgtgcagctaccgggagaagaagtctgagccccaggagctgatgcagctggagggctacacagtggactacacagacccccaccctggcctgcagggcggctgcatgttcttcaatgctgtgaaggagggggacaccgtcatctttgccagtgatgatgagcaggaccgcatcctgtgggtgcaggccatgtaccgggccaccggccagagctacaagcctgtgcctgccatccagacccagaagctgaaccccaagggcggcaccctgcacgcagatgcccagctgtatgctgaccgcttccagaagcacggcatggatgagttcatcagcgccaacccctgcaagctggaccacgccttcctgttccgcatcctgcagaggcagaccctggaccaccggctgaatgacagctacagctgcctgggctggttcagccctggccaggtgtttgtgctggatgagtactgtgcccgctatggagtgcggggctgccaccgccacctgtgctacctggccgagctgatggagcacagtgaaaatggagctgtgattgaccccaccctgctgcactacagctttgccttctgtgccagccacgtgcacggcaacagaccagatggcattggaacagtgtctgtggaggagaaggagagatttgaggagatcaaggagcggctgagcagcctgctggagaaccagatcagccacttccgctactgcttccccttcggccggcctgagggcgccctgaaggccaccctgagcctgctggagcgggtgctgatgaaggacatcgccacccccatcccagctgaggaggtgaagaaggtggtgaggaagtgcctggagaaggccgccctgatcaactacacccggctgacagaatatgccaagattgaggagaccatgaaccaggccagccctgccaggaagctggaggagatcctgcacctggccgagctgtgcatcgaggtgctgcagcagaatgaggagcaccacgccgaggcctttgcctggtggccagacctgctggccgagcacgccgagaagttctgggccctcttcaccgtggacatggacacagccctggaggcccagccccaggacagctgggacagcttccccctcttccagctgctgaacaacttcctgagaaatgacaccctgctgtgcaatggcaagttccacaagcacctgcaggagatctttgtgcccctggtggtgcgctacgtggacctgatggagagcagcatcgcccagagcatccaccggggctttgagcaggagacctggcagcctgtgaacaatggaagtgccaccagtgaagatctcttctggaagctggatgccctgcagatgtttgtgtttgacctgcactggccagagcaggagtttgcccaccacctggagcagaggctgaagctgatggccagtgacatgctggaggcctgtgtgaagaggaccaggacagcctttgagctgaagctgcagaaggccagcaagaccacagacctgcgcatcccagcctctgtgtgcaccatgtttaatgtgctggtggatgccaagaagcagagcaccaagctgtgtgccctggatggcggccaggagtttggcagccagtggcagcagtaccacagcaagattgatgacctgattgacaacagcgtgaaggagatcatcagcctgctggtgtccaagtttgtgtctgtgctggagggcgtgctgagcaagctgagccgctatgatgagggcaccttcttcagcagcatcctgtccttcaccgtgaaggctgctgccaagtatgtggatgtgcccaagccaggcatggacctggccgacacctacatcatgtttgtgcggcagaaccaggacatcctgcgggagaaggtgaatgaggagatgtacatcgagaagctgtttgaccagtggtacagcagctccatgaaggtgatctgtgtgtggctgacagaccggctggacctgcagctgcacatctaccagctgaagaccctcatcaagatcgtgaagaagacctacagagacttccggctgcagggcgtgctggagggcaccctgaacagcaagacctatgacacagtgcaccggcggctgactgtggaggaggccacagcctctgtgtctgagggcggcggcctgcagggcatcaccatgaaggacagtgatgaggaggaggagggctag

SEQ ID NO: 145636 - DNA, 2367 bp, Artificial Sequence
  Description of Artificial Sequence: Synthetic coding sequence
atgaccatccaccagttcctgctgctcttcctgttctgggtgtgcctgccccacttctgcagccctgagatcatgttccggaggacccctgtgccccagcagaggatcctgagcagccgggtgcccaggagtgatggcaagatcctgcaccggcagaagaggggctggatgtggaaccagttcttcctgctggaggagtacacaggcagtgactaccagtatgtgggcaagctgcacagcgaccaggacaagggagatggcagcctgaagtacatcctgtctggagatggagctggcaccctcttcatcattgatgagaagacaggagacatccacgccaccaggagaattgaccgggaggagaaggccttctacaccctgcgggcccaggccatcaacagaaggaccctgcggcctgtggagcctgagagcgagtttgtgatcaagatccatgacatcaatgacaatgagcccaccttccctgaggagatctacacagcctctgtgcctgagatgtctgtggtgggcacctctgtggtgcaggtgacagccacagatgctgatgaccccagctatggcaacagcgcccgggtcatctacagcatcctgcagggccagccctacttctctgtggagcctgagaccggcatcatcagaacagccctgcccaacatgaaccgggagaaccgggagcagtaccaggtggtgatccaggccaaggacatgggcggccagatgggcggcctgagcggcaccaccaccgtgaacatcaccctgacagatgtgaatgacaaccccccacgcttcccccagaacaccatccacctgcgggtgctggagagcagccctgtgggcacagccatcggctctgtgaaggccacagatgctgacaccgggaagaatgctgaggtggagtaccgcatcattgatggagatggaacagacatgtttgatattgtgacagagaaggacacccaggagggcatcatcaccgtgaagaagcccctggactatgagagcagaagactctacaccctgaaggtggaggccgagaacacccacgtggacccccgcttctactacctgggccccttcaaggacaccaccatcgtgaagatcagcattgaagatgtggatgagccccctgtgttcagccgcagcagctacctgtttgaggtgcatgaagatattgaggtgggcaccatcattggaacagtgatggcccgggaccctgacagcatcagcagccccatccgcttcagcctggacagacacacagacctggaccgcatcttcaacatccacagcggaaatggcagcctgtacaccagcaagcccctggaccgggagctgagccagtggcacaacctgactgtgattgctgctgagatcaacaaccccaaggagaccaccagggtggccgtgtttgtgcgcatcctggatgtgaatgacaatgccccccagtttgctgtgttctatgacacctttgtgtgtgaaaatgcccggcccggccagctgatccagaccatctctgctgtggacaaggatgaccccctgggcggccagaagttcttcttcagcctggccgctgtgaaccccaacttcaccgtgcaggacaatgaagacaacacagcccgcatcctgaccaggaagaatggcttcaacagacatgagatcagcacctacctgctgcctgtggtgatcagtgacaatgactaccccatccagagcagcacaggcaccctgaccatccgggtgtgtgcctgtgacagccagggcaacatgcagagctgcagcgctgaggccctgctgctgcctgctggcctgagcactggagccctgattgccatcctgctgtgcatcatcatcctgctggtgattgtggtgctgtttgctgccctgaagaggcagaggaagaaggagcccctcatcctgagcaaggaggacatccgggacaacatcgtgtcctacaatgatgaaggaggaggagaggaggacacccaggcctttgacatcggcaccctgaggaacccagctgccatcgaggagaagaagctgcggcgggacatcatccctgagaccctcttcatccccaggaggacccccacagccccagacaacacagatgtgcgggacttcatcaatgaaaggctgaaggagcatgacctggaccccacagccccaccctatgacagcctggccacctacgcctatgagggcaatgacagcattgctgagagcctgagcagcctggagagcggcaccacagaaggagaccagaactatgactacctgcgggagtggggcccccgcttcaacaagctggccgagatgtatggaggaggagagagtgacaaggacagctag

SEQ ID NO: 145637 - DNA, 2385 bp, Artificial Sequence
  Description of Artificial Sequence: Synthetic coding sequence
atgctgaccaggaactgcctgagcctgctgctgtgggtgctgtttgatggcggcctgctgacccccctgcagccccagccccagcagaccctggccacagagcccagagaaaatgtcatccacctgcccggccagaggagccacttccagagggtgaagaggggctgggtgtggaaccagttctttgtgctggaggagtatgtgggcagcgagccccagtatgtgggcaagctgcacagcgacctggacaagggggagggcaccgtgaagtacaccctgtctggagatggagctggcaccgtcttcaccattgatgagaccaccggggacatccacgccatccgcagcctggaccgggaggagaagcccttctacaccctgcgggcccaggccgtggacatcgagaccaggaagcccctggagcctgagagcgagttcatcatcaaggtgcaggacatcaatgacaatgagcccaagttcctggatggcccctacgtggccaccgtgcctgagatgagccctgtgggcgcctacgtgctgcaggtgaaggccacagatgctgatgaccccacctacggcaacagcgcccgggtggtgtacagcatcctgcagggccagccctacttcagcattgaccccaagacaggagtcatcagaacagccctgcccaacatggaccgggaggtgaaggagcagtaccaggtgctgatccaggccaaggacatgggcggccagctgggcggcctggccggcaccaccatcgtgaacatcaccctgacagatgtgaatgacaaccccccacgcttccccaagagcatcttccacctgaaggtgcctgagagcagccccatcggcagcgccatcggccgcatccgggctgtggaccctgactttggccagaatgctgagattgagtacaacatcgtgcctggagatggcggcaacctgtttgatattgtgacagatgaggacacccaggagggcgtcatcaagctgaagaagcccctggactttgagaccaagaaggcctacaccttcaaggtggaggccagcaacctgcacctggaccaccgcttccacagcgctggccccttcaaggacacagccaccgtgaagatctctgtgctggatgtggatgagccccctgtgttcagcaagcccctgtacaccatggaggtgtatgaggacacccctgtgggcaccatcattggagctgtgacagcccaggacctggatgtgggcagcagcgctgtgcgctacttcatcgactggaagagtgatggagacagctacttcaccattgatggaaatgaaggcaccatcgccaccaatgagctgctggaccgggagagcacagcccagtacaacttcagcatcatcgccagcaaggtgagcaaccccctgctgaccagcaaggtgaacatcctgatcaacgtgctggatgtgaatgagttccccccagagatctctgtgccctatgaaacagctgtgtgtgaaaatgccaagccaggccagatcatccagatcgtgtctgctgctgaccgggacctgagccctgctggccagcagttctccttccggctgagccctgaggccgccatcaagcccaacttcaccgtgcgggacttcaggaacaacacagctggcatcgagaccaggagaaatggctacagccggcggcagcaggagctgtacttcctgcctgtggtgattgaggacagcagctaccctgtgcagagcagcaccaacaccatgaccatccgggtgtgccgctgtgacagtgatggcaccatcctgagctgcaatgtggaggccatcttcctgcctgtgggcctgagcactggagccctgattgccatcctgctgtgcatcgtcatcctgctggccatcgtggtgctgtatgtggccctgcggcggcagaagaagaaggacaccctgatgaccagcaaagaagacatccgggacaacgtcatccactatgatgatgagggcggcggggaggaggacacccaggcctttgatattggagccctgaggaaccccaaggtgattgaggagaacaagatccggcgggacatcaagccagacagcctgtgcctgccccggcagaggcctcccatggaggacaacacagacatccgggacttcatccaccagaggctgcaggagaatgatgtggaccccacagccccaccctatgacagcctggccacctacgcctatgagggcagcggctctgtggccgagagcctgagcagcattgacagcctgaccacagaagctgaccaggactatgactacctgacagactggggcccccgcttcaaggtgctggccgacatgtttggagaggaggagagctacaacccagacaaggtgacctag

SEQ ID NO: 145638 - DNA, 2385 bp, Artificial Sequence; identical to SEQ ID NO: 145637
  Description of Artificial Sequence: Synthetic coding sequence

SEQ ID NO: 145639 - DNA, 2265 bp, Artificial Sequence
  Description of Artificial Sequence: Synthetic coding sequence
atgctgaccaggaactgcctgagcctgctgctgtgggtgctgtttgatggcggcctgctgacccccctgcagccccagccccagcagaccctggccacagagcccagagaaaatgtcatccacctgcccggccagaggagccacttccagagggtgaagaggggctgggtgtggaaccagttctttgtgctggaggagtatgtgggcagcgagccccagtatgtgggcaagctgcacagcgacctggacaagggggagggcaccgtgaagtacaccctgtctggagatggagctggcaccgtcttcaccattgatgagaccaccggggacatccacgccatccgcagcctggaccgggaggagaagcccttctacaccctgcgggcccaggccgtggacatcgagaccaggaagcccctggagcctgagagcgagttcatcatcaaggtgcaggacatcaatgacaatgagcccaagttcctggatggcccctacgtggccaccgtgcctgagatgagccctgtgggcgtcatcagaacagccctgcccaacatggaccgggaggtgaaggagcagtaccaggtgctgatccaggccaaggacatgggcggccagctgggcggcctggccggcaccaccatcgtgaacatcaccctgacagatgtgaatgacaaccccccacgcttccccaagagcatcttccacctgaaggtgcctgagagcagccccatcggcagcgccatcggccgcatccgggctgtggaccctgactttggccagaatgctgagattgagtacaacatcgtgcctggagatggcggcaacctgtttgatattgtgacagatgaggacacccaggagggcgtcatcaagctgaagaagcccctggactttgagaccaagaaggcctacaccttcaaggtggaggccagcaacctgcacctggaccaccgcttccacagcgctggccccttcaaggacacagccaccgtgaagatctctgtgctggatgtggatgagccccctgtgttcagcaagcccctgtacaccatggaggtgtatgaggacacccctgtgggcaccatcattggagctgtgacagcccaggacctggatgtgggcagcagcgctgtgcgctacttcatcgactggaagagtgatggagacagctacttcaccattgatggaaatgaaggcaccatcgccaccaatgagctgctggaccgggagagcacagcccagtacaacttcagcatcatcgccagcaaggtgagcaaccccctgctgaccagcaaggtgaacatcctgatcaacgtgctggatgtgaatgagttccccccagagatctctgtgccctatgaaacagctgtgtgtgaaaatgccaagccaggccagatcatccagatcgtgtctgctgctgaccgggacctgagccctgctggccagcagttctccttccggctgagccctgaggccgccatcaagcccaacttcaccgtgcgggacttcaggaacaacacagctggcatcgagaccaggagaaatggctacagccggcggcagcaggagctgtacttcctgcctgtggtgattgaggacagcagctaccctgtgcagagcagcaccaacaccatgaccatccgggtgtgccgctgtgacagtgatggcaccatcctgagctgcaatgtggaggccatcttcctgcctgtgggcctgagcactggagccctgattgccatcctgctgtgcatcgtcatcctgctggccatcgtggtgctgtatgtggccctgcggcggcagaagaagaaggacaccctgatgaccagcaaagaagacatccgggacaacgtcatccactatgatgatgagggcggcggggaggaggacacccaggcctttgatattggagccctgaggaaccccaaggtgattgaggagaacaagatccggcgggacatcaagccagacagcctgtgcctgccccggcagaggcctcccatggaggacaacacagacatccgggacttcatccaccagaggctgcaggagaatgatgtggaccccacagccccaccctatgacagcctggccacctacgcctatgagggcagcggctctgtggccgagagcctgagcagcattgacagcctgaccacagaagctgaccaggactatgactacctgacagactggggcccccgcttcaaggtgctggccgacatgtttggagaggaggagagctacaacccagacaaggtgacctag

SEQ ID NO: 145640 - DNA, 2445 bp, Artificial Sequence
  Description of Artificial Sequence: Synthetic coding sequence
atggatgctgccttcctgctggtgctgggcctgctggcccagagcctgtgcctgagcctgggcgtgcccggctggaggcggcccaccaccctgtacccctggaggcgggccccagccctgagccgggtgcggcgggcctgggtgatcccccccatctctgtgtctgagaaccacaagaggctgccctaccccctggtgcagatcaagagtgacaagcagcagctgggcagcgtcatctacagcatccagggccctggggtggatgaggagccccggggcgtcttcagcattgacaagttcaccgggaaggtgttcctgaatgccatgctggaccgggagaagacagaccgcttccggctgcgggcctttgccctggacctgggcggcagcaccctggaggaccccacagacctggagatcgtggtggtggaccagaatgacaacagacctgccttcctgcaggaggccttcaccggccgggtgctggagggcgctgtgcccggcacctacgtgaccagggctgaggccacagatgctgatgatcctgagacagacaatgctgccctgcgcttcagcatcctgcagcagggcagccctgagctgttcagcattgatgagctgaccggggagatcagaacagtgcaggtgggcctggaccgggaggtggtggccgtgtacaacctgaccctgcaggtggccgacatgtctggagatggcctgacagccacagccagcgccatcatcaccctggatgacatcaatgacaatgcccctgagttcaccagagatgagttcttcatggaggccatcgaggccgtgtctggagtggatgtgggccgcctggaggtggaggaccgggacctgcccggcagccccaactgggtggcccgcttcaccatcctggagggggaccctgatggccagttcaccatcagaacagaccccaagaccaatgaaggagtgctgagcatcgtgaaggccctggactatgagagctgtgagcactatgagctgaaggtgtctgtgcagaatgaggcccccctgcaggccgccgccctgcgggcagagcggggccaggccaaggtgcgggtgcacgtgcaggacaccaatgagccccctgtgttccaggagaaccccctgcggaccagcctggccgagggcgcccctcctggcaccctggtggccaccttcagcgcccgggaccctgacacagagcagctgcagaggctgagctacagcaaggactatgaccctgaggactggctgcaggtggatgctgccaccggccgcatccagacccagcacgtgctgagccctgccagccccttcctgaagggcggctggtaccgggccatcgtgctggcccaggatgatgccagccagcccaggacagccaccggcaccctgagcattgagatcctggaggtgaatgaccacgcccctgtgctggcccctcctcctcctggcagcctgtgcagcgagccccaccagggccctggcctgctgctgggcgccacagatgaggacctgccccctcatggagcccccttccacttccagctgagcccccggctgcctgagctgggcaggaactggagcctgagccaggtgaatgtgtcccatgcccggctgcggcccaggcaccaggtgcctgagggcctgcaccggctgagcctgctgctgcgggacagcggccagcccccccagcagcgggagcagcccctgaatgtgacagtgtgccgctgtgggaaggatggagtgtgcctgcccggggctgctgccctgctggccggcggcaccggcctgagcctgggcgccctggtgattgtgctggccagcgccctgctgctgctggtgctggtgctgctggtggccctgcgggcccgcttctggaagcagagccggggcaagggcctgctgcacggcccccaggatgacctgcgggacaacgtgctgaactatgatgagcagggcggcggggaggaggaccaggatgcctatgacatcagccagctgcggcaccccacagccctgagcctgcccctgggccccccacccctgcggagagatgccccccagggccgcctgcacccccagcccccccgggtgctgcccaccagccccctggacattgctgacttcatcaatgatggcctggaggccgctgacagcgaccccagcgtgcccccctatgacacagccctgatctatgactatgaaggagatggctctgtggccggcaccctgagcagcatcctgagcagccagggagatgaggaccaggactatgactacctgcgggactggggccccaggtttgcccggctggccgacatgtatggccacccctgtggcctggagtatggagcccgctgggaccaccaggcccgggagggcctgagccctggggccctgctgcccaggcaccggggccgcacagcctag

SEQ ID NO: 145641 - DNA, 2373 bp, Artificial Sequence
  Description of Artificial Sequence: Synthetic coding sequence
atggtgcctgcctggctgtggctgctgtgtgtgtctgtgccccaggccctgcccaaggcccagcctgctgagctgtctgtggaggtgcctgaaaattatggaggcaacttccccctgtacctgaccaagctgcccctgccccgggagggcgctgagggccagatcgtgctgagcggggacagcggcaaggccacagagggcccctttgccatggaccctgattctggcttcctgctggtgacccgggccctggaccgggaggagcaggccgagtaccagctgcaggtgaccctggagatgcaggacggccacgtgctgtggggcccccagcctgtgctggtgcacgtgaaggatgaaaatgaccaggtgccccacttcagccaggccatctaccgggcccggctgagccggggcaccaggcctggcatccccttcctgttcctggaggccagtgacagagatgagcccggcacagccaacagcgacctgcgcttccacatcctgagccaggccccagcccagcccagcccagacatgttccagctggagccccggctgggcgccctggccctgagccccaagggcagcaccagcctggaccacgccctggagaggacctaccagctgctggtgcaggtgaaggacatgggagaccaggccagcggccaccaggccacagccaccgtggaggtgtccatcatcgagagcacctgggtgtccctggagcccatccacctggccgagaacctgaaggtgctgtacccccaccacatggcccaggtgcactggagcggaggagatgtgcactaccacctggagagccaccccccaggcccctttgaggtgaatgctgagggcaacctgtatgtgacccgggagctggaccgggaggcccaggccgagtacctgctgcaggtgcgggcccagaacagccacggggaggactatgctgcccccctggagctgcacgtgctggtgatggatgaaaatgacaacgtgcccatctgccccccccgggaccccaccgtgtccatccctgagctgagccccccaggcacagaggtgacccggctgtctgcagaagatgctgatgcccctggcagccccaacagccacgtggtgtaccagctgctgagccctgagccagaagatggagtggagggccgggccttccaggtggaccccaccagcggctctgtgaccctgggcgtgctgcccctgcgggccggccagaacatcctgctgctggtgctggccatggacctggccggggctgagggcggcttcagcagcacctgtgaggtggaggtggccgtgacagacatcaatgaccacgcccctgagttcatcaccagccagatcggccccatcagcctgcctgaagatgtggagcccggcaccctggtggccatgctgacagccattgatgctgacctggagcccgccttccggctgatggactttgccatcgagcggggggacacagagggcaccttcggcctggactgggagccagattctggccacgtgcggctgcggctgtgcaagaacctgtcctatgaggccgcccccagccatgaggtggtggtggtggtgcagagcgtggccaagctggtgggccctggccctggccctggggccacagccaccgtgacagtgctggtggagcgggtgatgcccccacccaagctggaccaggagagctatgaggcctctgtgcccatcagcgccccagctggcagcttcctgctgaccatccagcccagcgaccccatcagcaggaccctgcgcttcagcctggtgaatgacagcgagggctggctgtgcatcgagaagttcagcggggaggtgcacacagcccagagcctgcagggcgcccagcccggggacacctacacagtgctggtggaggcccaggacacagaccacggcctcatcgtgtctggccccagcaaggaccctgacctggccagcggccacggcccctacagcttcaccctgggccccaaccccaccgtgcagagggactggaggctgcagaccctgaatggcagccacgcctacctgaccctggccctgcactgggtggagccccgggagcacatcatccctgtggtggtgagccacaatgcccagatgtggcagctgctggtgcgggtgattgtgtgccgctgcaatgtggagggccagtgcatgaggaaggtgggccgcatgaagggcatgcccaccaagctgtctgctgtgggcatcctggtgggcaccctggtggccatcggcatcttcctgatcctgatcttcacccactggaccatgagcaggaagaaggaccctgaccagcctgctgacagcgtgcccctgaaggccaccgtgtag

SEQ ID NO: 145642 - DNA, 2199 bp, Artificial Sequence
  Description of Artificial Sequence: Synthetic coding sequence
atggtgcctgcctggctgtggctgctgtgtgtgtctgtgccccaggccctgcccaaggcccagcctgctgagctgtctgtggaggtgcctgaaaattatggaggcaacttccccctgtacctgaccaagctgcccctgccccgggagggcgctgagggccagatcgtgctgagcggggacagcggcaaggccacagagggcccctttgccatggaccctgattctggcttcctgctggtgacccgggccctggaccgggaggagcaggccgagtaccagctgcaggtgaccctggagatgcaggacggccacgtgctgtggggcccccagcctgtgctggtgcacgtgaaggatgaaaatgaccaggccagcggccaccaggccacagccaccgtggaggtgtccatcatcgagagcacctgggtgtccctggagcccatccacctggccgagaacctgaaggtgctgtacccccaccacatggcccaggtgcactggagcggaggagatgtgcactaccacctggagagccaccccccaggcccctttgaggtgaatgctgagggcaacctgtatgtgacccgggagctggaccgggaggcccaggccgagtacctgctgcaggtgcgggcccagaacagccatggagaagattatgctgcccccctggagctgcacgtgctggtgatggatgaaaatgacaacgtgcccatctgccccccccgggaccccaccgtgtccatccctgagctgagccccccaggcacagaggtgacccggctgtctgcagaagatgctgatgcccctggcagccccaacagccacgtggtgtaccagctgctgagccctgagccagaagatggagtggagggccgggccttccaggtggaccccaccagcggctctgtgaccctgggcgtgctgcccctgcgggccggccagaacatcctgctgctggtgctggccatggacctggccggggctgagggcggcttcagcagcacctgtgaggtggaggtggccgtgacagacatcaatgaccacgcccctgagttcatcaccagccagatcggccccatcagcctgcctgaagatgtggagcccggcaccctggtggccatgctgacagccattgatgctgacctggagcccgccttccggctgatggactttgccatcgagcggggggacacagagggcaccttcggcctggactgggagccagacagcggccacgtgcggctgcggctgtgcaagaacctgtcctatgaagctgcccccagccatgaggtggtggtggtggtgcagagcgtggccaagctggtgggccctggccctggccctggggccacagccaccgtgacagtgctggtggagcgggtgatgcccccacccaagctggaccaggagagctatgaggcctctgtgcccatcagcgccccagctggcagcttcctgctgaccatccagcccagcgaccccatcagcaggaccctgcgcttcagcctggtgaatgattctgagggctggctgtgcatcgagaagttctctggagaggtgcacacagcccagagcctgcagggcgcccagcccggggacacctacacagtgctggtggaggcccaggacacagatgagccccggctgagcgccagcgcccccctggtgatccacttcctgaaggcccccccagccccagccctgaccctggcccctgtgcccagccagtacctgtgcaccccccggcaggaccacggcctcatcgtgtctggccccagcaaggaccctgacctggccagcggccacggcccctacagcttcaccctgggccccaaccccaccgtgcagagggactggaggctgcagaccctgaatggcagccacgcctacctgaccctggccctgcactgggtggagccccgggagcacatcatccctgtggtggtgagccacaatgcccagatgtggcagctgctggtgcgggtgattgtgtgccgctgcaatgtggagggccagtgcatgaggaaggtgggccgcatgaagggcatgcccaccaagctgtctgctgtgggcatcctggtgggcaccctggtggccatcggcatcttcctgatcctgatcttcacccactggaccatgagcaggaagaaggaccctgaccagcctgctgacagcgtgcccctgaaggccaccgtgtag

SEQ ID NO: 145643 - DNA, 2490 bp, Artificial Sequence
  Description of Artificial Sequence: Synthetic coding sequence
atggtgcctgcctggctgtggctgctgtgtgtgtctgtgccccaggccctgcccaaggcccagcctgctgagctgtctgtggaggtgcctgaaaattatggaggcaacttccccctgtacctgaccaagctgcccctgccccgggagggcgctgagggccagatcgtgctgagcggggacagcggcaaggccacagagggcccctttgccatggaccctgattctggcttcctgctggtgacccgggccctggaccgggaggagcaggccgagtaccagctgcaggtgaccctggagatgcaggacggccacgtgctgtggggcccccagcctgtgctggtgcacgtgaaggatgaaaatgaccaggtgccccacttcagccaggccatctaccgggcccggctgagccggggcaccaggcctggcatccccttcctgttcctggaggccagtgacagagatgagcccggcacagccaacagcgacctgcgcttccacatcctgagccaggccccagcccagcccagcccagacatgttccagctggagccccggctgggcgccctggccctgagccccaagggcagcaccagcctggaccacgccctggagaggacctaccagctgctggtgcaggtgaaggacatgggagaccaggccagcggccaccaggccacagccaccgtggaggtgtccatcatcgagagcacctgggtgtccctggagcccatccacctggccgagaacctgaaggtgctgtacccccaccacatggcccaggtgcactggagcggaggagatgtgcactaccacctggagagccaccccccaggcccctttgaggtgaatgctgagggcaacctgtatgtgacccgggagctggaccgggaggcccaggccgagtacctgctgcaggtgcgggcccagaacagccacggggaggactatgctgcccccctggagctgcacgtgctggtgatggatgaaaatgacaacgtgcccatctgccccccccgggaccccaccgtgtccatccctgagctgagccccccaggcacagaggtgacccggctgtctgcagaagatgctgatgcccctggcagccccaacagccacgtggtgtaccagctgctgagccctgagccagaagatggagtggagggccgggccttccaggtggaccccaccagcggctctgtgaccctgggcgtgctgcccctgcgggccggccagaacatcctgctgctggtgctggccatggacctggccggggctgagggcggcttcagcagcacctgtgaggtggaggtggccgtgacagacatcaatgaccacgcccctgagttcatcaccagccagatcggccccatcagcctgcctgaagatgtggagcccggcaccctggtggccatgctgacagccattgatgctgacctggagcccgccttccggctgatggactttgccatcgagcggggggacacagagggcaccttcggcctggactgggagccagattctggccacgtgcggctgcggctgtgcaagaacctgtcctatgaggccgcccccagccatgaggtggtggtggtggtgcagagcgtggccaagctggtgggccctggccctggccctggggccacagccaccgtgacagtgctggtggagcgggtgatgcccccacccaagctggaccaggagagctatgaggcctctgtgcccatcagcgccccagctggcagcttcctgctgaccatccagcccagcgaccccatcagcaggaccctgcgcttcagcctggtgaatgacagcgagggctggctgtgcatcgagaagttcagcggggaggtgcacacagcccagagcctgcagggcgcccagcccggggacacctacacagtgctggtggaggcccaggacacagatgagccccggctgagcgccagcgcccccctggtgatccacttcctgaaggcccccccagccccagccctgaccctggcccctgtgcccagccagtacctgtgcaccccccggcaggaccacggcctgattgtgtctggccccagcaaggaccctgacctggccagcggccacggcccctacagcttcaccctgggccccaaccccaccgtgcagagggactggaggctgcagaccctgaatggcagccacgcctacctgaccctggccctgcactgggtggagccccgggagcacatcatccctgtggtggtgagccacaatgcccagatgtggcagctgctggtgcgggtcatcgtgtgccgctgcaatgtggagggccagtgcatgaggaaggtgggccgcatgaagggcatgcccaccaagctgtctgctgtgggcatcctggtgggcaccctggtggccatcggcatcttcctgatcctgatcttcacccactggaccatgagcaggaagaaggaccctgaccagcctgctgacagcgtgcccctgaaggccaccgtgtag

SEQ ID NO: 145644 - DNA, 2424 bp, Artificial Sequence
  Description of Artificial Sequence: Synthetic coding sequence
atggtgcctgcctggctgtggctgctgtgtgtgtctgtgccccaggccctgcccaaggcccagcctgctgagctgtctgtggaggtgcctgaaaattatggaggcaacttccccctgtacctgaccaagctgcccctgccccgggagggcgctgagggccagatcgtgctgagcggggacagcggcaaggccacagagggcccctttgccatggaccctgattctggcttcctgctggtgacccgggccctggaccgggaggagcaggccgagtaccagctgcaggtgaccctggagatgcaggacggccacgtgctgtggggcccccagcctgtgctggtgcacgtgaaggatgaaaatgaccaggtgccccacttcagccaggccatctaccgggcccggctgagccggggcaccaggcctggcatccccttcctgttcctggaggccagtgacagagatgagcccggcacagccaacagcgacctgcgcttccacatcctgagccaggccccagcccagcccagcccagacatgttccagctggagccccggctgggcgccctggccctgagccccaagggcagcaccagcctggaccacgccctggagaggacctaccagctgctggtgcaggtgaaggacatgggagaccaggccagcggccaccaggccacagccaccgtggaggtgtccatcatcgagagcacctgggtgtccctggagcccatccacctggccgagaacctgaaggtgctgtacccccaccacatggcccaggtgcactggagcggaggagatgtgcactaccacctggagagccaccccccaggcccctttgaggtgaatgctgagggcaacctgtatgtgacccgggagctggaccgggaggcccaggccgagtacctgctgcaggtgcgggcccagaacagccacggggaggactatgctgcccccctggagctgcacgtgctggtgatggatgaaaatgacaacgtgcccatctgccccccccgggaccccaccgtgtccatccctgagctgagccccccaggcacagaggtgacccggctgtctgcagaagatgctgatgcccctggcagccccaacagccacgtggtgtaccagctgctgagccctgagccagaagatggagtggagggccgggccttccaggtggaccccaccagcggctctgtgaccctgggcgtgctgcccctgcgggccggccagaacatcctgctgctggtgctggccatggacctggccggggctgagggcggcttcagcagcacctgtgaggtggaggtggccgtgacagacatcaatgaccacgcccctgagttcatcaccagccagatcggccccatcagcctgcctgaagatgtggagcccggcaccctggtggccatgctgacagccattgatgctgacctggagcccgccttccggctgatggactttgccatcgagcggggggacacagagggcaccttcggcctggactgggagccagattctggccacgtgcggctgcggctgtgcaagaacctgtcctatgaggccgcccccagccatgaggtggtggtggtggtgcagagcgtggccaagctggtgggccctggccctggccctggggccacagccaccgtgacagtgctggtggagcgggtgatgcccccacccaagctggaccaggagagctatgaggcctctgtgcccatcagcgccccagctggcagcttcctgctgaccatccagcccagcgaccccatcagcaggaccctgcgcttcagcctggtgaatgacagcgagggctggctgtgcatcgagaagttcagcggggaggtgcacacagcccagagcctgcagggcgcccagcccggggacacctacacagtgctggtggaggcccaggacacagccctgaccctggcccctgtgcccagccagtacctgtgcaccccccggcaggaccacggcctgattgtgtctggccccagcaaggaccctgacctggccagcggccacggcccctacagcttcaccctgggccccaaccccaccgtgcagagggactggaggctgcagaccctgaatggcagccacgcctacctgaccctggccctgcactgggtggagccccgggagcacatcatccctgtggtggtgagccacaatgcccagatgtggcagctgctggtgcgggtcatcgtgtgccgctgcaatgtggagggccagtgcatgaggaaggtgggccgcatgaagggcatgcccaccaagctgtctgctgtgggcatcctggtgggcaccctggtggccatcggcatcttcctgatcctgatcttcacccactggaccatgagcaggaagaaggaccctgaccagcctgctgacagcgtgcccctgaaggccaccgtgtag

SEQ ID NO: 145645 - DNA, 2382 bp, Artificial Sequence
  Description of Artificial Sequence: Synthetic coding sequence
atggtgcctgcctggctgtggctgctgtgtgtgtctgtgccccaggccctgcccaaggcccagcctgctgagctgtctgtggaggtgcctgaaaattatggaggcaacttccccctgtacctgaccaagctgcccctgccccgggagggcgctgagggccagatcgtgctgagcggggagcaggccgagatgcaggacggccacgtgctgtggggcccccagcctgtgctggtgcacgtgaaggatgaaaatgaccaggtgccccacttcagccaggccatctaccgggcccggctgagccggggcaccaggcctggcatccccttcctgttcctggaggccagtgacagagatgagcccggcacagccaacagcgacctgcgcttccacatcctgagccaggccccagcccagcccagcccagacatgttccagctggagccccggctgggcgccctggccctgagccccaagggcagcaccagcctggaccacgccctggagaggacctaccagctgctggtgcaggtgaaggacatgggagaccaggccagcggccaccaggccacagccaccgtggaggtgtccatcatcgagagcacctgggtgtccctggagcccatccacctggccgagaacctgaaggtgctgtacccccaccacatggcccaggtgcactggagcggaggagatgtgcactaccacctggagagccaccccccaggcccctttgaggtgaatgctgagggcaacctgtatgtgacccgggagctggaccgggaggcccaggccgagtacctgctgcaggtgcgggcccagaacagccacggggaggactatgctgcccccctggagctgcacgtgctggtgatggatgaaaatgacaacgtgcccatctgccccccccgggaccccaccgtgtccatccctgagctgagccccccaggcacagaggtgacccggctgtctgcagaagatgctgatgcccctggcagccccaacagccacgtggtgtaccagctgctgagccctgagccagaagatggagtggagggccgggccttccaggtggaccccaccagcggctctgtgaccctgggcgtgctgcccctgcgggccggccagaacatcctgctgctggtgctggccatggacctggccggggctgagggcggcttcagcagcacctgtgaggtggaggtggccgtgacagacatcaatgaccacgcccctgagttcatcaccagccagatcggccccatcagcctgcctgaagatgtggagcccggcaccctggtggccatgctgacagccattgatgctgacctggagcccgccttccggctgatggactttgccatcgagcggggggacacagagggcaccttcggcctggactgggagccagattctggccacgtgcggctgcggctgtgcaagaacctgtcctatgaggccgcccccagccatgaggtggtggtggtggtgcagagcgtggccaagctggtgggccctggccctggccctggggccacagccaccgtgacagtgctggtggagcgggtgatgcccccacccaagctggaccaggagagctatgaggcctctgtgcccatcagcgccccagctggcagcttcctgctgaccatccagcccagcgaccccatcagcaggaccctgcgcttcagcctggtgaatgacagcgagggctggctgtgcatcgagaagttcagcggggaggtgcacacagcccagagcctgcagggcgcccagcccggggacacctacacagtgctggtggaggcccaggacacagatgagccccggctgagcgccagcgcccccctggtgatccacttcctgaaggcccccccagccccagccctgaccctggcccctgtgcccagccagtacctgtgcaccccccggcaggaccacggcctgattgtgtctggccccagcaaggaccctgacctggccagcggccacggcccctacagcttcaccctgggccccaaccccaccgtgcagagggactggaggctgcagaccctgaatggcagccacgcctacctgaccctggccctgcactgggtggagccccgggagcacatcatccctgtggtggtgagccacaatgcccagatgtggcagctgctggtgcgggtcatcgtgtgccgctgcaatgtggagggccagtgcatgaggaaggtgggccgcatgaagggcatgcccaccaagctgtctgctgtgggcatcctggtgggcaccctggtggccatcggcatcttcctgatcctgatcttcacccactggaccatgagcaggaagaaggaccctgaccagcctgctgacagcgtgcccctgaaggccaccgtgtag

SEQ ID NO: 145646 - DNA, 2499 bp, Artificial Sequence
  Description of Artificial Sequence: Synthetic coding sequence
atgatcctgcaggcccacctgcacagcctgtgcctgctgatgctgtacctggccaccggctacggccaggagggcaagttcagcggccccctgaagcccatgaccttcagcatctatgagggccaggagcccagccagatcatcttccagttcaaggccaaccccccagctgtgacctttgagctgactggagaaacagacaacatcttcgtcatcgagcgggagggcctgctgtactacaacagagccctggaccgggagaccaggagcacccacaacctgcaggtggccgccctggatgccaacggcatcatcgtggagggccctgtgcccatcaccatcaaggtgaaggacatcaatgacaaccggcccaccttcctgcagagcaaatatgagggctctgtgcggcagaacagcaggcctgggaagcccttcctgtatgtgaatgccacagacctggatgatcctgccacccccaacggccagctgtactaccagatcgtcatccagctgcccatgatcaacaacgtgatgtacttccagatcaacaacaagacaggagccatcagcctgacccgggagggcagccaggagctgaacccagccaagaaccccagctacaacctggtgatctctgtgaaggacatgggcggccagagtgaaaattccttcagtgacaccacctctgtggacatcatcgtgacagagaacatctggaaggcccccaagcctgtggagatggtggagaacagcacagacccccaccccatcaagatcacccaggtgcgctggaatgaccccggggcccagtacagcctggtggacaaggagaagctgccccgcttccccttcagcattgaccaggagggggacatctacgtgacccagcccctggaccgggaggagaaggatgcctacgtgttctatgctgtggccaaggatgaatatggcaagcccctgagctaccccctggagatccacgtgaaggtgaaggacatcaatgacaacccccccacctgccccagccctgtgacagtgtttgaggtgcaggagaatgaaaggctgggcaacagcatcggcaccctgacagcccatgacagagatgaggagaacacagccaacagcttcctgaactacagaattgtggagcagacccccaagctgcccatggatggcctcttcctgatccagacctacgccggcatgctgcagctggccaagcagagcctgaagaagcaggacaccccccagtacaacctgaccatcgaggtgtctgacaaggacttcaagaccctgtgctttgtgcagatcaacgtcatcgacatcaatgaccagatccccatctttgagaagagtgactatggcaacctgaccctggccgaggacaccaacatcggcagcaccatcctgaccatccaggccacagatgctgatgagcccttcaccggcagcagcaagatcctgtaccacatcatcaagggggacagcgagggccgcctgggcgtggacacagacccccacaccaacacaggctacgtgatcatcaagaagcccctggactttgaaacagctgctgtgagcaacatcgtgttcaaggccgagaaccctgagcccctggtgtttggagtgaagtacaatgccagcagctttgccaagttcaccctcatcgtgacagatgtgaatgaggccccccagttcagccagcacgtgttccaggccaaggtgtctgaagatgtggccatcggcaccaaggtgggcaatgtgacagccaaggaccctgagggcctggacatctcctacagcctgcggggggacacccggggctggctgaagattgaccacgtgactggagagatcttctctgtggcccccctggaccgggaggccggcagcccctacagagtgcaggtggtggccacagaggtgggcggcagcagcctgagctctgtgtctgagttccacctgatcctgatggatgtgaatgacaaccccccccggctggccaaggactacacaggcctcttcttctgccaccccctgagcgcccctggcagcctcatctttgaggccacagatgatgaccagcacctgttccggggcccccacttcaccttcagcctgggcagcggcagcctgcagaatgactgggaggtgtccaagatcaatggcacccacgcccggctgagcaccaggcacacagaatttgaggagcgggagtatgtggtgctgatccgcatcaatgatggcggccggccccccctggagggcatcgtgtccctgcctgtgaccttctgcagctgtgtggagggcagctgcttccggcctgctggccaccagacaggcatccccaccgtgggcatggctgtgggcatcctgctgaccaccctgctggtgattggcatcatcctggccgtggtgttcatccgcatcaagaaggacaagggcaaggacaacgtggagagcgcccaggccagcgaggtgaagcccctgcggagctag

SEQ ID NO: 145647 - DNA, 2499 bp, Artificial Sequence; identical to SEQ ID NO: 145646
  Description of Artificial Sequence: Synthetic coding sequence

SEQ ID NO: 145648 - DNA, 444 bp, Artificial Sequence
  Description of Artificial Sequence: Synthetic coding sequence
atgatcctgcaggcccacctgcacagcctgtgcctgctgatgctgtacctggccaccggctacggccaggagggcaagttcagcggccccctgaagcccatgaccttcagcatctatgagggccaggagcccagccagatcatcttccagttcaaggccaaccccccagctgtgacctttgagctgactggagaaacagacaacatcttcgtcatcgagcgggagggcctgctgtactacaacagagccctggaccgggagaccaggagcacccacaacctgcaggtggccgccctggatgccaacggcatcatcgtggagggccctgtgcccatcaccatcaaggtgaaggacatcaatgacaaccggcccaccttcctgcagagcaaatatgagggctctgtgcggcagaacagcaggcctgggaagcccttcctgtactag

SEQ ID NO: 145649 - DNA, 2373 bp, Artificial Sequence
  Description of Artificial Sequence: Synthetic coding sequence
atgaagatcaccagcaccagctgcatctgccctgtgctggtgtgcctgtgctttgtgcagcgctgctatggaacagcccaccacagcagcatcaaggtgatgaggaaccagaccaagcacattgaaggagaaacagaggtgcaccaccggcccaagaggggctgggtgtggaaccagttctttgtgctggaggagcacatgggccctgacccccagtatgtgggcaagctgcacagcaacagcgacaagggagatggctctgtgaagtacatcctgactggagagggcgccggcaccatcttcatcattgatgacaccactggagacatccacagcaccaagagcctggaccgggagcagaagacccactacgtgctgcacgcccaggccatcgacaggaggaccaacaagcccctggagcctgagagcgagttcatcatcaaggtgcaggacatcaatgacaatgcccccaagttcacagatggcccctacatcgtgacagtgcctgagatgtctgacatgggcacctctgtgctgcaggtgacagccacagatgctgatgaccccacctacggcaacagcgcccgggtggtgtacagcatcctgcagggccagccctacttctctgtggaccccaagacaggagtcatcagaacagccctgcacaacatggaccgggaggcccgggagcactacagcgtggtgatccaggccaaggacatggccggccaggtgggcggcctgagcggcagcaccaccgtgaacatcaccctgacagatgtgaatgacaaccccccacgcttcccccagaagcactaccagctgtatgtgcctgagagcgcccaggtgggcagcgctgtgggcaagatcaaggccaatgatgctgacaccggcagcaatgctgacatgacctacagcatcatcaatggagatggcatgggcatcttcagcatcagcacagacaaggagacccgggagggcatcctgagcctgaagaagcccctgaactatgagaagaagaagagctacaccctgaacattgaaggagccaacacccacctggacttccgcttcagccacctgggccccttcaaggatgccaccatgctgaagatcatcgtgggagatgtggatgagcccccactcttctccatgcccagctacctgatggaggtgtatgaaaatgccaagattggcaccgtggtgggcaccgtgctggcccaggaccctgacagcaccaacagcctggtgcgctacttcatcaactacaacgtggaggatgaccgcttcttcaacattgatgccaacacaggcaccatccgcaccaccaaggtgctggaccgggaggagaccccctggtacaacatcaccgtgacagccagcgagattgacaacccagacctgctgagccacgtgacagtgggcatccgggtgctggatgtgaatgacaaccccccagagctggcccgggagtatgacatcatcgtgtgtgagaacagcaagccaggccaggtgatccacaccatcagcgccacagacaaggatgactttgccaacggcccccgcttcaacttcttcctggatgagcggctgcctgtgaaccccaacttcaccctgaaggacaatgaagacaacacagccagcatcctgaccaggagaagacgcttcagcaggacagtgcaggatgtgtactacctgcccatcatgatcagtgatggcggcatccccagcctgagcagcagcagcaccctgaccatccgggtgtgtgcctgtgaaagagatggccgggtgaggacctgccacgccgaggccttcctgagcagcgctggcctgagcactggagccctgattgccatcctgctgtgtgtgctgatcctgctggccatcgtggtgctcttcatcaccctgcggcgcagcaagaaggagcccctcatcatcagtgaagaagatgtgagagaaaatgtggtgacctatgatgatgagggcggcggggaggaggacacagaggcctttgacatcacagccctgaggaaccccagcgctgctgaggagctgaagtaccgccgggacatccggcctgaggtgaagctgacccccaggcaccagaccagcagcaccctggagagcattgatgtgcaggagttcatcaagcagaggctggccgaggccgacctggaccccagcgtgcccccctatgacagcctgcagacctacgcctatgagggccagaggtctgaggccggcagcatcagcagcctggacagcgccaccacccagagcgaccaggactaccactacctgggggactggggccctgagttcaagaagctggccgagctgtatggagaaattgagagcgagaggaccacctag

SEQ ID NO: 145650 - DNA, 2373 bp, Artificial Sequence; identical to SEQ ID NO: 145649
  Description of Artificial Sequence: Synthetic coding sequence

SEQ ID NO: 145651 - DNA, 1725 bp, Artificial Sequence
  Description of Artificial Sequence: Synthetic coding sequence
atgaagatcaccagcaccagctgcatctgccctgtgctggtgtgcctgtgctttgtgcagcgctgctatggaacagcccaccacagcagcatcaaggtgatgaggaaccagaccaagcacattgaaggagaaacagaggtgcaccaccggcccaagaggggctgggtgtggaaccagttctttgtgctggaggagcacatgggccctgacccccagtatgtgggcaagctgcacagcaacagcgacaagggagatggctctgtgaagtacatcctgactggagagggcgccggcaccatcttcatcattgatgacaccactggagacatccacagcaccaagagcctggaccgggagcagaagacccactacgtgctgcacgcccaggccatcgacaggaggaccaacaagcccctggagcctgagagcgagttcatcatcaaggtgcaggacatcaatgacaatgcccccaagttcacagatggcccctacatcgtgacagtgcctgagatgtctgacatgggcacctctgtgctgcaggtgacagccacagatgctgatgaccccacctacggcaacagcgcccgggtggtgtacagcatcctgcagggccagccctacttctctgtggaccccaagacaggagtcatcagaacagccctgcacaacatggaccgggaggcccgggagcactacagcgtggtgatccaggccaaggacatggccggccaggtgggcggcctgagcggcagcaccaccgtgaacatcaccctgacagatgtgaatgacaaccccccacgcttcccccagaagcactaccagctgtatgtgcctgagagcgcccaggtgggcagcgctgtgggcaagatcaaggccaatgatgctgacaccggcagcaatgctgacatgacctacagcatcatcaatggagatggcatgggcatcttcagcatcagcacagacaaggagacccgggagggcatcctgagcctgaagaagcccctgaactatgagaagaagaagagctacaccctgaacattgaaggagccaacacccacctggacttccgcttcagccacctgggccccttcaaggatgccaccatgctgaagatcatcgtgggagatgtggatgagcccccactcttctccatgcccagctacctgatggaggtgtatgaaaatgccaagattggcaccgtggtgggcaccgtgctggcccaggaccctgacagcaccaacagcctggtgcgctacttcatcaactacaacgtggaggatgaccgcttcttcaacattgatgccaacacaggcaccatccgcaccaccaaggtgctggaccgggaggagaccccctggtacaacatcaccgtgacagccagcgagattgacaacccagacctgctgagccacgtgacagtgggcatccgggtgctggatgtgaatgacaaccccccagagctggcccgggagtatgacatcatcgtgtgtgagaacagcaagccaggccaggtgatccacaccatcagcgccacagacaaggatgactttgccaacggcccccgcttcaacttcttcctggatgagcggctgcctgtgaaccccaacttcaccctgaaggacaatgaggccgccgcccccagccccagcggctttgtgcacgcccgggagatgggcgtgtgtggccctgccatgcagaagcccagctgcccccggctggtgtag

SEQ ID NO: 145652 - DNA, 2373 bp, Artificial Sequence; identical to SEQ ID NO: 145649
  Description of Artificial Sequence: Synthetic coding sequence

SEQ ID NO: 145653 - DNA, 2373 bp, Artificial Sequence; identical to SEQ ID NO: 145649
  Description of Artificial Sequence: Synthetic coding sequence

SEQ ID NO: 145654 - DNA, 2319 bp, Artificial Sequence
  Description of Artificial Sequence: Synthetic coding sequence
atgaactgctacctgctgctgcgcttcatgctgggcatccccctgctgtggccctgcctgggcgccacagagaacagccagaccaagaaggtgaagcagcctgtgcgcagccacctgcgggtgaagaggggctgggtgtggaaccagttctttgtgcctgaggagatgaacaccaccagccaccacatcggccagctgcggagtgacctggacaatggaaacaacagcttccagtacaagctgctgggcgctggggccggcagcaccttcatcattgatgagaggactggagacatctatgccatccagaagctggaccgggaggagaggagcctgtacatcctgcgggcccaggtgattgacatcgccaccggccgggctgtggagcctgagagcgagtttgtgatcaaggtgtctgacatcaatgacaatgagcccaagttcctggatgagccctatgaggccatcgtgcctgagatgagccctgagggcaccctggtgatccaggtgacagccagtgatgctgatgaccccagcagcggcaacaatgcccggctgctgtacagcctgctgcagggccagccctacttctctgtggagcccaccactggagtcatccgcatcagcagcaagatggaccgggagctgcaggatgagtactgggtgatcatccaggccaaggacatgattggccagcccggggccctgagcggcaccacctctgtgctgatcaagctgagtgatgtgaatgacaacaagcccatcttcaaggagagcctgtaccgcctgactgtgtctgagagcgcccccaccggcaccagcatcggcaccatcatggcctatgacaatgacattggagaaaatgctgagatggactacagcattgaagaagatgacagccagacctttgacatcatcaccaaccacgagacccaggagggcatcgtcatcctgaagaagaaggtggactttgagcaccagaaccactacggcatccgggccaaggtgaagaaccaccacgtgcctgagcagctgatgaagtaccacacagaggccagcaccaccttcatcaagatccaggtggaggatgtggatgagcccccactcttcctgctgccctactacgtgtttgaggtgtttgaggagaccccccagggcagctttgtgggcgtggtgtctgccacagatcctgacaacaggaagagccccatccgctacagcatcaccaggagcaaggtgttcaacatcaatgacaatggcaccatcaccaccagcaacagcctggaccgggagatcagcgcctggtacaacctgagcatcacagccacagagaagtacaacatcgagcagatcagcagcatccccctgtatgtgcaggtgctgaacatcaatgaccacgcccctgagttcagccagtactatgagacctacgtgtgtgaaaatgccggcagcggccaggtgatccagaccatctctgctgtggacagagatgagagcattgaggagcaccacttctacttcaacctgtctgtggaggacaccaacaacagcagcttcaccatcatcgacaaccaggacaacacagctgtgatcctgaccaacagaacaggcttcaacctgcaggaggagcccgtcttctacatcagcatcctgattgctgacaatggcatccccagcctgaccagcaccaacaccctgaccatccacgtgtgtgactgtggggacagcggcagcacccagacctgccagtaccaggagctggtgctgtccatgggcttcaagacagaggtgatcatcgccatcctgatctgcatcatgatcatcttcggcttcatcttcctgaccctgggcctgaagcagaggaggaagcagatcctcttccctgagaagtctgaggacttccgggagaacatcttccagtatgatgatgaaggaggaggagaggaggacacagaggcctttgatattgctgagctgcggagcagcaccatcatgagggagaggaagaccaggaagaccaccagcgctgagatccgcagcctgtaccggcagagcctgcaggtgggccctgacagcgccatcttcaggaagttcatcctggagaagctggaggaggccaacacagacccctgtgcccccccatttgacagcctgcagacctacgcctttgagggcaccggcagcctggccggcagcctgagcagcctggagagcgctgtgtctgaccaggatgagagctatgactacctgaatgagctgggcccccgcttcaagaggctggcctgcatgtttggcagcgctgtgcagagcaacaactag

SEQ ID NO: 145655 - DNA, 1173 bp, Artificial Sequence
  Description of Artificial Sequence: Synthetic coding sequence
atgaacaccaccagccaccacatcggccagctgcggagtgacctggacaatggaaacaacagcttccagtacaagctgctgggcgctggggccggcagcaccttcatcattgatgagaggactggagacatctatgccatccagaagctggaccgggaggagaggagcctgtacatcctgcgggcccaggtgattgatattgccaccggccgggctgtggagcctgagagcgagtttgtgatcaaggtgtctgacatcaatgacaatgagcccaagttcctggatgagccctatgaggccatcgtgcctgagatgagccctgagggcaccctggtgatccaggtgacagccagtgatgctgatgaccccagcagcggcaacaatgcccggctgctgtacagcctgctgcagggccagccctacttctctgtggagcccaccaccggggtcatccgcatcagcagcaagatggaccgggagctgcaggatgagtactgggtgatcatccaggccaaggacatgattggccagcccggggccctgagcggcaccacctctgtgctgatcaagctgagtgatgtgaatgacaacaagcccatcttcaaggagagcctgtaccgcctgactgtgtctgagagcgcccccaccggcaccagcatcggcaccatcatggcctatgacaatgacatcggggagaatgctgagatggactacagcattgaggaggatgacagccagacctttgacatcatcaccaaccacgagacccaggagggcatcgtcatcctgaagaagaaggtggactttgagcaccagaaccactacggcatccgggccaaggtgaagaaccaccacgtgcctgagcagctgatgaagtaccacacagaggccagcaccaccttcatcaagatccaggtggaggatgtggatgagcccccactcttcctgctgccctactacgtgtttgaggtgtttgaggagaccccccagggcagctttgtgggcgtggtgtctgccacagatcctgacaacaggaagagccccatccgctacagcatcaccaggagcaaggtgttcaacatcaatgacaatggcaccatcaccaccagcaacagcctggaccgggagatcagcgcctggtacaacctgagcatcacagccacagagaagtag

SEQ ID NO: 145656 - DNA, 1473 bp, Artificial Sequence
  Description of Artificial Sequence: Synthetic coding sequence
atgaactgctacctgctgctgcgcttcatgctgggcatccccctgctgtggccctgcctgggcgccacagagaacagccagaccaagaaggtgaagcagcctgtgcgcagccacctgcgggtgaagaggggctgggtgtggaaccagttctttgtgcctgaggagatgaacaccaccagccaccacatcggccagctgcggagtgacctggacaatggaaacaacagcttccagtacaagctgctgggcgctggggccggcagcaccttcatcattgatgagaggactggagacatctatgccatccagaagctggaccgggaggagaggagcctgtacatcctgcgggcccaggtgattgacatcgccaccggccgggctgtggagcctgagagcgagtttgtgatcaaggtgtctgacatcaatgacaatgagcccaagttcctggatgagccctatgaggccatcgtgcctgagatgagccctgagggcaccctggtgatccaggtgacagccagtgatgctgatgaccccagcagcggcaacaatgcccggctgctgtacagcctgctgcagggccagccctacttctctgtggagcccaccactggagtcatccgcatcagcagcaagatggaccgggagctgcaggatgagtactgggtgatcatccaggccaaggacatgattggccagcccggggccctgagcggcaccacctctgtgctgatcaagctgagtgatgtgaatgacaacaagcccatcttcaaggagagcctgtaccgcctgactgtgtctgagagcgcccccaccggcaccagcatcggcaccatcatggcctatgacaatgacattggagaaaatgctgagatggactacagcattgaagaagatgacagccagacctttgacatcatcaccaaccacgagacccaggagggcatcgtcatcctgaagaagaaggtggactttgagcaccagaaccactacggcatccgggccaaggtgaagaaccaccacgtgcctgagcagctgatgaagtaccacacagaggccagcaccaccttcatcaagatccaggtggaggatgtggatgagcccccactcttcctgctgccctactacgtgtttgaggtgtttgaggagaccccccagggcagctttgtgggcgtggtgtctgccacagatcctgacaacaggaagagccccatccgctacagcatcaccaggagcaaggtgttcaacatcaatgacaatggcaccatcaccaccagcaacagcctggaccgggagatcagcgcctggtacaacctgagcatcacagccacagagaagtacaacatcgagcagatcagcagcatccccctgtatgtgcaggtgctgaacatcaatgaccacgcccctgagttcagccagtactatgagacctacgtgtgtgaaaatgccggcagcggccagggcctcttcttctag

SEQ ID NO: 145657 - DNA, 2406 bp, Artificial Sequence
  Description of Artificial Sequence: Synthetic coding sequence
atgtggaccagcggccgcatgagcaatgccaagaactggctgggcctgggcatgagcctgtacttctggggcctgatggacctgaccaccaccgtgctgagtgacacccccaccccccagggcgagctggaggccctgctgagtgacaagccccagagccaccagaggaccaagaggtcctgggtgtggaaccagttctttgtgctggaggagtacacaggaacagaccccctgtatgtgggcaagctgcacagcgacatggacagaggagatggcagcatcaagtacatcctgtctggagagggcgccggcatcgtgttcaccattgatgacaccactggagacatccacgccatccagaggctggaccgggaggagcgggcccagtacaccctgcgggcccaggccctggacagaagaacaggccggcccatggagcctgagagcgagttcatcatcaagatccaggacatcaatgacaatgagcccaagttcctggatggcccctacgtggccaccgtgcctgagatgagccctgtgggcaccagcgtcatccaggtgacagccacagatgctgatgaccccacctacggcaacagcgcccgggtggtgtacagcatcctgcagggccagccctacttctctgtggacagcaagacaggagtcatcagaacagccctgatgaacatggaccgggaggccaaggagtactatgaggtgatcatccaggccaaggacatgggcggccagctgggcggcctggccggcaccaccaccgtgaacatcaccctgagtgatgtgaatgacaaccccccacgcttcccccagaagcactaccagatgtctgtgctggagagcgcccccatcagcagcacagtgggccgggtgtttgccaaggacctggatgagggcatcaatgctgagatgaagtacaccatcgtggatggagatggagcagatgcctttgacatcagcacagaccccaacttccaggtgggcatcatcaccgtgaagaagcccctgagctttgagagcaagaagagctacaccctgaaggtggagggcgccaacccccacctggagatgaggttcctgaacctgggccccttccaggacaccaccaccgtgcacatctctgtggaggatgtggatgagccccctgtgtttgagcccggcttctactttgtggaggtgcctgaagatgtggccatcggcaccaccatccagatcatcagcgccaaggaccctgatgtgaccaacaacagcatccgctacagcattgacaggagcagtgaccccggccgcttcttctacgtggacatcaccactggagccctgatgacagcccggcccctggaccgggaggagttctcctggcacaacatcaccgtgctggccatggagatgaacaaccccagccaggtgggctctgtgcctgtgaccatcaaggtgctggatgtgaatgacaatgcccctgagttcccccgcttctatgaggcctttgtgtgtgaaaatgccaaggccggccagctgatccagacagtgtctgctgtggaccaggatgaccccagaaatggccagcacttctactacagcctggcccctgaggccgccaacaaccccaacttcaccatccgggacaaccaggacaacacagcccgcatcctgacccggcgcagcggcttccggcagcaggagcagagcgtcttccacctgcccatcctgattgctgacagcggccagcctgtgctgagcagcacaggcaccctgaccatccaggtgtgcagctgtgatgatgatggccacgtgatgagctgcagccctgaggcctacatgctgcctgtgtccctgagcagaggagccctgattgccatcctggcctgcatctttgtgctgctggtgctggtgctgctgatcctgtccatgagaagacacaggaagcagccctacatcattgatgatgaggagaacatccacgagaacatcgtgcgctatgatgatgaaggaggaggagaggaggacacagaggcctttgatattgctgccatgtggaacccccgggaggcccaggccggggccgcccccaagacccggcaggacatgctgcctgagattgagagcctgagccgctacgtgccccagacctgtgctgtgaacagcacagtgcacagctatgtgctggccaagctgtatgaagctgacatggacctgtgggcccccccatttgacagcctgcagacctacatgtttgaaggagatggctctgtggccggcagcctgagcagcctgcagagcgccaccagtgacagcgagcagagctttgacttcctgacagactggggcccccgcttcaggaagctggccgagctgtatggagccagcgagggccctgcccccctgtggtag

SEQ ID NO: 145658 - DNA, 2406 bp, Artificial Sequence; identical to SEQ ID NO: 145657
  Description of Artificial Sequence: Synthetic coding sequence

SEQ ID NO: 145659 - DNA, 2406 bp, Artificial Sequence; identical to SEQ ID NO: 145657
  Description of Artificial Sequence: Synthetic coding sequence

SEQ ID NO: 145660 - DNA, 2487 bp, Artificial Sequence
  Description of Artificial Sequence: Synthetic coding sequence
atgaggcccaggcctgagggccggggcctgcgggccggcgtggccctgagccctgccctgctgctgctgctgctgctgcccccaccacccaccctgctgggccgcctgtgggccgccggcacccccagccccagcgcccctggggcccggcaggatggagccctgggcgccggccgggtgaagaggggctgggtgtggaaccagttctttgtggtggaggagtacacaggaacagagcccctgtatgtgggcaagatccacagcgacagtgatgaaggagatggagccatcaagtacaccatcagcggggagggcgccggcaccatcttcctgattgatgagctgaccggggacatccacgccatggagcggctggaccgggagcagaagaccttctacaccctgcgggcccaggcccgggaccgggccaccaaccggctgctggagcctgagagcgagttcatcatcaaggtgcaggacatcaatgacagcgagccccgcttcctgcacggcccctacatcggctctgtggccgagctgagccccaccggcacctctgtgatgcaggtgatggccagtgatgctgatgaccccacctacggcagcagcgcccggctggtgtacagcgtgctggatggagagcaccacttcaccgtggaccccaagacaggagtcatcagaacagctgtgcctgacctggaccgggagagccaggagagatatgaggtggtgatccaggccacagacatggccggccagctgggcggcctgagcggcagcaccaccgtgaccatcgtggtgacagatgtgaatgacaaccccccacgcttcccccagaagatgtaccagttcagcatccaggagagcgcccccatcggcacagctgtgggccgggtgaaggccgaggacagtgatgtgggggagaacacagacatgacctaccacctgaaggatgagagcagcagtggaggagatgtgttcaaggtgaccacagacagcgacacccaggaggccatcatcgtggtgcagaagaggctggactttgagagccagcctgtgcacacagtcatcctggaggccctgaacaagtttgtggaccccaggtttgctgacctgggcaccttccgggaccaggccatcgtgcgggtggccgtgacagatgtggatgagcccccagagttccggccccccagcggcctgctggaggtgcaggaggatgcccaggtgggcagcctggtgggcgtggtgacagcccgggaccctgatgctgccaacagacctgtgcgctatgccatcgaccgggagagtgacctggaccagatctttgatattgatgctgacaccggggccatcgtgacaggcaagggcctggaccgggagacagctggctggcacaacatcaccgtgctggccatggaggccgacaaccacgcccagctgagccgggccagcctgcgcatccgcatcctggatgtgaatgacaaccccccagagctggccaccccctatgaagctgctgtgtgtgaagatgccaagccaggccagctgatccagaccatctctgtggtggacagagatgagccccagggcggccaccgcttctacttccggctggtgcctgaggcccccagcaacccccacttcagcctgctggacatccaggacaacacagctgctgtgcacacccagcacgtgggcttcaaccggcaggagcaggatgtgttcttcctgcccatcctggtggtggacagcggcccccccaccctgagcagcacaggcaccctgaccatccgcatctgtggctgtgacagcagcggcaccatccagagctgcaacaccacagcctttgtgatggccgccagcctgagccctggggccctgattgccctgctggtgtgtgtgctgatcctggtggtgctggtgctgctgatcctgaccctgcggcggcaccacaagagccacctgagcagtgatgaagatgaggacatgagggacaacgtcatcaagtacaatgatgagggcggcggggagcaggacacagaggcctatgacatgtctgccctgcggagcctgtatgactttggagagctgaagggaggagatggcggcggcagcgctgggggcggggccggcggcggcagcggcggcggggccggcagccccccccaggcccacctgcccagcgagcggcacagcctgccccagggcccccccagccctgagccagacttctctgtgttccgggacttcatcagcaggaaggtggccctggctgatggagacctgtctgtgcccccctatgatgccttccagacctacgcctttgaaggagctgacagccctgctgccagcctgagcagcctgcacagcggcagcagcggcagcgagcaggactttgcctacctgagctcctggggcccccgcttccggcccctggccgccctgtatgccggccacagaggagatgatgaggcccaggccagctag

SEQ ID NO: 145661 - DNA, 2487 bp, Artificial Sequence; identical to SEQ ID NO: 145660
  Description of Artificial Sequence: Synthetic coding sequence

SEQ ID NO: 145662 - DNA, 2490 bp, Artificial Sequence
  Description of Artificial Sequence: Synthetic coding sequence
atgggcctgccccggggccccctggccagcctgctgctgctgcaggtgtgctggctgcagtgtgccgccagcgagccctgcagagctgtgttccgggaggccgaggtgaccctggaggccggcggcgctgagcaggagcccggccaggccctgggcaaggtgttcatgggctgccccggccaggagcccgccctcttcagcacagacaatgatgacttcaccgtgagaaatggagagaccgtgcaggagcggcgcagcctgaaggagaggaaccccctgaagatcttccccagcaagaggatcctgcggcggcacaagagggactgggtggtggcccccatctctgtgcctgaaaatggcaagggccccttcccccagaggctgaaccagctgaagagcaacaaggaccgggacaccaagatcttctacagcatcaccggccctggagctgacagccccccagagggcgtgtttgctgtggagaaggagaccggctggctgctgctgaacaagcccctggaccgggaggagatcgccaagtatgagctgtttggacatgctgtgtctgaaaatggagcctctgtggaggaccccatgaacatcagcatcatcgtgacagaccagaatgaccacaagcccaagttcacccaggacaccttccggggctctgtgctggagggcgtgctgcccggcacctctgtgatgcaggtgacagccacagatgaagatgatgccatctacacctacaacggggtggtggcctacagcatccacagccaggagcccaaggacccccatgacctgatgttcaccatccacaggagcacaggcaccatcagcgtcatcagcagcggcctggaccgggagaaggtgcctgagtacaccctgaccatccaggccacagacatggatggagatggcagcaccaccacagctgtggccgtggtggagatcctggatgccaatgacaatgcccccatgtttgacccccagaagtatgaggcccacgtgcctgaaaatgctgtgggccacgaggtgcagaggctgactgtgacagacctggatgcccccaacagccctgcctggagggccacctacctgatcatgggaggagatgatggagaccacttcaccatcaccacccaccctgagagcaaccagggcatcctgaccaccaggaagggcctggactttgaggccaagaaccagcacaccctgtatgtggaggtgaccaatgaggccccctttgtgctgaagctgcccaccagcacagccaccatcgtggtgcacgtggaggatgtgaatgaggcccctgtgtttgtgccccccagcaaggtggtggaggtgcaggagggcatccccactggagagcctgtgtgtgtgtacacagcagaagatcctgacaaggagaaccagaagatctcctaccgcatcctgcgggaccctgctggctggctggccatggaccctgacagcggccaggtgacagctgtgggcaccctggaccgggaggatgagcagtttgtgaggaacaacatctatgaggtgatggtgctggccatggacaatggcagcccccccaccactggaacaggcaccctgctgctgaccctgattgatgtgaatgaccacggccctgtgcctgagccccggcagatcaccatctgcaaccagagccctgtgcggcaggtgctgaacatcacagacaaggacctgagcccccacaccagccccttccaggcccagctgacagatgacagcgacatctactggacagctgaggtgaatgaggagggggacacagtggtgctgagcctgaagaagttcctgaagcaggacacctatgatgtgcacctgagcctgagtgaccacggcaacaaggagcagctgaccgtcatccgggccaccgtgtgtgactgccacggccacgtggagacctgccccggcccctggaagggcggcttcatcctgcctgtgctgggcgctgtgctggccctgctcttcctgctgctggtgctgctgctgctggtgaggaagaagaggaagatcaaggagcccctgctgctgcctgaagatgacacccgggacaacgtgttctactatggagaggagggcggcggggaggaggaccaggactatgacatcacccagctgcaccggggcctggaggcccggcctgaggtggtgctgagaaatgatgtggcccccaccatcatccccacccccatgtaccggcccaggcctgccaacccagatgagatcggcaacttcatcatcgagaacctgaaggccgccaacacagaccccacagccccaccctatgacaccctgctggtgtttgattatgagggcagcggcagtgatgctgccagcctgagcagcctgaccagcagcgccagtgaccaggaccaggactatgactacctgaatgagtggggcagccgcttcaagaagctggccgacatgtatggaggaggagaagatgactag

SEQ ID NO: 145663 - DNA, 2355 bp, Artificial Sequence
  Description of Artificial Sequence: Synthetic coding sequence
atgggcctgccccggggccccctggccagcctgctgctgctgcaggtgtgctggctgcagtgtgccgccagcgagccctgcagagctgtgttccgggaggccgaggtgaccctggaggccggcggcgctgagcaggagcccggccaggccctgggcaaggtgttcatgggctgccccggccaggagcccgccctcttcagcacagacaatgatgacttcaccgtgagaaatggagagaccgtgcaggagcggcgcagcctgaaggagaggaaccccctgaagatcttccccagcaagaggatcctgcggcggcacaagagggactgggtggtggcccccatctctgtgcctgaaaatggcaagggccccttcccccagaggctgaaccagctgaagagcaacaaggaccgggacaccaagatcttctacagcatcaccggccctggagctgacagccccccagagggcgtgtttgctgtggagaaggagaccggctggctgctgctgaacaagcccctggaccgggaggagatcgccaagtatgagctgtttggacatgctgtgtctgaaaatggagcctctgtggaggaccccatgaacatcagcatcatcgtgacagaccagaatgaccacaagcccaagttcacccaggacaccttccggggctctgtgctggagggcgtgctgcccggcacctctgtgatgcaggtgacagccacagatgaagatgatgccatctacacctacaacggggtggtggcctacagcatccacagccaggagcccaaggacccccatgacctgatgttcaccatccacaggagcacaggcaccatcagcgtcatcagcagcggcctggaccgggagaaggtgcctgagtacaccctgaccatccaggccacagacatggatggagatggcagcaccaccacagctgtggccgtggtggagatcctggatgccaatgacaatgcccccatgtttgacccccagaagtatgaggcccacgtgcctgaaaatgctgtgggccacgaggtgcagaggctgactgtgacagacctggatgcccccaacagccctgcctggagggccacctacctgatcatgggaggagatgatggagaccacttcaccatcaccacccaccctgagagcaaccagggcatcctgaccaccaggaagggcctggactttgaggccaagaaccagcacaccctgtatgtggaggtgaccaatgaggccccctttgtgctgaagctgcccaccagcacagccaccatcgtggtgcacgtggaggatgtgaatgaggcccctgtgtttgtgccccccagcaaggtggtggaggtgcaggagggcatccccactggagagcctgtgtgtgtgtacacagcagaagatcctgacaaggagaaccagaagatctcctaccgcatcctgcgggaccctgctggctggctggccatggaccctgacagcggccaggtgacagctgtgggcaccctggaccgggaggatgagcagtttgtgaggaacaacatctatgaggtgatggtgctggccatggacaatggcagcccccccaccactggaacaggcaccctgctgctgaccctgattgatgtgaatgaccacggccctgtgcctgagccccggcagatcaccatctgcaaccagagccctgtgcggcaggtgctgaacatcacagacaaggacctgagcccccacaccagccccttccaggcccagctgacagatgacagcgacatctactggacagctgaggtgaatgaggagggggacacagtggtgctgagcctgaagaagttcctgaagcaggacacctatgatgtgcacctgagcctgagtgaccacggcaacaaggagcagctgaccgtcatccgggccaccgtgtgtgactgccacggccacgtggagacctgccccggcccctggaagggcggcttcatcctgcctgtgctgggcgctgtgctggccctgctcttcctgctgctggtgctgctgctgctggtgaggaagaagaggaagatcaaggagcccctgctgctgcctgaagatgacacccgggacaacgtgttctactatggagaggagggcggcggggaggaggaccaggactatgacatcacccagctgcaccggggcctggaggcccggcctgaggtggtgctgagaaatgatgtggcccccaccatcatccccacccccatgtaccggcccaggcctgccaacccagatgagatcggcaacttcatcatcgagggccgcggggagcggggcagccagagaggaaatggaggcctgcagctggcccggggccgcacccggcgctcctag

SEQ ID NO: 145664 - DNA, 2325 bp, Artificial Sequence
  Description of Artificial Sequence: Synthetic coding sequence
atgggctgccccggccaggagcccgccctcttcagcacagacaatgatgacttcaccgtgagaaatggagaaacagtgcaggagaggaggagcctgaaggagaggaaccccctgaagatcttccccagcaagaggatcctgcggcggcacaagagggactgggtggtggcccccatctctgtgcctgaaaatggcaagggccccttcccccagaggctgaaccagctgaagagcaacaaggaccgggacaccaagatcttctacagcatcactggacctggagctgacagccccccagagggcgtgtttgctgtggagaaggagaccggctggctgctgctgaacaagcccctggaccgggaggagatcgccaagtatgagctgtttggacatgctgtgtctgaaaatggagcctctgtggaggaccccatgaacatcagcatcatcgtgacagaccagaatgaccacaagcccaagttcacccaggacaccttccggggctctgtgctggagggcgtgctgcccggcacctctgtgatgcaggtgacagccacagatgaagatgatgccatctacacctacaatggagtggtggcctacagcatccacagccaggagcccaaggacccccatgacctgatgttcaccatccacaggagcacaggcaccatcagcgtcatcagcagcggcctggaccgggagaaggtgcctgagtacaccctgaccatccaggccacagacatggatggagatggcagcaccaccacagctgtggccgtggtggagatcctggatgccaatgacaatgcccccatgtttgacccccagaagtatgaggcccacgtgcctgaaaatgctgtgggccacgaggtgcagaggctgactgtgacagacctggatgcccccaacagccctgcctggagggccacctacctgatcatgggaggagatgatggagaccacttcaccatcaccacccaccctgagagcaaccagggcatcctgaccaccaggaagggcctggactttgaggccaagaaccagcacaccctgtatgtggaggtgaccaatgaggccccctttgtgctgaagctgcccaccagcacagccaccatcgtggtgcacgtggaggatgtgaatgaggcccctgtgtttgtgccccccagcaaggtggtggaggtgcaggagggcatccccaccggggagcctgtgtgtgtgtacacagctgaggaccctgacaaggagaaccagaagatctcctaccgcatcctgcgggaccctgctggctggctggccatggaccctgattctggccaggtgacagctgtgggcaccctggacagagaagatgagcagtttgtgaggaacaacatctatgaggtgatggtgctggccatggacaatggcagcccccccaccaccggcaccggcaccctgctgctgaccctgattgatgtgaatgaccacggccctgtgcctgagccccggcagatcaccatctgcaaccagagccctgtgcggcaggtgctgaacatcacagacaaggacctgagcccccacaccagccccttccaggcccagctgacagatgacagcgacatctactggacagctgaggtgaatgaggagggggacacagtggtgctgagcctgaagaagttcctgaagcaggacacctatgatgtgcacctgagcctgagtgaccacggcaacaaggagcagctgaccgtcatccgggccaccgtgtgtgactgccacggccacgtggagacctgccccggcccctggaagggcggcttcatcctgcctgtgctgggcgctgtgctggccctgctcttcctgctgctggtgctgctgctgctggtgaggaagaagaggaagatcaaggagcccctgctgctgcctgaagatgacacccgggacaacgtgttctactacggggaggagggcggcggggaggaggaccaggactatgacatcacccagctgcaccggggcctggaggcccggcctgaggtggtgctgagaaatgatgtggcccccaccatcatccccacccccatgtaccggcccaggcctgccaacccagatgaaattggcaacttcatcatcgagaacctgaaggccgccaacacagaccccacagccccaccctatgacaccctgctggtgtttgattatgagggcagcggcagtgatgctgccagcctgagcagcctgaccagcagcgccagtgaccaggaccaggactatgactacctgaatgagtggggcagccgcttcaagaagctggccgacatgtatggaggaggagaagatgactag

SEQ ID NO: 145665 - DNA, 2751 bp, Artificial Sequence
  Description of Artificial Sequence: Synthetic coding sequence
atgacagctggagctggggtgctgctgctgctgctgagcctgagcggggccctgcgggcccacaatgaagacctgaccacccgggagacctgcaaggccggcttctctgaagatgactacacagccctgatcagccagaacatcctggagggggagaagctgctgcaggtgaagttcagcagctgtgtgggcaccaagggcacccagtatgagaccaacagcatggacttcaaggtgggcgcagatggcaccgtgtttgccacccgggagctgcaggtgcccagcgagcaggtggccttcaccgtgacagcctgggacagccagacagctgagaagtgggatgctgtggtgcggctgctggtggcccagaccagcagcccccacagcggccacaagccccagaagggcaagaaggtggtggccctggaccccagccccccacccaaggacaccctgctgccctggccccagcaccagaatgccaacggcctgcggcggaggaagagggactgggtgatcccccccatcaacgtgcctgagaacagccggggccccttcccccagcagctggtgcgcatccgcagtgacaaggacaatgacatccccatccgctacagcatcaccggggtgggcgctgaccagccccccatggaggtgttcagcattgacagcatgagcggccgcatgtatgtgacccggcccatggaccgggaggagcacgccagctaccacctgcgggcccatgctgtggacatgaatggaaacaaggtggagaaccccatcgacctgtacatctacgtgattgacatgaatgacaacagacctgagttcatcaaccaggtgtacaatggatctgtggatgagggcagcaagccaggcacctacgtgatgacagtgacagccaatgatgctgatgacagcaccacagccaacggcatggtgcgctaccgcatcgtgacccagaccccccagagccccagccagaacatgttcaccatcaacagcgagactggagacatcgtgacagtggccgccggcctggaccgggagaaggtgcagcagtacaccgtcatcgtgcaggccacagacatggagggcaacctgaactacggcctgagcaacacagccacagccatcatcaccgtgacagatgtgaatgacaaccccccagagttcaccgccagcacctttgctggggaggtgcctgaaaatagagtggagaccgtggtggccaacctgactgtgatggaccgggaccagccccacagccccaactggaatgctgtgtaccgcatcatcagcggggaccccagcggccacttctctgtgaggacagatcctgtgaccaatgaaggcatggtgacagtggtgaaggctgtggactatgagctgaacagagccttcatgctgactgtgatggtgagcaaccaggcccccctggccagcggcatccagatgtccttccagagcacagctggggtgaccatcagcatcatggacatcaatgaggccccctacttccccagcaaccacaagctgatccggctggaggagggcgtgcccccaggcaccgtgctgaccaccttctctgctgtggaccctgaccgcttcatgcagcaggccgtgcgctacagcaagctgagtgaccctgcctcctggctgcacatcaatgccaccaacggccagatcaccacagctgctgtgctggaccgggagagcctgtacaccaagaacaacgtgtatgaggccaccttcctggccgctgacaatggcatccccccagccagcggcaccggcaccctgcagatctacctgattgacatcaatgacaatgcccctgagctgctgcccaaggaggcccagatctgtgagaagcccaacctgaatgccatcaacatcacagctgctgatgctgatgtggaccccaacatcggcccctacgtgtttgagctgccctttgtgcctgctgctgtgaggaagaactggaccatcacccggctgaatggagactatgcccagctgagcctgcgcatcctgtacctggaggccggcatgtatgatgtgcccatcatcgtgacagattctggcaacccccccctgagcaacaccagcatcatcaaggtgaaggtgtgcccctgtgatgacaacggggactgcaccaccatcggggctgtggccgccgccggcctgggcaccggggccatcgtggccatcctgatctgcatcctgatcctgctgaccatggtgctgctgtttgtgatgtggatgaagaggcgggagaaggagcggcacaccaagcagctgctgattgatcctgaagatgatgtgcgggacaacatcctgaagtatgatgaggagggcggcggggaggaggaccaggactatgacctgagccagctgcagcagcctgaggccatgggccacgtgcccagcaaggcccctggggtgagaagagtggatgagaggcctgtgggcgctgagccccagtaccccatccggcccatggtgccccaccctggggacatcggggacttcatcaatgaaggcctgcgggctgctgacaatgaccccacagccccaccctatgacagcctgctggtgtttgattatgagggcagcggcagcacagctggctctgtgagcagcctgaacagcagcagcagcggggaccaggactatgactacctgaatgactggggcccccgcttcaagaagctggccgacatgtatggaggaggagaggaggactag

SEQ ID NO: 145666 - DNA, 2475 bp, Artificial Sequence
  Description of Artificial Sequence: Synthetic coding sequence
atgcccaagagcacaggcatgctgcatggaggaagagaaaatgccggcgtgaagttcagcagctgtgtgggcaccaagggcacccagtatgagaccagcagcccccacagcggccacaagccccagaagggcaagaaggtggtggccctggaccccagccccccacccaaggacaccctgctgccctggccccagcaccagaatgccaacggcctgcggcggaggaagagggactgggtgatcccccccatcaacgtgcctgagaacagccggggccccttcccccagcagctggtgcgcatccgcagtgacaaggacaatgacatccccatccgctacagcatcaccggggtgggcgctgaccagccccccatggaggtgttcagcattgacagcatgagcggccgcatgtatgtgacccggcccatggaccgggaggagcacgccagctaccacctgcgggcccatgctgtggacatgaatggaaacaaggtggagaaccccatcgacctgtacatctacgtgattgacatgaatgacaacagacctgagttcatcaaccaggtgtacaatggatctgtggatgagggcagcaagccaggcacctacgtgatgacagtgacagccaatgatgctgatgacagcaccacagccaacggcatggtgcgctaccgcatcgtgacccagaccccccagagccccagccagaacatgttcaccatcaacagcgagactggagacatcgtgacagtggccgccggcctggaccgggagaaggtgcagcagtacaccgtcatcgtgcaggccacagacatggagggcaacctgaactacggcctgagcaacacagccacagccatcatcaccgtgacagatgtgaatgacaaccccccagagttcaccgccagcacctttgctggggaggtgcctgaaaatagagtggagaccgtggtggccaacctgactgtgatggaccgggaccagccccacagccccaactggaatgctgtgtaccgcatcatcagcggggaccccagcggccacttctctgtgaggacagatcctgtgaccaatgaaggcatggtgacagtggtgaaggctgtggactatgagctgaacagagccttcatgctgactgtgatggtgagcaaccaggcccccctggccagcggcatccagatgtccttccagagcacagctggggtgaccatcagcatcatggacatcaatgaggccccctacttccccagcaaccacaagctgatccggctggaggagggcgtgcccccaggcaccgtgctgaccaccttctctgctgtggaccctgaccgcttcatgcagcaggccgtgcgctacagcaagctgagtgaccctgcctcctggctgcacatcaatgccaccaacggccagatcaccacagctgctgtgctggaccgggagagcctgtacaccaagaacaacgtgtatgaggccaccttcctggccgctgacaatggcatccccccagccagcggcaccggcaccctgcagatctacctgattgacatcaatgacaatgcccctgagctgctgcccaaggaggcccagatctgtgagaagcccaacctgaatgccatcaacatcacagctgctgatgctgatgtggaccccaacatcggcccctacgtgtttgagctgccctttgtgcctgctgctgtgaggaagaactggaccatcacccggctgaatggagactatgcccagctgagcctgcgcatcctgtacctggaggccggcatgtatgatgtgcccatcatcgtgacagattctggcaacccccccctgagcaacaccagcatcatcaaggtgaaggtgtgcccctgtgatgacaacggggactgcaccaccatcggggctgtggccgccgccggcctgggcaccggggccatcgtggccatcctgatctgcatcctgatcctgctgaccatggtgctgctgtttgtgatgtggatgaagaggcgggagaaggagcggcacaccaagcagctgctgattgatcctgaagatgatgtgcgggacaacatcctgaagtatgatgaggagggcggcggggaggaggaccaggactatgacctgagccagctgcagcagcctgaggccatgggccacgtgcccagcaaggcccctggggtgagaagagtggatgagaggcctgtgggcgctgagccccagtaccccatccggcccatggtgccccaccctggggacatcggggacttcatcaatgaaggcctgcgggctgctgacaatgaccccacagccccaccctatgacagcctgctggtgtttgattatgagggcagcggcagcacagctggctctgtgagcagcctgaacagcagcagcagcggggaccaggactatgactacctgaatgactggggcccccgcttcaagaagctggccgacatgtatggaggaggagaggaggactag

SEQ ID NO: 145667 - DNA, 2529 bp, Artificial Sequence
  Description of Artificial Sequence: Synthetic coding sequence
atggacttcaaggtgggcgcagatggcaccgtgtttgccacccgggagctgcaggtgcccagcgagcaggtggccttcaccgtgacagcctgggacagccagacagctgagaagtgggatgctgtggtgcggctgctggtggcccagaccagcagcccccacagcggccacaagccccagaagggcaagaaggtggtggccctggaccccagccccccacccaaggacaccctgctgccctggccccagcaccagaatgccaacggcctgcggcggaggaagagggactgggtgatcccccccatcaacgtgcctgagaacagccggggccccttcccccagcagctggtgcgcatccgcagtgacaaggacaatgacatccccatccgctacagcatcaccggggtgggcgctgaccagccccccatggaggtgttcagcattgacagcatgagcggccgcatgtatgtgacccggcccatggaccgggaggagcacgccagctaccacctgcgggcccatgctgtggacatgaatggaaacaaggtggagaaccccatcgacctgtacatctacgtgattgacatgaatgacaacagacctgagttcatcaaccaggtgtacaatggatctgtggatgagggcagcaagccaggcacctacgtgatgacagtgacagccaatgatgctgatgacagcaccacagccaacggcatggtgcgctaccgcatcgtgacccagaccccccagagccccagccagaacatgttcaccatcaacagcgagactggagacatcgtgacagtggccgccggcctggaccgggagaaggtgcagcagtacaccgtcatcgtgcaggccacagacatggagggcaacctgaactacggcctgagcaacacagccacagccatcatcaccgtgacagatgtgaatgacaaccccccagagttcaccgccagcacctttgctggggaggtgcctgaaaatagagtggagaccgtggtggccaacctgactgtgatggaccgggaccagccccacagccccaactggaatgctgtgtaccgcatcatcagcggggaccccagcggccacttctctgtgaggacagatcctgtgaccaatgaaggcatggtgacagtggtgaaggctgtggactatgagctgaacagagccttcatgctgactgtgatggtgagcaaccaggcccccctggccagcggcatccagatgtccttccagagcacagctggggtgaccatcagcatcatggacatcaatgaggccccctacttccccagcaaccacaagctgatccggctggaggagggcgtgcccccaggcaccgtgctgaccaccttctctgctgtggaccctgaccgcttcatgcagcaggccgtgcgctacagcaagctgagtgaccctgcctcctggctgcacatcaatgccaccaacggccagatcaccacagctgctgtgctggaccgggagagcctgtacaccaagaacaacgtgtatgaggccaccttcctggccgctgacaatggcatccccccagccagcggcaccggcaccctgcagatctacctgattgacatcaatgacaatgcccctgagctgctgcccaaggaggcccagatctgtgagaagcccaacctgaatgccatcaacatcacagctgctgatgctgatgtggaccccaacatcggcccctacgtgtttgagctgccctttgtgcctgctgctgtgaggaagaactggaccatcacccggctgaatggagactatgcccagctgagcctgcgcatcctgtacctggaggccggcatgtatgatgtgcccatcatcgtgacagattctggcaacccccccctgagcaacaccagcatcatcaaggtgaaggtgtgcccctgtgatgacaacggggactgcaccaccatcggggctgtggccgccgccggcctgggcaccggggccatcgtggccatcctgatctgcatcctgatcctgctgaccatggtgctgctgtttgtgatgtggatgaagaggcgggagaaggagcggcacaccaagcagctgctgattgatcctgaagatgatgtgcgggacaacatcctgaagtatgatgaggagggcggcggggaggaggaccaggactatgacctgagccagctgcagcagcctgaggccatgggccacgtgcccagcaaggcccctggggtgagaagagtggatgagaggcctgtgggcgctgagccccagtaccccatccggcccatggtgccccaccctggggacatcggggacttcatcaatgaaggcctgcgggctgctgacaatgaccccacagccccaccctatgacagcctgctggtgtttgattatgagggcagcggcagcacagctggctctgtgagcagcctgaacagcagcagcagcggggaccaggactatgactacctgaatgactggggcccccgcttcaagaagctggccgacatgtatggaggaggagaggaggactag

SEQ ID NO: 145668 - DNA, 2358 bp, Artificial Sequence
  Description of Artificial Sequence: Synthetic coding sequence
atgaagctgggcaaggtggagttctgccacttcctgcagctgattgccctcttcctgtgcttcagcggcatgagccaggccgagctgagccgcagccgcagcaagccctacttccagagcggccgcagcaggaccaagaggtcctgggtgtggaaccagttctttgtgctggaggagtacatgggcagtgaccccctgtatgtgggcaagctgcacagtgatgtggacaagggagatggcagcatcaagtacatcctgtctggagagggcgccagcagcatcttcatcattgatgaaaatactggagacatccacgccaccaagaggctggaccgggaggagcaggcctactacaccctgcgggcccaggccctggaccggctgaccaacaagcctgtggagcctgagagcgagtttgtgatcaagatccaggacatcaatgacaatgagcccaagttcctggatggcccctacacagctggggtgcctgagatgagccctgtgggcacctctgtggtgcaggtgacagccacagatgctgatgaccccacctacggcaacagcgcccgggtggtgtacagcatcctgcagggccagccctacttctctgtggagcccaagacaggagtcatcaagacagccctgcccaacatggaccgggaggccaaggaccagtacctgctggtgatccaggccaaggacatggtgggccagaatggaggcctgagcggcaccacctctgtgacagtgaccctgacagatgtgaatgacaaccccccacgcttcccccggcgcagctaccagtacaacgtgcctgagagcctgcctgtggcctctgtggtggcccgcatcaaggctgctgatgctgacattggagccaatgctgagatggagtacaagatcgtggatggagatggcctgggcatcttcaagatctctgtggacaaggagacccaggagggcatcatcaccatccagaaggagctggactttgaggccaagaccagctacaccctgagaattgaagctgccaacaaggatgctgacccccgcttcctgagcctgggccccttcagtgacaccaccaccgtgaagatcatcgtggaggatgtggatgagccccctgtgttcagcagccccctgtaccccatggaggtgtctgaggccacccaggtgggcaacatcatcggcaccgtggccgcccatgaccctgacagcagcaacagccctgtgcgctacagcattgacaggaacacagacctggagcgctacttcaacattgatgccaacagcggggtcatcaccacagccaagagcctggaccgggagaccaatgccatccacaacatcaccgtgctggccatggagagccagaaccccagccaggtgggccggggctacgtggccatcaccatcctggacatcaatgacaatgcccctgagtttgccatggactatgagaccaccgtgtgtgaaaatgcccagcccggccaggtgatccagaagatctctgctgtggacaaggatgagcccagcaatggccaccagttctacttcagcctgaccacagatgccaccaacaaccacaacttcagcctgaaggacaacaaggacaacacagccagcatcctgaccaggagaaatggcttccggcggcaggagcagagcgtgtactacctgcccatcttcatcgtggacagcggcagccccagcctgagcagcaccaacaccctgaccatccgggtgtgtgactgtgatgctgatggagtggcccagacctgcaatgctgaggcctacgtgctgcctgctggcctgagcactggagccctgattgccatcctggcctgtgtgctgaccctgctggtgctgatcctgctgattgtgaccatgagaagaaggaagaaggagcccctcatctttgatgaggagcgggacatccgggagaacatcgtgcgctatgatgatgaaggaggaggagaggaggacacagaggcctttgacatggccgccctgaggaacctgaatgtcatccgggacaccaagaccaggagagatgtgaccccagagatccagttcctgagcaggcctgccttcaagagcatcccagacaacgtcatcttccgggagttcatctgggagcggctgaaggaggctgatgtggaccccggggccccaccctatgacagcctgcagacctacgcctttgagggcaatggatctgtggccgagagcctgagcagcctggacagcatcagcagcaacagcgaccagaactatgactacctgagtgactggggcccccgcttcaagaggctggccgacatgtatggcaccggccaggagagcctgtacagctag

SEQ ID NO: 145669 - DNA, 2358 bp, Artificial Sequence; identical to SEQ ID NO: 145668
  Description of Artificial Sequence: Synthetic coding sequence

SEQ ID NO: 145670 - DNA, 2358 bp, Artificial Sequence; identical to SEQ ID NO: 145668
  Description of Artificial Sequence: Synthetic coding sequence

SEQ ID NO: 145671 - DNA, 1893 bp, Artificial Sequence
  Description of Artificial Sequence: Synthetic coding sequence
atgaagctgggcaaggtggagttctgccacttcctgcagctgattgccctcttcctgtgcttcagcggcatgagccaggccgagctgagccgcagccgcagcaagccctacttccagagcggccgcagcaggaccaagaggtcctgggtgtggaaccagttctttgtgctggaggagtacatgggcagtgaccccctgtatgtgggcaagctgcacagtgatgtggacaagggagatggcagcatcaagtacatcctgtctggagagggcgccagcagcatcttcatcattgatgaaaatactggagacatccacgccaccaagaggctggaccgggaggagcaggcctactacaccctgcgggcccaggccctggaccggctgaccaacaagcctgtggagcctgagagcgagtttgtgatcaagatccaggacatcaatgacaatgagcccaagttcctggatggcccctacacagctggggtgcctgagatgagccctgtgggcacctctgtggtgcaggtgacagccacagatgctgatgaccccacctacggcaacagcgcccgggtggtgtacagcatcctgcagggccagccctacttctctgtggagcccaagacaggagtcatcaagacagccctgcccaacatggaccgggaggccaaggaccagtacctgctggtgatccaggccaaggacatggtgggccagaatggaggcctgagcggcaccacctctgtgacagtgaccctgacagatgtgaatgacaaccccccacgcttcccccggcgcagctaccagtacaacgtgcctgagagcctgcctgtggcctctgtggtggcccgcatcaaggctgctgatgctgacattggagccaatgctgagatggagtacaagatcgtggatggagatggcctgggcatcttcaagatctctgtggacaaggagacccaggagggcatcatcaccatccagaaggagctggactttgaggccaagaccagctacaccctgagaattgaagctgccaacaaggatgctgacccccgcttcctgagcctgggccccttcagtgacaccaccaccgtgaagatcatcgtggaggatgtggatgagccccctgtgttcagcagccccctgtaccccatggaggtgtctgaggccacccaggtgggcaacatcatcggcaccgtggccgcccatgaccctgacagcagcaacagccctgtgcgctacagcattgacaggaacacagacctggagcgctacttcaacattgatgccaacagcggggtcatcaccacagccaagagcctggaccgggagaccaatgccatccacaacatcaccgtgctggccatggagagccagaaccccagccaggtgggccggggctacgtggccatcaccatcctggacatcaatgacaatgcccctgagtttgccatggactatgagaccaccgtgtgtgaaaatgcccagcccggccaggtgatccagaagatctctgctgtggacaaggatgagcccagcaatggccaccagttctacttcagcctgaccacagatgccaccaacaaccacaacttcagcctgaaggacaacaaggacaacacagccagcatcctgaccaggagaaatggcttccggcggcaggagcagagcgtgtactacctgcccatcttcatcgtggacagcggcagccccagcctgagcagcaccaacaccctgaccatccgggtgtgtgactgtgatgctgatggagtggcccagacctgcaatgctgaggcctacgtgctgcctgctggcctgagcactggagccctgattgccatcctggcctgtgtgctgaccctgctgggccgctactgcttccagggcctgctgtag

SEQ ID NO: 145672 - DNA, 2400 bp, Artificial Sequence
  Description of Artificial Sequence: Synthetic coding sequence
atgcctgagcggctggccgagatgctgctggacctgtggacccccctcatcatcctgtggatcaccctgcccccctgcatctacatggcccccatgaaccagagccaggtgctgatgagcggcagccccctggagctgaacagcctgggggaggagcagaggatcctgaacagaagcaagaggggctgggtgtggaaccagatgtttgtgctggaggagttcagcggccctgagcccatcctggtgggccgcctgcacacagacctggaccccggcagcaagaagatcaagtacatcctgtctggagatggagctggcaccatcttccagatcaatgatgtgactggagacatccacgccatcaagaggctggaccgggaggagaaggccgagtacaccctgacagcccaggccgtggactgggagaccagcaagcccctggagcccccatctgagttcatcatcaaggtgcaggacatcaatgacaatgcccctgagttcctgaatggcccctaccacgccaccgtgcctgagatgagcatcctgggcacctctgtgaccaacgtgacagccacagatgctgatgatcctgtgtatggcaacagcgccaagctggtgtacagcatcctggagggccagccctacttcagcattgagcctgagacagccatcatcaagacagccctgcccaacatggaccgggaggccaaggaggagtacctggtggtgatccaggccaaggacatgggcggccacagcggcggcctgagcggcaccaccaccctgactgtgaccctgacagatgtgaatgacaacccccccaagtttgcccagagcctgtaccacttctctgtgcctgaagatgtggtgctgggcacagccatcggccgggtgaaggccaatgaccaggacattggagaaaatgcccagagcagctatgacatcattgatggagatggaacagccctgtttgagatcaccagtgatgcccaggcccaggacggcatcatccggctgaggaagcccctggactttgagaccaagaagagctacaccctgaaggtggaggccgccaacgtgcacatcgacccccgcttcagcggccggggccccttcaaggacacagccaccgtgaagatcgtggtggaggatgctgatgagccccctgtgttcagcagccccacctacctgctggaggtgcatgaaaatgctgccctgaacagcgtcatcggccaggtgacagcccgggaccctgacatcaccagcagccccatccgcttcagcattgacagacacacagacctggagcggcagttcaacatcaatgctgatgatggcaagatcaccctggccacccccctggaccgggagctgtctgtgtggcacaacatcaccatcatcgccacagagatccggaaccacagccagatcagccgggtgcctgtggccatcaaggtgctggatgtgaatgacaatgcccctgagtttgcctctgaatatgaggccttcctgtgtgaaaatggcaagccaggccaggtgatccagacagtgtctgccatggacaaggatgaccccaagaatggccactacttcctgtacagcctgctgcctgagatggtgaacaaccccaacttcaccatcaagaagaatgaagacaacagcctgagcatcctggccaagcacaacggcttcaaccggcagaagcaggaggtgtacctgctgcccatcatcatcagtgacagcggcaacccccccctgagcagcaccagcaccctgaccatccgggtgtgtggctgcagcaatgatggagtggtgcagagctgcaatgtggaggcctacgtgctgcccatcggcctgtccatgggcgccctgattgccatcctggcctgcatcatcctgctgctggtgattgtggtgctgtttgtgaccctgcggcggcacaagaatgagcccctcatcatcaaggatgatgaagatgtgcgggagaacatcatccgctatgatgatgaaggaggaggagaggaggacacagaggcctttgacatcgccaccctgcagaacccagatggcatcaatggcttcctgcccaggaaggacatcaagccagacctgcagttcatgccccggcagggcctggcccctgtgcccaatggagtggatgtggatgagttcatcaacgtgcggctgcacgaggccgacaatgaccccacagccccaccctatgacagcatccagatctacggctatgagggccggggctctgtggccggcagcctgagcagcctggagagcaccaccagtgacagcgaccagaactttgactacctgagtgactggggcccccgcttcaagaggctgggggagctgtacagcgtgggggagagtgacaaggagacctag

SEQ ID NO: 145673 - DNA, 2400 bp, Artificial Sequence; identical to SEQ ID NO: 145672
  Description of Artificial Sequence: Synthetic coding sequence

SEQ ID NO: 145674 - DNA, 795 bp, Artificial Sequence
  Description of Artificial Sequence: Synthetic coding sequence
atgaccaagttcagcagcttcagcctcttcttcctgattgtgggcgcctacatgacccacgtgtgcttcaacatggagatcatcggcggcaaggaggtgagcccccacagccggcccttcatggccagcatccagtatggaggccaccacgtgtgtggcggcgtgctgattgacccccagtgggtgctgacagctgcccactgccagtaccgcttcaccaagggccagagccccaccgtggtgctgggcgcccacagcctgagcaagaatgaggccagcaagcagaccctggagatcaagaagttcatccccttcagccgggtgaccagtgacccccagagcaatgacatcatgctggtgaagctgcagacagctgccaagctgaacaagcacgtgaagatgctgcacatccgcagcaagaccagcctgcggagcggcaccaagtgcaaggtgacaggctggggcgccacagatcctgacagcctgcggcccagcgacaccctgcgggaggtgacagtgacagtgctgagcaggaagctgtgcaacagccagagctactacaacggggaccccttcatcaccaaggacatggtgtgtgctggagatgccaagggccagaaggacagctgcaagggggacagcggcggccccctcatctgcaagggcgtcttccacgccatcgtgtctgggggccatgaatgtggggtggccaccaagccaggcatctacaccctgctgaccaagaagtaccagacctggatcaagagcaacctggtgcccccccacaccaactag

SEQ ID NO: 145675 - DNA, 246 bp, Artificial Sequence
  Description of Artificial Sequence: Synthetic coding sequence
atgaggacctaccactacatccccctcttcatctggacctacatgttccacacagtggacaccatcctgctgcaggagaagcccaacagctacctgagcagcaagaagattgctggcctgaccaaggatgatggcaagatgctgcggaggaccaagaggggctggatgtggaaccagttcttcctgctggaggagtacacaggaacagacacccagtatgtgggcaagctgcacacagaccagtag

SEQ ID NO: 145676 - DNA, 399 bp, Artificial Sequence
  Description of Artificial Sequence: Synthetic coding sequence
atgaggacctaccactacatccccctcttcatctggacctacatgttccacacagtggacaccatcctgctgcaggagaagcccaacagctacctgagcagcaagaagattgctggcctgaccaaggatgatggcaagatgctgcggaggaccaagaggggctggatgtggaaccagttcttcctgctggaggagtacacaggaacagacacccagtatgtgggcaagctgcacacagaccaggacaagggagatggcaacctgaagtacatcctgactggagatggagctggcagcctgtttgtgattgatgaaaatactggagacatccacgccgccaagaagctggaccgggaggagaagagcctgtacatcctgcgggccaaggccattgattag

SEQ ID NO: 145677 - DNA, 9045 bp, Artificial Sequence
  Description of Artificial Sequence: Synthetic coding sequence
atggcccctcctcctcctcctgtgctgcctgtgctgctgctgctggccgctgctgctgccctgcctgccatgggcctgcgggctgctgcctgggagccccgggtgcctgggggcacccgggcctttgccctgcggcccggctgcacctatgctgtgggcgccgcctgcaccccccgggccccccgggagctgctggatgtgggcagagatggccgcctggccggcagaagaagagtgtctggggccggccggcccctgcccctgcaggtgcggctggtggcccggagcgcccccacagccctgagccggcggctgcgggcccggacccacctgcccggctgtggggcccgggcccggctgtgtggcactggagcccggctgtgtggggccctgtgcttccctgtgcctgggggctgtgccgccgcccagcacagcgccctggccgcccccaccaccctgcctgcctgccgctgccccccccggccccggccccgctgccccggccggcccatctgcctgcccccaggcggctctgtgcggctgcggctgctgtgtgccctgcggcgggctgctggagctgtgcgggtgggcctggccctggaggccgccacagctggcaccccatctgccagccccagccccagcccccccctgccccccaacctgcctgaggcccgggccggccctgcccggcgggcccggcggggcaccagcggccggggcagcctgaagttccccatgcccaactaccaggtggccctgtttgaaaatgaacctgctggcaccctcatcctgcagctgcacgcccactacaccattgaaggagaggaggagcgggtgtcctactacatggagggcctgtttgatgagaggagccggggctacttcagaattgacagcgccaccggggctgtgtccacagattctgtgctggaccgggagaccaaggagacccacgtgctgcgggtgaaggctgtggactacagcaccccacccaggtctgccaccacctacatcaccgtgctggtgaaggacaccaatgaccacagccctgtgtttgagcagagcgagtaccgggagcgggtgcgggagaacctggaggtgggctatgaggtgctgaccatccgggccagtgaccgggacagccccatcaatgccaacctgcgctacagagtgctgggcggggcctgggatgtgttccagctgaatgaaagcagcggcgtggtgtccaccagggctgtgctggaccgggaggaggccgctgagtaccagctgctggtggaggccaatgaccagggcaggaaccctggccccctgagcgccacagccaccgtgtacatcgaggtggaggatgaaaatgacaactacccccagttcagcgagcagaactacgtggtgcaggtgcctgaagatgtgggcctgaacacagctgtgctgcgggtgcaggccacagaccgggaccagggccagaatgctgccatccactacagcatcctgtctggaaatgtggccggccagttctacctgcacagcctgagcggcatcctggatgtgatcaaccccctggactttgaagatgtgcagaagtacagcctgagcatcaaggcccaggacggcggccggcccccactcatcaacagcagcggcgtggtgtctgtgcaggtgctggatgtgaatgacaatgagcccatctttgtgagcagccccttccaggccaccgtgctggagaatgtgcccctgggctaccctgtggtgcacatccaggccgtggatgctgacagcggggagaatgcccggctgcactaccgcctggtggacacagccagcaccttcctgggcggcggcagcgctggccccaagaacccagcccccaccccagacttccccttccagatccacaacagcagcggctggatcaccgtgtgtgccgagctggaccgggaggaggtggagcactacagctttggagtggaggccgtggaccacggcagcccccccatgagcagcagcacctctgtgtccatcaccgtgctggatgtgaatgacaatgaccctgtgttcacccagcccacctatgagctgcggctgaatgaagatgctgctgtgggcagctctgtgctgaccctgcaggcccgggacagagatgccaacagcgtcatcacctaccagctgactggaggcaacaccaggaacagatttgccctgagcagccagaggggcggcggcctcatcaccctggccctgcccctggactacaagcaggagcagcagtatgtgctggccgtgacagccagtgatggcaccaggagccacacagcccacgtgctgatcaacgtgacagatgccaacacccacaggcctgtgttccagagcagccactacacagtgtctgtgtctgaggacaggcctgtgggcaccagcatcgccaccctgagcgccaatgatgaggacaccggggagaatgcccgcatcacctacgtgatccaggaccctgtgccccagttcagaattgatcctgattctggcaccatgtacaccatgatggagctggactatgagaaccaggtggcctacaccctgaccatcatggcccaggacaatggcatcccccagaagagtgacaccaccaccctggagatcctgatcctggatgccaatgacaatgccccccagttcctgtgggacttctaccagggcagcatctttgaagatgccccacccagcaccagcatcctgcaggtgtctgccacagaccgggacagcggccccaacggccgcctgctgtacaccttccagggcggagatgatggagatggagacttctacatcgagcccaccagcggggtcatccgcacccagaggcggctggacagagaaaatgtggccgtgtacaacctgtgggccctggccgtggaccggggcagccccacccccctgagcgcctctgtggagatccaggtgaccatcctggacatcaatgacaatgcccccatgtttgagaaggatgagctggagctgtttgtggaggagaacaaccctgtgggctctgtggtggccaagatccgggccaatgaccctgatgagggccccaatgcccagatcatgtaccagatcgtggagggggacatgaggcacttcttccagctggacctgctgaatggagacctgcgggccatggtggagctggactttgaggtgagaagagaatatgtgctggtggtgcaggccaccagcgcccccctggtgtcccgggccaccgtgcacatcctgctggtggaccagaatgacaacccccctgtgctgcctgacttccagatcctcttcaacaactacgtgaccaacaagagcaacagcttccccactggagtcatcggctgcatcccagcccatgaccctgatgtgtctgacagcctgaactacacctttgtgcagggcaatgagctgcggctgctgctgctggaccctgccactggagagctgcagctgagccgggacctggacaacaaccggcccctggaggccctgatggaggtgtctgtgtctgatggcatccacagcgtgacagccttctgcaccctgcgggtgaccatcatcacagatgacatgctgaccaacagcatcaccgtgcggctggagaacatgagccaggagaagttcctgagccccctgctggccctgtttgtggagggcgtggccgctgtgctgagcaccaccaaggatgatgtgtttgtgttcaacgtgcagaatgacacagatgtgagcagcaacatcctgaatgtgaccttcagcgccctgctgcctggaggagtgcggggccagttcttccccagcgaggacctgcaggagcagatctacctgaacagaaccctgctgaccaccatcagcacccagagggtgctgccctttgatgacaacatctgcctgcgggagccctgtgagaactacatgaagtgtgtgtctgtgctgcgctttgacagcagcgcccccttcctgagcagcaccaccgtgctcttccggcccatccaccccatcaatggcctgcgctgccgctgccccccaggcttcaccggggactactgtgaaacagaaattgacctgtgctacagcgacccctgtggggccaacggccgctgccgcagccgggagggcggctacacctgtgagtgctttgaggacttcaccggggagcactgtgaggtggatgcccggagcggccgctgtgccaatggagtgtgcaagaatggaggcacctgtgtgaacctgctgattggaggcttccactgtgtgtgccccccaggagaatatgagcggccctactgtgaggtgaccaccaggagcttccccccccagagctttgtgaccttccggggcctgcggcagcgcttccacttcaccatcagcctgacctttgccacccaggagagaaatggcctgctgctgtacaacggccgcttcaatgagaagcatgacttcatcgccctggagatcgtggatgagcaggtgcagctgaccttctctgctggggagaccaccaccaccgtggcccccaaggtgcccagcggcgtgtctgatggccgctggcacagcgtgcaggtgcagtactacaacaagcccaacatcggccacctgggcctgccccacggccccagcggggagaagatggctgtggtgacagtggatgactgtgacaccaccatggctgtgcgctttgggaaggacatcggcaactacagctgtgccgcccagggcacccagacaggcagcaagaagagcctggacctgaccggccccctgctgctgggcggcgtgcccaacctgcctgaggacttccctgtgcacaaccggcagtttgtgggctgcatgaggaacctgtctgtggatggcaagaatgtggacatggccggcttcatcgccaacaacggcacccgggagggctgtgccgcccggaggaacttctgtgatggccgccgctgccagaatggaggcacctgtgtgaaccgctggaacatgtacctgtgtgagtgccccctgcgctttggaggcaagaactgtgagcaggccatgccccacccccagctgttctctggagagagcgtggtgtcctggagcgacctgaacatcatcatctctgtgccctggtacctgggcctgatgttccgcaccaggaaggaggacagcgtgctgatggaggccaccagcggcggccccaccagcttccggctgcagatcctgaacaactacctgcagtttgaggtgagccacggccccagtgatgtggagagcgtgatgctgagcggcctgcgggtgacagatggagagtggcaccacctgctgattgagctgaagaatgtgaaggaggacagcgagatgaagcacctggtgaccatgaccctggactatggcatggaccagaacaaggctgacattggaggcatgctgcccggcctgactgtgcgctctgtggtggtgggcggggccagcgaggacaaggtgtctgtgcggcggggcttccggggctgcatgcagggcgtgaggatgggcggcacccccaccaacgtggccaccctgaacatgaacaatgccctgaaggtgcgggtgaaggatggctgtgatgtggatgacccctgcaccagcagcccctgcccccccaacagccgctgccatgatgcctgggaggactacagctgtgtgtgtgacaagggctacctgggcatcaactgtgtggatgcctgccacctgaacccctgtgagaacatgggcgcctgtgtgcgcagccctggcagcccccagggctacgtgtgtgaatgtggccccagccactacggcccctactgtgagaacaagctggacctgccctgcccccggggctggtggggcaaccctgtgtgtggcccctgccactgtgctgtgtccaagggctttgatcctgactgcaacaagaccaacggccagtgccagtgcaaggagaactactacaagctgctggcccaggacacctgcctgccctgtgactgcttcccccacggcagccacagcaggacctgtgacatggccaccggccagtgtgcctgcaagccaggagtgattggccggcagtgcaacagatgtgacaacccctttgctgaggtgaccaccctgggctgtgaggtgatctacaacggctgccccaaggcctttgaagctggcatctggtggccccagaccaagtttggccagcctgctgctgtgccctgccccaagggctctgtgggcaatgctgtgcgccactgcagcggggagaagggctggctgcccccagagctgttcaactgcaccaccatcagctttgtggacctgcgggccatgaatgagaagctgagcagaaatgagacccaggtggatggagcccgggccctgcagctggtgcgggccctgcggagcgccacccagcacacaggcaccctgtttggaaatgatgtgaggacagcctaccagctgctgggccacgtgctgcagcacgagagctggcagcagggctttgacctggccgccacccaggatgctgacttccatgaagatgtgatccacagcggcagcgccctgctggccccagccaccagggctgcctgggagcagatccagaggtctgagggcggcacagcccagctgctgcggcggctggagggctacttcagcaatgtggccagaaatgtgcggaggacctacctgcggccctttgtgattgtgacagccaacatgatcctggccgtggacatctttgacaagttcaacttcaccggggcccgggtgcccaggtttgacaccatccacgaggagttcccccgggagctggagagctctgtgtccttccctgctgacttcttccggcccccagaggagaaggagggccccctgctgcggcctgctggccgccgcaccaccccccagaccaccaggcctggccctggaacagagcgggaggcccccatcagcagaagaagaagacacccagatgatgctggccagtttgctgtggccctggtgatcatctaccgcaccctgggccagctgctgcctgagagatatgaccctgacagaagaagcctgcggctgccccaccggcccatcatcaacacccccatggtgtccaccctggtgtacagcgagggcgcccccctgccccggcccctggagaggcctgtgctggtggagtttgccctgctggaggtggaggagaggaccaagcctgtgtgtgtgttctggaaccacagcctggccgtgggcggcactggaggctggagcgcccggggctgtgagctgctgagcaggaacagaacccacgtggcctgccagtgcagccacacagccagctttgctgtgctgatggacatcagcagaagagaaaatggagaggtgctgcccctgaagatcgtgacctacgccgctgtgtccctgagcctggccgccctgctggtggcctttgtgctgctgagcctggtgaggatgctgcggagcaacctgcacagcatccacaagcacctggccgtggccctcttcctgagccagctggtgtttgtgattggcatcaaccagacagagaaccccttcctgtgcaccgtggtggccatcctgctgcactacatctacatgagcacctttgcctggaccctggtggagagcctgcacgtgtacaggatgctgacagaggtgaggaacatcgacaccggccccatgaggttctactacgtggtgggctggggcatcccagccatcgtgacaggcctggccgtgggcctggacccccagggctacggcaacccagacttctgctggctgagcctgcaggacaccctcatctggagctttgctggccccatcggggctgtgatcatcatcaacacagtgacctctgtgctgagcgccaaggtgtcctgccagaggaagcaccactactacggcaagaagggcatcgtgtccctgctgaggacagccttcctgctgctgctgctgatcagcgccacctggctgctgggcctgctggccgtgaacagagatgccctgtccttccactacctgtttgccatcttcagcggcctgcagggcccctttgtgctgctcttccactgtgtgctgaaccaggaggtgaggaagcacctgaagggcgtgctgggcggcaggaagctgcacctggaggacagcgccaccacccgggccaccctgctgaccaggagcctgaactgcaacaccacctttggagatggccctgacatgctgaggacagacctgggggagagcacagccagcctggacagcatcgtgagagatgagggcatccagaagctgggcgtgagcagcggcctggtgcggggcagccatggagagccagatgccagcctgatgcccaggagctgcaaggaccccccaggccatgacagcgacagcgacagcgagctgagcctggatgagcagagcagcagctatgccagcagccacagcagtgacagtgaagatgatggagtgggcgctgaggagaagtgggaccctgcccggggagctgtgcacagcacccccaagggagatgctgtggccaaccacgtgcctgctggctggccagaccagagcctggccgagagtgacagcgaggaccccagcggcaagccccggctgaaggtggagaccaaggtgtctgtggagctgcaccgggaggagcagggcagccacagaggagagtaccccccagaccaggagagcggcggggccgcccggctggccagcagccagcccccagagcagaggaagggcatcctgaagaacaaggtgacctaccccccacccctgaccctgacagagcagaccctgaagggccgcctgcgggagaagctggccgactgtgagcagagccccaccagcagcaggaccagcagcctgggcagcggcggccctgactgtgccatcaccgtgaagagccctggccgggagcccggccgggaccacctgaatggagtggccatgaatgtgaggactggaagtgcccaggctgatggcagtgacagcgagaagccctag

SEQ ID NO: 145678 - DNA, 4194 bp, Artificial Sequence
  Description of Artificial Sequence: Synthetic coding sequence
atggcccctcctcctcctcctgtgctgcctgtgctgctgctgctggccgctgctgctgccctgcctgccatgggcctgcgggctgctgcctgggagccccgggtgcctgggggcacccgggcctttgccctgcggcccggctgcacctatgctgtgggcgccgcctgcaccccccgggccccccgggagctgctggatgtgggcagagatggccgcctggccggcagaagaagagtgtctggggccggccggcccctgcccctgcaggtgcggctggtggcccggagcgcccccacagccctgagccggcggctgcgggcccggacccacctgcccggctgtggggcccgggcccggctgtgtggcactggagcccggctgtgtggggccctgtgcttccctgtgcctgggggctgtgccgccgcccagcacagcgccctggccgcccccaccaccctgcctgcctgccgctgccccccccggccccggccccgctgccccggccggcccatctgcctgcccccaggcggctctgtgcggctgcggctgctgtgtgccctgcggcgggctgctggagctgtgcgggtgggcctggccctggaggccgccacagctggcaccccatctgccagccccagccccagcccccccctgccccccaacctgcctgaggcccgggccggccctgcccggcgggcccggcggggcaccagcggccggggcagcctgaagttccccatgcccaactaccaggtggccctgtttgaaaatgaacctgctggcaccctcatcctgcagctgcacgcccactacaccattgaaggagaggaggagcgggtgtcctactacatggagggcctgtttgatgagaggagccggggctacttcagaattgacagcgccaccggggctgtgtccacagattctgtgctggaccgggagaccaaggagacccacgtgctgcgggtgaaggctgtggactacagcaccccacccaggtctgccaccacctacatcaccgtgctggtgaaggacaccaatgaccacagccctgtgtttgagcagagcgagtaccgggagcgggtgcgggagaacctggaggtgggctatgaggtgctgaccatccgggccagtgaccgggacagccccatcaatgccaacctgcgctacagagtgctgggcggggcctgggatgtgttccagctgaatgaaagcagcggcgtggtgtccaccagggctgtgctggaccgggaggaggccgctgagtaccagctgctggtggaggccaatgaccagggcaggaaccctggccccctgagcgccacagccaccgtgtacatcgaggtggaggatgaaaatgacaactacccccagttcagcgagcagaactacgtggtgcaggtgcctgaagatgtgggcctgaacacagctgtgctgcgggtgcaggccacagaccgggaccagggccagaatgctgccatccactacagcatcctgtctggaaatgtggccggccagttctacctgcacagcctgagcggcatcctggatgtgatcaaccccctggactttgaagatgtgcagaagtacagcctgagcatcaaggcccaggacggcggccggcccccactcatcaacagcagcggcgtggtgtctgtgcaggtgctggatgtgaatgacaatgagcccatctttgtgagcagccccttccaggccaccgtgctggagaatgtgcccctgggctaccctgtggtgcacatccaggccgtggatgctgacagcggggagaatgcccggctgcactaccgcctggtggacacagccagcaccttcctgggcggcggcagcgctggccccaagaacccagcccccaccccagacttccccttccagatccacaacagcagcggctggatcaccgtgtgtgccgagctggaccgggaggaggtggagcactacagctttggagtggaggccgtggaccacggcagcccccccatgagcagcagcacctctgtgtccatcaccgtgctggatgtgaatgacaatgaccctgtgttcacccagcccacctatgagctgcggctgaatgaagatgctgctgtgggcagctctgtgctgaccctgcaggcccgggacagagatgccaacagcgtcatcacctaccagctgactggaggcaacaccaggaacagatttgccctgagcagccagaggggcggcggcctcatcaccctggccctgcccctggactacaagcaggagcagcagtatgtgctggccgtgacagccagtgatggcaccaggagccacacagcccacgtgctgatcaacgtgacagatgccaacacccacaggcctgtgttccagagcagccactacacagtgtctgtgtctgaggacaggcctgtgggcaccagcatcgccaccctgagcgccaatgatgaggacaccggggagaatgcccgcatcacctacgtgatccaggaccctgtgccccagttcagaattgatcctgattctggcaccatgtacaccatgatggagctggactatgagaaccaggtggcctacaccctgaccatcatggcccaggacaatggcatcccccagaagagtgacaccaccaccctggagatcctgatcctggatgccaatgacaatgccccccagttcctgtgggacttctaccagggcagcatctttgaagatgccccacccagcaccagcatcctgcaggtgtctgccacagaccgggacagcggccccaacggccgcctgctgtacaccttccagggcggagatgatggagatggagacttctacatcgagcccaccagcggggtcatccgcacccagaggcggctggacagagaaaatgtggccgtgtacaacctgtgggccctggccgtggaccggggcagccccacccccctgagcgcctctgtggagatccaggtgaccatcctggacatcaatgacaatgcccccatgtttgagaaggatgagctggagctgtttgtggaggagaacaaccctgtgggctctgtggtggccaagatccgggccaatgaccctgatgagggccccaatgcccagatcatgtaccagatcgtggagggggacatgaggcacttcttccagctggacctgctgaatggagacctgcgggccatggtggagctggactttgaggtgagaagagaatatgtgctggtggtgcaggccaccagcgcccccctggtgtcccgggccaccgtgcacatcctgctggtggaccagaatgacaacccccctgtgctgcctgacttccagatcctcttcaacaactacgtgaccaacaagagcaacagcttccccactggagtcatcggctgcatcccagcccatgaccctgatgtgtctgacagcctgaactacacctttgtgcagggcaatgagctgcggctgctgctgctggaccctgccactggagagctgcagctgagccgggacctggacaacaaccggcccctggaggccctgatggaggtgtctgtgtctgatggcatccacagcgtgacagccttctgcaccctgcgggtgaccatcatcacagatgacatgctgaccaacagcatcaccgtgcggctggagaacatgagccaggagaagttcctgagccccctgctggccctgtttgtggagggcgtggccgctgtgctgagcaccaccaaggatgatgtgtttgtgttcaacgtgcagaatgacacagatgtgagcagcaacatcctgaatgtgaccttcagcgccctgctgcctggaggagtgcggggccagttcttccccagcgaggacctgcaggagcagatctacctgaacagaaccctgctgaccaccatcagcacccagagggtgctgccctttgatgacaacatctgcctgcgggagccctgtgagaactacatgaagtgtgtgtctgtgctgcgctttgacagcagcgcccccttcctgagcagcaccaccgtgctcttccggcccatccaccccatcaatggcctgcgctgccgctgccccccaggcttcaccggggactactgtgaaacagaaattgacctgtgctacagcgacccctgtggggccaacggccgctgccgcagccgggagggcggctacacctgtgagtgctttgaggacttcaccgctgtgtcctag

SEQ ID NO: 145679 - DNA, 2319 bp, Artificial Sequence
  Description of Artificial Sequence: Synthetic coding sequence
tgagacttccccttccagatccacaacagcagcggctggatcaccgtgtgtgccgagctggaccgggaggaggtggagcactacagctttggagtggaggccgtggaccacggcagcccccccatgagcagcagcacctctgtgtccatcaccgtgctggatgtgaatgacaatgaccccgtcttcacccagcccacctatgagctgcggctgaatgaagatgctgctgtgggcagctctgtgctgaccctgcaggcccgggacagagatgccaacagcgtcatcacctaccagctgaccggcggcaacaccaggaacagatttgccctgagcagccagagaggaggcggcctcatcaccctggccctgcccctggactacaagcaggagcagcagtatgtgctggccgtgacagccagtgatggcaccaggagccacacagcccacgtgctgatcaacgtgacagatgccaacacccacaggcctgtgttccagagcagccactacacagtgtctgtgtctgaagatagacctgtgggcaccagcatcgccaccctgagcgccaatgatgaagatactggagaaaatgcccgcatcacctacgtgatccaggaccctgtgccccagttcagaattgatcctgacagcggcaccatgtacaccatgatggagctggactatgagaaccaggtggcctacaccctgaccatcatggcccaggacaatggcatcccccagaagagtgacaccaccaccctggagatcctgatcctggatgccaatgacaatgccccccagttcctgtgggacttctaccagggcagcatctttgaagatgccccacccagcaccagcatcctgcaggtgtctgccacagaccgggacagcggccccaacggccgcctgctgtacaccttccagggcggagatgatggagatggagacttctacatcgagcccaccagcggggtcatccgcacccagaggcggctggaccgggagaatgtggccgtgtacaacctgtgggccctggccgtggaccggggcagccccacccccctgagcgcctctgtggagatccaggtgaccatcctggacatcaatgacaatgcccccatgtttgagaaggatgagctggagctgtttgtggaggagaacaaccctgtgggctctgtggtggccaagatccgggccaatgaccctgatgagggccccaatgcccagatcatgtaccagatcgtggagggggacatgaggcacttcttccagctggacctgctgaatggagacctgcgggccatggtggagctggactttgaggtgcggcgggagtatgtgctggtggtgcaggccaccagcgcccccctggtgtcccgggccaccgtgcacatcctgctggtggaccagaatgacaacccccctgtgctgcctgacttccagatcctcttcaacaactacgtgaccaacaagagcaacagcttccccaccggggtgattggctgcatcccagcccatgaccctgatgtgtctgacagcctgaactacacctttgtgcagggcaatgagctgcggctgctgctgctggaccctgccaccggggagctgcagctgagccgggacctggacaacaaccggcccctggaggccctgatggaggtgtctgtgtctgatggcatccacagcgtgacagccttctgcaccctgcgggtgaccatcatcacagatgacatgctgaccaacagcatcaccgtgcggctggagaacatgagccaggagaagttcctgagccccctgctggccctgtttgtggagggcgtggccgctgtgctgagcaccaccaaggatgatgtgtttgtgttcaacgtgcagaatgacacagatgtgagcagcaacatcctgaatgtgaccttcagcgccctgctgcccggcggcgtgcggggccagttcttccccagcgaggacctgcaggagcagatctacctgaacagaaccctgctgaccaccatcagcacccagagggtgctgccctttgatgacaacatctgcctgcgggagccctgtgagaactacatgaagtgtgtgtctgtgctgcgctttgacagcagcgcccccttcctgagcagcaccaccgtgctcttccggcccatccaccccatcaatggcctgcgctgccgctgccccccaggcttcaccggggactactgtgaaacagaaattgacctgtgctacagcgacccctgtggggccaacggccgctgccgcagccgggagggcggctacacctgtgaatgttttgaggacttcacagagatctcctag

SEQ ID NO: 145680 - DNA, 8772 bp, Artificial Sequence
  Description of Artificial Sequence: Synthetic coding sequence
atgaggagccctgccaccggggtgcccctgcccaccccacctccacccctgctgctgctgctgctgctgctgctgcccccacccctgctgggggaccaggtgggcccctgccgcagcctgggcagccggggccggggcagcagcggggcctgtgcccccatgggctggctgtgccccagcagcgccagcaacctgtggctgtacaccagccgctgcagagatgctggaacagagctgaccggccacctggtgccccaccatgatggcctgcgggtgtggtgcccagagagcgaggcccacatccccctgcccccagcccctgagggctgcccctggagctgccgcctgctgggcattggaggccacctgagcccccagggcaagctgaccctgcctgaggagcacccctgcctgaaggccccccggctgcgctgccagagctgcaagctggcccaggcccctggcctgcgggccggggagaggagccctgaggagagcctgggcggccgcaggaagagaaatgtgaacacagccccccagttccagcccccatcctaccaggccaccgtgcctgagaaccagcctgctggcacccctgtggccagcctgcgggccatcgaccctgatgaaggagaggccggccgcctggagtacaccatggatgccctgtttgacagccgcagcaaccagttcttcagcctggaccctgtgactggagctgtgaccacagctgaggagctggaccgggagaccaagagcacccacgtgttccgggtgacagcccaggaccacggcatgccccggcgcagcgccctggccaccctgaccatcctggtgacagacaccaatgaccatgaccctgtgtttgagcagcaggagtacaaggagagcctgcgggagaacctggaggtgggctatgaggtgctgactgtgcgggccacagatggagatgcccccccaaatgccaacatcctgtaccgcctgctggagggcagcggcggcagccccagcgaggtgtttgaaattgaccccaggtctggagtcatccgcacccggggccctgtggaccgggaggaggtggagagctaccagctgactgtggaggccagtgaccagggccgggaccccggccccaggagcaccacagctgctgtgttcctgtctgtggaggatgacaatgacaatgccccccagttcagcgagaagcgctacgtggtgcaggtgcgggaggatgtgacccctggggcccctgtgctgcgggtgacagccagtgaccgggacaagggcagcaatgctgtggtgcactacagcatcatgtctggaaatgcccggggccagttctacctggatgcccagacaggagccctggatgtggtgagccccctggactatgagaccaccaaggagtacaccctgcgggtgcgggcccaggacggcggccggccccccctgagcaatgtgtctggcctggtgacagtgcaggtgctggacatcaatgacaatgcccccatctttgtgtccacccccttccaggccaccgtgctggagagcgtgcccctgggctacctggtgctgcacgtgcaggccattgatgctgatgctggggacaatgcccggctggagtaccgcctggccggcgtgggccatgacttccccttcaccatcaacaatggaacaggctggatctctgtggccgctgagctggaccgggaggaggtggacttctacagctttggagtggaggcccgggaccacggcaccccagccctgacagccagcgcctctgtgtctgtgacagtgctggatgtgaatgacaacaaccccaccttcacccagcctgagtacacagtgcggctgaatgaagatgctgctgtgggcacctctgtggtgacagtgtctgctgtggacagagatgcccacagcgtcatcacctaccagatcaccagcggcaacaccaggaaccgcttcagcatcaccagccagagcggcggcggcctggtgtccctggccctgcccctggactacaagctggagcggcagtatgtgctggccgtgacagccagtgatggcacccggcaggacacagcccagatcgtggtgaatgtgacagatgccaacacccacaggcctgtgttccagagcagccactacacagtgaatgtgaatgaagatagacctgctggcaccaccgtggtgctgatcagcgccacagatgaagatactggagaaaatgcccgcatcacctacttcatggaggacagcatcccccagttcagaattgatgctgacaccggggctgtgaccacccaggccgagctggactatgaggaccaggtgtcctacaccctggccatcacagcccgggacaatggcatcccccagaagagtgacaccacctacctggagatcctggtgaatgatgtgaatgacaatgccccccagttcctgcgggacagctaccagggctctgtgtatgaagatgtgccccccttcacctctgtgctgcagatcagcgccacagaccgggacagcggcctgaatggccgggtcttctacaccttccagggcggagatgatggagatggagacttcatcgtggagagcaccagcggcatcgtgaggaccctgcggcggctggaccgggagaatgtggcccagtatgtgctgcgggcctatgctgtggacaagggcatgcccccagcccggacccccatggaggtgacagtgacagtgctggatgtgaatgacaacccccctgtgtttgagcaggatgaatttgatgtgtttgtggaggagaacagccccatcggcctggccgtggcccgggtgacagccacagatcctgatgagggcaccaatgcccagatcatgtaccagatcgtggagggcaacatccctgaggtgttccagctggacatcttctctggagagctgacagccctggtggacctggactatgaagatagaccagaatatgtgctggtgatccaggccaccagcgcccccctggtgtcccgggccaccgtgcacgtgcggctgctggacagaaatgacaacccccctgtgctgggcaactttgagatcctcttcaacaactacgtgaccaacagaagcagcagcttccctgggggcgccatcggccgggtgcctgcccatgaccctgacatcagtgacagcctgacctacagctttgaaagaggaaatgagctgagcctggtgctgctgaatgccagcactggagagctgaagctgagccgggccctggacaacaaccggcccctggaggccatcatgtctgtgctggtgtctgatggagtgcacagcgtgacagcccagtgtgccctgcgggtgaccatcatcacagatgagatgctgacccacagcatcaccctgcggctggaggacatgagccctgagcgcttcctgagccccctgctgggcctcttcatccaggccgtggccgccaccctggccaccccaccagaccacgtggtggtgttcaacgtgcagagggacacagatgcccctgggggccacatcctgaatgtgtccctgtctgtgggccagcccccaggccctgggggcggcccccccttcctgcccagcgaggacctgcaggagcggctgtacctgaacagaagcctgctgacagccatcagcgcccagagggtgctgccctttgatgacaacatctgcctgcgggagccctgtgagaactacatgagatgtgtgtctgtgctgcgctttgacagcagcgcccccttcatcgccagcagctctgtgctcttccggcccatccaccctgtgggcggcctgcgctgccgctgccccccaggcttcaccggggactactgtgaaacagaggtggacctgtgctacagccggccctgtggcccccacggccgctgccgcagccgggagggcggctacacctgcctgtgcagagatggctacacaggagagcactgtgaggtgtctgcccggagcggccgctgcaccccaggagtgtgcaagaatggaggcacctgtgtgaacctgctggtgggcggcttcaagtgtgactgccccagcggggactttgagaagccctactgccaggtgaccaccaggagcttccctgcccacagcttcatcaccttccggggcctgcggcagcgcttccacttcaccctggccctgagctttgccaccaaggagagagatggcctgctgctgtacaacggccgcttcaatgagaagcatgactttgtggccctggaggtgatccaggagcaggtgcagctgaccttctctgctggggagagcaccaccaccgtgagcccctttgtgcctgggggcgtgtctgatggccagtggcacacagtgcagctgaagtactacaacaagcccctgctgggccagacaggcctgccccagggccccagcgagcagaaggtggccgtggtgacagtggatggctgtgacacaggagtggccctgcgctttggatctgtgctgggcaactacagctgtgccgcccagggcacccagggcggcagcaagaagagcctggacctgaccggccccctgctgctgggcggcgtgcctgacctgcctgagagcttccctgtgaggatgaggcagtttgtgggctgcatgaggaacctgcaggtggacagccgccacatcgacatggctgacttcatcgccaacaatggaacagtgcccggctgcccagccaagaagaatgtgtgtgacagcaacacctgccacaatggaggcacctgtgtgaaccagtgggatgccttcagctgtgaatgtcccctgggctttggaggcaagagctgtgcccaggagatggccaacccccagcacttcctgggcagcagcctggtggcctggcacggcctgagcctgcccatcagccagccctggtacctgagcctgatgttccgcacccggcaggctgatggagtgctgctgcaggccatcacccggggccgcagcaccatcaccctgcagctgcgggagggccacgtgatgctgtctgtggagggcaccggcctgcaggccagcagcctgcggctggagcccggccgggccaatgatggagactggcaccacgcccagctggccctgggcgccagcggcggccctggccacgccatcctgagctttgattatggccagcagagagctgagggcaacctgggcccccggctgcacggcctgcacctgagcaacatcaccgtgggcggcatccctggccctgctggaggagtggcccggggcttccggggctgcctgcagggcgtgcgggtgtctgacaccccagagggcgtgaacagcctggaccccagccatggagagagcatcaacgtggagcagggctgcagcctgcctgacccctgtgacagcaacccctgcccagccaacagctactgcagcaatgactgggacagctacagctgcagctgtgaccccggctactacggggacaactgcaccaacgtgtgtgacctgaacccctgtgagcaccagagcgtgtgcaccaggaagcccagcgcccctcatggctacacctgtgagtgcccccccaactacctgggcccctactgtgagaccagaattgaccagccctgcccccggggctggtggggccaccccacctgtggcccctgcaactgtgatgtgtccaaaggatttgatcctgactgcaacaagaccagcggggagtgccactgcaaggagaaccactacagacctcctggcagccccacctgcctgctgtgtgactgctaccccaccggcagcctgagccgggtgtgtgaccctgaagatggccagtgcccctgcaagccaggagtcatcggccggcagtgtgacagatgtgacaacccctttgctgaggtgaccaccaacggctgtgaggtgaactatgacagctgcccccgggccatcgaggccggcatctggtggcccaggaccaggtttggcctgcctgctgctgccccctgccccaagggcagctttggaacagctgtgcgccactgtgatgagcaccggggctggctgccccccaacctcttcaactgcaccagcatcaccttcagcgagctgaagggctttgctgagcggctgcagagaaatgaaagtggcctggacagcggccgcagccagcagctggccctgctgctgagaaatgccacccagcacacagctggctacttcggcagtgatgtgaaggtggcctaccagctggccacccggctgctggcccacgagagcacccagaggggcttcggcctgagcgccacccaggatgtgcacttcacagagaacctgctgcgggtgggcagcgccctgctggacacagccaacaagaggcactgggagctgatccagcagacagagggcggcacagcctggctgctgcagcactatgaggcctatgccagcgccctggcccagaacatgaggcacacctacctgagccccttcaccatcgtgacccccaacatcgtcatctctgtggtgcggctggacaagggcaactttgctggggccaagctgcccaggtatgaggccctgcggggggagcagcccccagacctggagaccaccgtcatcctgcctgagagcgtcttccgggagaccccacctgtggtgcggcctgctggccctggagaggcccaggagcctgaggagctggcccggcggcagaggaggcaccctgagctgagccagggcgaggccgtggccagcgtcatcatctaccgcaccctggccggcctgctgccccacaactatgaccctgacaagaggagcctgcgggtgcccaagaggcccatcatcaacacccctgtggtgtccatctctgtgcatgatgatgaggagctgctgccccgggccctggacaagcctgtgacagtgcagttccggctgctggagacagaggagaggaccaagcccatctgtgtgttctggaaccacagcatcctggtgtctggaactggaggctggagcgcccggggctgtgaggtggtgttcagaaatgaaagccacgtgtcctgccagtgcaaccacatgaccagctttgctgtgctgatggatgtgtccagaagagaaaatggagagatcctgcccctgaagaccctgacctacgtggccctgggcgtgaccctggccgccctgctgctgaccttcttcttcctgaccctgctgcgcatcctgcggagcaaccagcacggcatcagaagaaacctgacagctgccctgggcctggcccagctggtgttcctgctgggcatcaaccaggccgacctgccctttgcctgcaccgtcatcgccatcctgctgcacttcctgtacctgtgcaccttctcctgggccctgctggaggccctgcacctgtaccgggccctgacagaggtgagagatgtgaacacaggccccatgaggttctactacatgctgggctggggcgtgcctgccttcatcaccggcctggccgtgggcctggaccctgagggctacggcaacccagacttctgctggctgagcatctatgacaccctcatctggagctttgctggccctgtggcctttgctgtgtccatgtctgtgttcctgtacatcctggccgcccgggccagctgtgccgcccagaggcagggctttgagaagaagggccctgtgtctggcctgcagcccagctttgctgtgctgctgctgctgagcgccacctggctgctggccctgctgtctgtgaacagcgacaccctgctcttccactacctgtttgccacctgcaactgcatccagggccccttcatcttcctgtcctatgtggtgctgagcaaggaggtgaggaaggccctgaagctggcctgcagcaggaagcccagcccagaccctgccctgaccaccaagagcaccctgaccagcagctacaactgccccagcccctatgcagatggccgcctgtaccagccctatggagacagcgctggcagcctgcacagcaccagccgcagcggcaagagccagcccagctacatccccttcctgctgcgggaggagagcgccctgaaccctggccagggccccccaggcctgggggaccccggcagcctcttcctggagggccaggaccagcagcacgaccctgacacagacagcgacagcgacctgagcctggaggatgaccagagcggcagctatgccagcacccacagcagtgacagcgaggaggaggaggaggaggaggaggaggaggccgccttccctggagagcagggctgggacagcctgctgggccctggagctgagcggctgcccctgcacagcacccccaaggatggcggccctggccctgggaaggccccctggccaggggactttggcaccacagccaaggagagcagtggaaatggagcccctgaggagcggctgagagaaaatggagatgccctgagccgggagggcagcctgggccccctgcccggcagcagcgcccagccccacaagggcatcctgaagaagaagtgcctgcccaccatcagcgagaagagcagcctgctgcggctgcccctggagcagtgcaccggcagcagccggggcagcagcgccagcgagggcagccggggcggccccccaccccggcccccaccccggcagagcctgcaggagcagctgaatggagtgatgcccatcgccatgagcatcaaggccggcaccgtggatgaggacagcagcggcagcgagttcctgttcttcaacttcctgcactag

SEQ ID NO: 145681 - DNA, 9939 bp, Artificial Sequence
  Description of Artificial Sequence: Synthetic coding sequence
atgatggcccggcggcccccctggaggggcctgggcggccgcagcacccccatcctgctgctgctgctgctgagcctcttccccctgagccaggaggagctgggcggcggcggccaccagggctgggaccccggcctggccgccaccaccggcccccgggcccacatcggcggcggggccctggccctgtgcccagagagcagcggcgtgcgggaggatggcggccctggcctgggcgtgcgggagcccatctttgtgggcctgcggggccggcggcagagcgccaggaacagccggggccccccagagcagcccaatgaggagctgggcattgaacatggagtgcagcccctgggcagccgggagcgggagaccggccagggccctggctctgtgctgtactggaggcctgaggtgagcagctgtggccgcacaggccccctgcagaggggcagcctgagccctggggccctgagcagcggcgtgcccggcagcggcaacagcagccccctgcccagcgacttcctgatccgccaccacggccccaagcctgtgagcagccagagaaatgccggcaccggcagcaggaagagggtgggcacagcccgctgctgcggggagctgtgggccaccggcagcaagggccagggcgagcgggccaccaccagcggggctgagaggacagcccccaggaggaactgcctgcccggggccagcggcagcggccctgagctggacagcgcccccaggacagccaggacagccccagccagcggcagcgccccccgggagagcaggacagcccctgagcccgcccccaagaggatgaggagccggggcctcttccgctgccgcttcctgccccagaggcctggccccaggcctcctggcctgcctgcccggcctgaggccaggaaggtgaccagcgccaacagagcccgcttccggcgggccgccaacagacacccccagttcccccagtacaactaccagaccctggtgcctgaaaatgaagctgctggaacagctgtgctgcgggtggtggcccaggaccctgatgctggggaggccggccgcctggtgtacagcctggccgccctgatgaacagccgcagcctggagctgttcagcattgacccccagagcggcctcatcagaacagctgctgccctggaccgggagagcatggagcggcactacctgcgggtgacagcccaggaccacggcagcccccggctgagcgccaccaccatggtggccgtgacagtggccgacagaaatgaccacagccctgtgtttgagcaggcccagtaccgggagaccctgcgggagaatgtggaggagggctaccccatcctgcagctgcgggccacagatggagatgcccccccaaatgccaacctgcgctacagatttgtgggccccccagctgcccgggctgctgctgctgctgcctttgaaattgaccccaggagcggcctcatcagcaccagcggccgggtggaccgggagcacatggagagctatgagctggtggtggaggccagtgaccagggccaggagcccggccccaggtctgccaccgtgcgggtgcacatcaccgtgctggatgaaaatgacaatgccccccagttcagcgagaagcgctacgtggcccaggtgcgggaggatgtgcggccccacacagtggtgctgcgggtgacagccacagaccgggacaaggatgccaacggcctggtgcactacaacatcatcagcggcaacagccggggccactttgccatcgacagcctgactggagagatccaggtggtggcccccctggactttgaggccgagcgggagtatgccctgcgcatccgggcccaggatgctggccggccccccctgagcaacaacacaggcctggccagcatccaggtggtggacatcaatgaccacatccccatctttgtgtccacccccttccaggtgtctgtgctggagaatgcccccctgggccacagcgtcatccacatccaggccgtggatgctgaccacggggagaatgcccggctggagtacagcctgactggagtggccccagacaccccatttgtgatcaacagcgccaccggctgggtgtctgtgtctggccccctggaccgggagagcgtggagcactacttcttcggcgtggaggcccgggaccacggcagcccccccctgagcgccagcgcctctgtgacagtgacagtgctggatgtgaatgacaacagacctgagttcaccatgaaggagtaccacctgcggctgaatgaagatgctgctgtgggcacctctgtggtgtctgtgacagctgtggacagagatgccaacagcgccatctcctaccagatcaccggcggcaacaccaggaacagatttgccatcagcacccagggcggcgtgggcctggtgaccctggccctgcccctggactacaagcaggagcgctacttcaagctggtgctgacagccagtgaccgggccctgcatgaccactgctacgtgcacatcaacatcacagatgccaacacccacaggcctgtgttccagagcgcccactacagcgtgtctgtgaatgaagatcggcccatgggcagcaccatcgtggtgatcagcgccagtgatgatgatgtgggagaaaatgcccgcatcacctacctgctggaggacaacctgccccagttcagaattgatgctgacagcggggccatcaccctgcaggcccccctggactatgaggaccaggtgacctacaccctggccatcacagcccgggacaatggcatcccccagaaggctgacaccacctacgtggaggtgatggtgaatgatgtgaatgacaatgccccccagtttgtggccagccactacacaggcctggtgtctgaagatgccccacccttcacctctgtgctgcagatcagcgccacagacagagatgcccacgccaacggccgggtgcagtacaccttccagaatggagaagatggagatggagacttcaccatcgagcccaccagcggcatcgtgaggacagtgcggcggctggaccgggaggccgtgtctgtgtatgagctgacagcctatgctgtggacagaggagtgccccccctgcggacccctgtgtccatccaggtgatggtgcaggatgtgaatgacaatgcccctgtgtttcctgctgaggagtttgaggtgcgggtgaaggagaacagcatcgtgggctctgtggtggcccagatcacagctgtggaccctgatgagggccccaatgcccacatcatgtaccagatcgtggagggcaacatccctgagctgttccagatggacatcttctctggagagctgacagccctgattgacctggactatgaggcccggcaggagtatgtgattgtggtgcaggccaccagcgcccccctggtgtcccgggccaccgtgcacgtgcggctggtggaccagaatgacaacagccctgtgctgaacaacttccagatcctcttcaacaactacgtgagcaacagaagtgacaccttccccagcggcatcatcggccgcatcccagcctatgaccctgatgtgtctgaccacctgttctacagctttgaaagaggaaatgagctgcagctgctggtggtgaaccagaccagcggggagctgcggctgagcaggaagctggacaacaaccggcccctggtggcctccatgctggtgacagtgacagatggcctgcacagcgtgacagcccagtgtgtgctgcgggtggtgatcatcacagaggagctgctggccaacagcctgactgtgcggctggagaacatgtggcaggagcgcttcctgagccccctgctgggccgcttcctggagggcgtggccgctgtgctggccaccccagcagaagatgtgttcatcttcaacatccagaatgacacagatgtgggcggcaccgtgctgaatgtgtccttcagcgccctggcccccaggggggccggggccggggctgctggcccctggttcagcagcgaggagctgcaggagcagctgtatgtgagaagagctgccctggccgcccggagcctgctggatgtgctgccctttgatgacaacgtgtgcctgcgggagccctgtgagaactacatgaagtgtgtgtctgtgctgcgctttgacagcagcgcccccttcctggccagcgccagcaccctcttccggcccatccagcccatcgccggcctgcgctgccgctgccccccaggcttcaccggggacttctgtgaaacagagctggacctgtgctacagcaacccctgcagaaatggaggagcctgtgcccggcgggagggcggctacacctgtgtgtgccggccccgcttcaccggggaggactgtgagctggacacagaggccggccgctgtgtgcctggggtgtgcagaaatggaggcacctgcacagatgccccaaatggaggcttccgctgccagtgcccagctgggggcgcctttgagggcccccgctgtgaggtggccgcccgctccttcccccccagcagctttgtgatgttccggggcctgcggcagcgcttccacctgaccctgagcctgagctttgccaccgtgcagcagagcggcctgctcttctacaacggccgcctgaatgagaagcatgacttcctggccctggagctggtggccggccaggtgcggctgacctacagcactggagagagcaacacagtggtgagccccaccgtgcctgggggcctgagtgatggccagtggcacacagtgcacctgcgctactacaacaagcccaggacagatgccctgggcggggcccagggccccagcaaggacaaggtggccgtgctgtctgtggatgactgtgatgtggccgtggccctgcagtttggagctgagatcggcaactacagctgtgccgctgctggggtgcagaccagcagcaagaagagcctggacctgaccggccccctgctgctgggcggcgtgcccaacctgcctgagaacttccctgtgagccacaaggacttcatcggctgcatgagggacctgcacattgatggccggcgggtggacatggccgcctttgtggccaacaacggcaccatggccggctgccaggccaagctgcacttctgtgacagcggcccctgcaagaacagcggcttctgcagcgagcgctggggcagcttcagctgtgactgccctgtgggctttggaggcaaggactgccagctgaccatggcccacccccaccacttcagaggaaatggcaccctgtcctggaactttggaagtgacatggctgtgtctgtgccctggtacctgggcctggccttccgcacccgggccacccagggcgtgctgatgcaggtgcaggccggcccccacagcaccctgctgtgccagctggaccggggcctgctgtctgtgacagtgacccggggcagcggccgggccagccacctgctgctggaccaggtgacagtgtctgatggccgctggcatgacctgcggctggagctgcaggaggagcccggcggccggcggggccaccacgtgctgatggtgtccctggacttcagcctcttccaggacaccatggctgtgggcagcgagctgcagggcctgaaggtgaagcagctgcacgtgggcggcctgcccccaggcagcgctgaggaggccccccagggcctggtgggctgcatccagggcgtgtggctgggcagcacccccagcggcagccctgccctgctgccccccagccaccgggtgaatgctgagcccggctgtgtggtgaccaatgcctgtgccagcggcccctgcccccctcatgctgactgccgggacctgtggcagaccttcagctgcacctgccagcccggctactacggccctggctgtgtggatgcctgcctgctgaacccctgccagaaccagggcagctgccgccacctgcccggggccccccacggctacacctgtgactgtgtgggcggctacttcggccaccactgtgagcacaggatggaccagcagtgcccccggggctggtggggcagccccacctgtggcccctgcaactgtgatgtgcacaagggctttgaccccaactgcaacaagaccaacggccagtgccactgcaaggagttccactaccggccccggggcagtgacagctgcctgccctgtgactgctaccctgtgggcagcaccagccgcagctgtgccccccacagcggccagtgcccctgcaggcctggggccctgggccggcagtgcaacagctgtgacagcccctttgctgaggtgacagccagcggctgccgggtgctgtatgatgcctgccccaagagcctgcggtctggagtgtggtggccccagaccaagtttggagtgctggccaccgtgccctgccccaggggggccctgggcgctgctgtgcggctgtgtgatgaggcccagggctggctggagccagacctcttcaactgcaccagccctgccttccgggagctgagcctgctgctggatggcctggagctgaacaagacagccctggacaccatggaggccaagaagctggcccagaggctgcgggaggtgacaggccacacagaccactacttcagccaggatgtgcgggtgacagcccggctgctggcccacctgctggcctttgagagccaccagcagggcttcggcctgacagccacccaggatgcccacttcaatgaaaacctgctgtgggccggcagcgccctgctggcccctgagactggagacctgtgggccgccctgggccagagggcccctgggggcagccctggcagcgctggcctggtgcgccacctggaggagtatgctgccaccctggccaggaacatggagctgacctacctgaaccccatgggcctggtgacccccaacatcatgctgagcattgacaggatggagcaccccagcagccccaggggggcccggcgctacccccgctaccacagcaacctcttccggggccaggatgcctgggacccccacacccacgtgctgctgcccagccagagcccccggcccagccccagcgaggtgctgcccaccagcagcagcattgagaacagcaccaccagctctgtggtgcccccaccagcccctcctgagcctgagcccggcatcagcatcatcatcctgctggtgtaccgcaccctgggcggcctgctgcctgcccagttccaggccgagcggcggggggcccggctgccccagaaccctgtgatgaacagccctgtggtgtctgtggccgtgttccacggcaggaacttcctgcggggcatcctggagagccccatcagcctggagttccggctgctgcagacagccaacagaagcaaggccatctgtgtgcagtgggaccccccaggcctggccgagcagcacggcgtgtggacagcccgggactgtgagctggtgcacagaaatggcagccacgcccgctgccgctgcagcaggacaggcaccttcggcgtgctgatggatgccagcccccgggagcggctggagggggacctggagctgctggccgtgttcacccacgtggtggtggccgtgtctgtggccgccctggtgctgacagctgccatcctgctgagcctgcggagcctgaagagcaatgtgcggggcatccacgccaacgtggccgccgccctgggcgtggccgagctgctcttcctgctgggcatccacaggacccacaaccagctggtgtgcacagctgtggccatcctgctgcactacttcttcctgagcacctttgcctggctgtttgtgcagggcctgcacctgtacaggatgcaggtggagcccagaaatgtggacagaggagccatgaggttctaccacgccctgggctggggcgtgcctgctgtgctgctgggcctggccgtgggcctggaccctgagggctacggcaacccagacttctgctggatctctgtgcatgagcccctcatctggagctttgctggccctgtggtgctggtgattgtgatgaatggcaccatgttcctgctggccgcccggaccagctgcagcacaggccagcgggaggccaagaagaccagcgccctgaccctgcggagcagcttcctgctgctgctgctggtgtctgcctcctggctgtttggcctgctggccgtgaaccacagcatcctggccttccactacctgcatgctggcctgtgtggcctgcagggcctggccgtgctgctgctcttctgtgtgctgaatgctgatgcccgggccgcctggatgcctgcctgcctgggcaggaaggccgcccctgaggaggcccggcctgcccctggcctgggccctggggcctacaacaacacagccctgtttgaggagagcggcctcatccgcatcaccctgggcgccagcacagtgtcctctgtgtcctctgcccggagcggccgcacccaggaccaggacagccagaggggccgcagctacctgcgggacaacgtgctggtgagacatggcagcgctgctgaccacacagaccacagcctgcaggcccacgccggccccacagacctggatgtggccatgttccacagagatgctggagctgacagcgacagcgacagcgacctgagcctggaggaggagaggagcctgagcatccccagcagcgagagcgaggacaatggccgcacccggggccgcttccagaggcccctgtgccgggccgcccagagcgagcggctgctgacccaccccaaggatgtggatggaaatgacctgctgagctactggccagccctgggagaatgtgaggccgccccctgtgccctgcagacctggggcagcgagcggcggctgggcctggacaccagcaaggatgctgccaacaacaaccagcctgaccctgccctgaccagcggagatgagaccagcctgggccgggcccagaggcagaggaagggcatcctgaagaaccggctgcagtaccccctggtgccccagaccaggggggcccctgagctgtcctggtgccgggccgccaccctgggccacagagctgtgcctgctgccagctatggccgcatctatgctgggggcggcaccggcagcctgagccagcctgccagccgctacagcagccgggagcagctggacctgctgctgcggcggcagctgagccgggagcggctggaggaggccccagcccctgtgctgcggcccctgagcaggcctggcagccaggagtgcatggatgctgcccctggccgcctggagcccaaggaccggggcagcaccctgccccggcggcagcccccccgggactacccaggggccatggccggccgcttcggcagcagagatgccctggacctgggcgccccccgggagtggctgagcaccctgcccccacccaggaggacccgggacctggacccccagcccccacccctgcccctgagcccccagaggcagctgagccgggaccccctgctgcccagccggcccctggacagcctgagccgcagcagcaacagccgggagcagctggaccaggtgcccagccgccaccccagccgggaggccctgggccccctgccccagctgctgcgggcccgggaggacagcgtgtctggccccagccacggccccagcacagagcagctggacatcctgagcagcatcctggccagcttcaacagcagcgccctgagctctgtgcagagcagcagcacccccctgggcccccacaccacagccaccccatctgccacagcctctgtgctgggccccagcacccccaggtctgccaccagccacagcatcagcgagctgagcccagattctgaggtgcccaggtctgagggccacagctag

SEQ ID NO: 145682 - DNA, 9954 bp, Artificial Sequence
  Description of Artificial Sequence: Synthetic coding sequence
atgatggcccggcggcccccctggaggggcctgggcggccgcagcacccccatcctgctgctgctgctgctgagcctcttccccctgagccaggaggagctgggcggcggcggccaccagggctgggaccccggcctggccgccaccaccggcccccgggcccacatcggcggcggggccctggccctgtgcccagagagcagcggcgtgcgggaggatggcggccctggcctgggcgtgcgggagcccatctttgtgggcctgcggggccggcggcagagcgccaggaacagccggggccccccagagcagcccaatgaggagctgggcattgaacatggagtgcagcccctgggcagccgggagcgggagaccggccagggccctggctctgtgctgtactggaggcctgaggtgagcagctgtggccgcacaggccccctgcagaggggcagcctgagccctggggccctgagcagcggcgtgcccggcagcggcaacagcagccccctgcccagcgacttcctgatccgccaccacggccccaagcctgtgagcagccagagaaatgccggcaccggcagcaggaagagggtgggcacagcccgctgctgcggggagctgtgggccaccggcagcaagggccagggcgagcgggccaccaccagcggggctgagaggacagcccccaggaggaactgcctgcccggggccagcggcagcggccctgagctggacagcgcccccaggacagccaggacagccccagccagcggcagcgccccccgggagagcaggacagcccctgagcccgcccccaagaggatgaggagccggggcctcttccgctgccgcttcctgccccagaggcctggccccaggcctcctggcctgcctgcccggcctgaggccaggaaggtgaccagcgccaacagagcccgcttccggcgggccgccaacagacacccccagttcccccagtacaactaccagaccctggtgcctgaaaatgaagctgctggaacagctgtgctgcgggtggtggcccaggaccctgatgctggggaggccggccgcctggtgtacagcctggccgccctgatgaacagccgcagcctggagctgttcagcattgacccccagagcggcctcatcagaacagctgctgccctggaccgggagagcatggagcggcactacctgcgggtgacagcccaggaccacggcagcccccggctgagcgccaccaccatggtggccgtgacagtggccgacagaaatgaccacagccctgtgtttgagcaggcccagtaccgggagaccctgcgggagaatgtggaggagggctaccccatcctgcagctgcgggccacagatggagatgcccccccaaatgccaacctgcgctacagatttgtgggccccccagctgcccgggctgctgctgctgctgcctttgaaattgaccccaggagcggcctcatcagcaccagcggccgggtggaccgggagcacatggagagctatgagctggtggtggaggccagtgaccagggccaggagcccggccccaggtctgccaccgtgcgggtgcacatcaccgtgctggatgaaaatgacaatgccccccagttcagcgagaagcgctacgtggcccaggtgcgggaggatgtgcggccccacacagtggtgctgcgggtgacagccacagaccgggacaaggatgccaacggcctggtgcactacaacatcatcagcggcaacagccggggccactttgccatcgacagcctgactggagagatccaggtggtggcccccctggactttgaggccgagcgggagtatgccctgcgcatccgggcccaggatgctggccggccccccctgagcaacaacacaggcctggccagcatccaggtggtggacatcaatgaccacatccccatctttgtgtccacccccttccaggtgtctgtgctggagaatgcccccctgggccacagcgtcatccacatccaggccgtggatgctgaccacggggagaatgcccggctggagtacagcctgactggagtggccccagacaccccatttgtgatcaacagcgccaccggctgggtgtctgtgtctggccccctggaccgggagagcgtggagcactacttcttcggcgtggaggcccgggaccacggcagcccccccctgagcgccagcgcctctgtgacagtgacagtgctggatgtgaatgacaacagacctgagttcaccatgaaggagtaccacctgcggctgaatgaagatgctgctgtgggcacctctgtggtgtctgtgacagctgtggacagagatgccaacagcgccatctcctaccagatcaccggcggcaacaccaggaacagatttgccatcagcacccagggcggcgtgggcctggtgaccctggccctgcccctggactacaagcaggagcgctacttcaagctggtgctgacagccagtgaccgggccctgcatgaccactgctacgtgcacatcaacatcacagatgccaacacccacaggcctgtgttccagagcgcccactacagcgtgtctgtgaatgaagatcggcccatgggcagcaccatcgtggtgatcagcgccagtgatgatgatgtgggagaaaatgcccgcatcacctacctgctggaggacaacctgccccagttcagaattgatgctgacagcggggccatcaccctgcaggcccccctggactatgaggaccaggtgacctacaccctggccatcacagcccgggacaatggcatcccccagaaggctgacaccacctacgtggaggtgatggtgaatgatgtgaatgacaatgccccccagtttgtggccagccactacacaggcctggtgtctgaagatgccccacccttcacctctgtgctgcagatcagcgccacagacagagatgcccacgccaacggccgggtgcagtacaccttccagaatggagaagatggagatggagacttcaccatcgagcccaccagcggcatcgtgaggacagtgcggcggctggaccgggaggccgtgtctgtgtatgagctgacagcctatgctgtggacagaggagtgccccccctgcggacccctgtgtccatccaggtgatggtgcaggatgtgaatgacaatgcccctgtgtttcctgctgaggagtttgaggtgcgggtgaaggagaacagcatcgtgggctctgtggtggcccagatcacagctgtggaccctgatgagggccccaatgcccacatcatgtaccagatcgtggagggcaacatccctgagctgttccagatggacatcttctctggagagctgacagccctgattgacctggactatgaggcccggcaggagtatgtgattgtggtgcaggccaccagcgcccccctggtgtcccgggccaccgtgcacgtgcggctggtggaccagaatgacaacagccctgtgctgaacaacttccagatcctcttcaacaactacgtgagcaacagaagtgacaccttccccagcggcatcatcggccgcatcccagcctatgaccctgatgtgtctgaccacctgttctacagctttgaaagaggaaatgagctgcagctgctggtggtgaaccagaccagcggggagctgcggctgagcaggaagctggacaacaaccggcccctggtggcctccatgctggtgacagtgacagatggcctgcacagcgtgacagcccagtgtgtgctgcgggtggtgatcatcacagaggagctgctggccaacagcctgactgtgcggctggagaacatgtggcaggagcgcttcctgagccccctgctgggccgcttcctggagggcgtggccgctgtgctggccaccccagcagaagatgtgttcatcttcaacatccagaatgacacagatgtgggcggcaccgtgctgaatgtgtccttcagcgccctggcccccaggggggccggggccggggctgctggcccctggttcagcagcgaggagctgcaggagcagctgtatgtgagaagagctgccctggccgcccggagcctgctggatgtgctgccctttgatgacaacgtgtgcctgcgggagccctgtgagaactacatgaagtgtgtgtctgtgctgcgctttgacagcagcgcccccttcctggccagcgccagcaccctcttccggcccatccagcccatcgccggcctgcgctgccgctgccccccaggcttcaccggggacttctgtgaaacagagctggacctgtgctacagcaacccctgcagaaatggaggagcctgtgcccggcgggagggcggctacacctgtgtgtgccggccccgcttcaccggggaggactgtgagctggacacagaggccggccgctgtgtgcctggggtgtgcagaaatggaggcacctgcacagatgccccaaatggaggcttccgctgccagtgcccagctgggggcgcctttgagggcccccgctgtgaggtggccgcccgctccttcccccccagcagctttgtgatgttccggggcctgcggcagcgcttccacctgaccctgagcctgagctttgccaccgtgcagcagagcggcctgctcttctacaacggccgcctgaatgagaagcatgacttcctggccctggagctggtggccggccaggtgcggctgacctacagcactggagagagcaacacagtggtgagccccaccgtgcctgggggcctgagtgatggccagtggcacacagtgcacctgcgctactacaacaagcccaggacagatgccctgggcggggcccagggccccagcaaggacaaggtggccgtgctgtctgtggatgactgtgatgtggccgtggccctgcagtttggagctgagatcggcaactacagctgtgccgctgctggggtgcagaccagcagcaagaagagcctggacctgaccggccccctgctgctgggcggcgtgcccaacctgcctgagaacttccctgtgagccacaaggacttcatcggctgcatgagggacctgcacattgatggccggcgggtggacatggccgcctttgtggccaacaacggcaccatggccggctgccaggccaagctgcacttctgtgacagcggcccctgcaagaacagcggcttctgcagcgagcgctggggcagcttcagctgtgactgccctgtgggctttggaggcaaggactgccagctgaccatggcccacccccaccacttcagaggaaatggcaccctgtcctggaactttggaagtgacatggctgtgtctgtgccctggtacctgggcctggccttccgcacccgggccacccagggcgtgctgatgcaggtgcaggccggcccccacagcaccctgctgtgccagctggaccggggcctgctgtctgtgacagtgacccggggcagcggccgggccagccacctgctgctggaccaggtgacagtgtctgatggccgctggcatgacctgcggctggagctgcaggaggagcccggcggccggcggggccaccacgtgctgatggtgtccctggacttcagcctcttccaggacaccatggctgtgggcagcgagctgcagggcctgaaggtgaagcagctgcacgtgggcggcctgcccccaggcagcgctgaggaggccccccagggcctggtgggctgcatccagggcgtgtggctgggcagcacccccagcggcagccctgccctgctgccccccagccaccgggtgaatgctgagcccggctgtgtggtgaccaatgcctgtgccagcggcccctgcccccctcatgctgactgccgggacctgtggcagaccttcagctgcacctgccagcccggctactacggccctggctgtgtggatgcctgcctgctgaacccctgccagaaccagggcagctgccgccacctgcccggggccccccacggctacacctgtgactgtgtgggcggctacttcggccaccactgtgagcacaggatggaccagcagtgcccccggggctggtggggcagccccacctgtggcccctgcaactgtgatgtgcacaagggctttgaccccaactgcaacaagaccaacggccagtgccactgcaaggagttccactaccggccccggggcagtgacagctgcctgccctgtgactgctaccctgtgggcagcaccagccgcagctgtgccccccacagcggccagtgcccctgcaggcctggggccctgggccggcagtgcaacagctgtgacagcccctttgctgaggtgacagccagcggctgccgggtgctgtatgatgcctgccccaagagcctgcggtctggagtgtggtggccccagaccaagtttggagtgctggccaccgtgccctgccccaggggggccctgggcctgcggggggccggggctgctgtgcggctgtgtgatgaggcccagggctggctggagccagacctcttcaactgcaccagccctgccttccgggagctgagcctgctgctggatggcctggagctgaacaagacagccctggacaccatggaggccaagaagctggcccagaggctgcgggaggtgacaggccacacagaccactacttcagccaggatgtgcgggtgacagcccggctgctggcccacctgctggcctttgagagccaccagcagggcttcggcctgacagccacccaggatgcccacttcaatgaaaacctgctgtgggccggcagcgccctgctggcccctgagaccggggacctgtgggccgccctgggccagagggcccctgggggcagccctggcagcgctggcctggtgcgccacctggaggagtatgctgccaccctggccaggaacatggagctgacctacctgaaccccatgggcctggtgacccccaacatcatgctgagcattgacaggatggagcaccccagcagccccaggggggcccggcgctacccccgctaccacagcaacctcttccggggccaggatgcctgggacccccacacccacgtgctgctgcccagccagagcccccggcccagccccagcgaggtgctgcccaccagcagcagcattgagaacagcaccaccagctctgtggtgcccccaccagcccctcctgagcctgagcccggcatcagcatcatcatcctgctggtgtaccgcaccctgggcggcctgctgcctgcccagttccaggccgagaggagaggagcccggctgccccagaaccctgtgatgaacagccctgtggtgtctgtggccgtgttccatggaagaaacttcctgcggggcatcctggagagccccatcagcctggagttccggctgctgcagacagccaacagaagcaaggccatctgtgtgcagtgggaccccccaggcctggccgagcagcacggcgtgtggacagcccgggactgtgagctggtgcacagaaatggcagccacgcccgctgccgctgcagcaggacaggcacctttggagtgctgatggatgccagcccccgggagcggctggagggggacctggagctgctggccgtgttcacccacgtggtggtggccgtgtctgtggccgccctggtgctgacagctgccatcctgctgagcctgcggagcctgaagagcaatgtgcggggcatccacgccaacgtggccgccgccctgggcgtggccgagctgctcttcctgctgggcatccacaggacccacaaccagctggtgtgcacagctgtggccatcctgctgcactacttcttcctgagcacctttgcctggctgtttgtgcagggcctgcacctgtacaggatgcaggtggagcccagaaatgtggacagaggagccatgaggttctaccacgccctgggctggggcgtgcctgctgtgctgctgggcctggccgtgggcctggaccctgagggctacggcaacccagacttctgctggatctctgtgcatgagcccctcatctggagctttgctggccctgtggtgctggtgattgtgatgaatggcaccatgttcctgctggccgcccggaccagctgcagcacaggccagcgggaggccaagaagaccagcgccctgaccctgcggagcagcttcctgctgctgctgctggtgtctgcctcctggctgtttggcctgctggccgtgaaccacagcatcctggccttccactacctgcacgccggcctgtgtggcctgcagggcctggccgtgctgctgctcttctgtgtgctgaatgctgatgcccgggccgcctggatgcctgcctgcctgggcaggaaggccgcccctgaggaggcccggcctgcccctggcctgggccctggggcctacaacaacacagccctgtttgaggagagcggcctcatccgcatcaccctgggcgccagcacagtgtcctctgtgagcagcgcccggagcggccgcacccaggaccaggacagccagaggggccgcagctacctgcgggacaacgtgctggtgcgccacggcagcgctgctgaccacacagaccacagcctgcaggcccatgctggccccacagacctggatgtggccatgttccacagagatgctggagctgacagcgacagcgacagcgacctgagcctggaggaggagaggagcctgagcatccccagcagcgagagtgaagataatggaagaacccggggccgcttccagaggcccctgtgcagagctgcccagagcgagcggctgctgacccaccccaaggatgtggatggaaatgacctgctgagctactggccagccctgggggagtgtgaggccgccccctgtgccctgcagacctggggcagcgagcggcggctgggcctggacaccagcaaggatgctgccaacaacaaccagcctgaccctgccctgaccagcggagatgagaccagcctgggccgggcccagaggcagaggaagggcatcctgaagaaccggctgcagtaccccctggtgccccagaccaggggggcccctgagctgtcctggtgcagagctgccaccctgggccacagagctgtgcctgctgccagctatggccgcatctatgccggcggcggcaccggcagcctgagccagcctgccagccgctacagcagccgggagcagctggacctgctgctgcggcggcagctgagccgggagcggctggaggaggccccagcccctgtgctgcggcccctgagccggcccggcagccaggagtgcatggatgctgcccctggccgcctggagcccaaggaccggggcagcaccctgccccggcggcagcccccccgggactacccaggggccatggccggccgcttcggcagcagagatgccctggacctgggcgccccccgggagtggctgagcaccctgcccccacccaggaggacccgggacctggacccccagcccccacccctgcccctgagcccccagaggcagctgagccgggaccccctgctgcccagccggcccctggacagcctgagccgcagcagcaacagccgggagcagctggaccaggtgcccagccgccaccccagccgggaggccctgggccccctgccccagctgctgcgggccagagaagattctgtgtctggccccagccacggccccagcacagagcagctggacatcctgagcagcatcctggccagcttcaacagcagcgccctgagctctgtgcagagcagcagcacccccctgggcccccacaccacagccacccccagcgccacagcctctgtgctgggccccagcacccccaggtctgccaccagccacagcatcagcgagctgagcccagacagcgaggtgcccaggtctgagggccacagctag

SEQ ID NO: 145683 - DNA, 1557 bp, Artificial Sequence
  Description of Artificial Sequence: Synthetic coding sequence
atggccttctgggccggcggcagccccagcgtggtggactacttccccagcgaggacttctaccgctgtggctactgcaagaatgaaagtggcagccgcagcaatggcatgtgggcccacagcatgacagtgcaggactaccaggacctgattgaccggggctggaggagaagtggcaagtatgtgtacaagcctgtgatgaaccagacctgctgcccccagtacaccatccgctgccggcccctgcagttccagcccagcaagagccacaagaaggtgctgaagaagatgctgaagttcctggccaagggggaggtgcccaagggcagctgtgaagatgagcccatggacagcaccatggatgatgctgtggccggggactttgccctgatcaacaagctggacatccagtgtgacctgaagaccctgagtgatgacatcaaggagagcctggagagcgagggcaagaacagcaagaaggaggagccccaggagctgctgcagagccaggactttgtgggggagaagctgggcagcggggagcccagccacagcgtgaaggtgcacacagtgcccaagccaggaaaaggagctgacctgagcaagccaccctgcaggaaggccaaggagatcaggaaggagaggaagaggctgaagctgatgcagcagaacccagctggggagctggagggcttccaggcccagggccacccccccagcctcttcccccccaaggccaagagcaaccagcccaagagcctggaggacctgatctttgagagcctgcctgaaaatgccagccacaagctggaggtgcgggtggtgcgcagcagcccccccagcagccagttcaaggccaccctgctggagagctaccaggtgtacaagcgctaccagatggtgatccacaagaaccccccagacacccccacagagagccagttcacccgcttcctgtgcagcagccccctggaggccgagaccccaccaaatggaccagactgtggctacggcagcttccaccagcagtactggctggatggcaagatcatcgctgtgggcgtcatcgacatcctgcccaactgtgtgtcctctgtgtacctgtactatgaccctgactacagcttcctgagcctgggcgtgtacagcgccctgcgggagatcgccttcacccggcagctgcacgagaagaccagccagctgagctactactacatgggcttctacatccacagctgccccaagatgaagtacaagggccagtaccggcccagcgacctgctgtgcccagagacctacgtgtgggtgcccatcgagcagtgcctgcccagcctggagaacagcaagtactgccgcttcaaccaggaccctgaggccgtggatgaggacaggagcacagagccagaccggctgcaggtgttccacaagagggccatcatgccctacggcgtgtacaagaagcagcagaaggaccccagcgaggaggccgctgtgctgcagtatgccagcctggtgggccagaagtgcagcgagaggatgctgctcttcagaaattag

SEQ ID NO: 145684 - DNA, 3195 bp, Artificial Sequence
  Description of Artificial Sequence: Synthetic coding sequence
atgggccgccacgtggccaccagctgccacgtggcctggctgctggtgctgatcagcggctgctggggccaggtgaaccggctgcccttcttcaccaaccacttctttgacacctacctgctgatcagcgaggacacccctgtgggcagctctgtgacccagctgctggcccaggacatggacaatgaccccctggtgtttggagtgtctggagaggaggccagccgcttctttgctgtggagccagacaccggggtggtgtggctgcggcagcccctggaccgggagaccaagtctgagttcaccgtggagttctctgtgtctgaccaccagggcgtcatcaccaggaaggtgaacatccaggtgggagatgtgaatgacaatgcccccaccttccacaaccagccctacagcgtgcgcatccctgaggtgggcgccactggaaacacccctgtgggcacccccatcttcatcgtgaatgccacagatcctgacctgggcgctgggggctctgtgctgtacagcttccagccccccagccagttctttgccattgattctgcccggggcatcgtgaccgtcatccgggagctggactatgagaccacccaggcctaccagctgactgtgaatgccacagaccaggacaagacccggcccctgagcaccctggccaacctggccatcatcatcacagatgtgcaggacatggaccccatcttcatcaacctgccctacagcaccaacatctatgagcacagccccccaggcaccaccgtgcgcatcatcacagccatcgaccaggacaagggccggccccggggcatcggctacaccatcgtgtctggcaacaccaacagcatctttgccctggactacatctctggagtgctgaccctgaatggcctgctggaccgggagaaccccctgtacagccacggcttcatcctgactgtgaagggcacagagctgaatgatgacaggacccccagtgatgccaccgtgaccaccaccttcaacatcctggtgattgacatcaatgacaatgcccctgagttcaacagcagcgagtacagcgtggccatcacagagctggcccaggtgggctttgccctgcccctcttcatccaggtggtggacaaggatgagggcctgaacagcatgtttgaggtgtacctggtgggcaacaacagccaccacttcatcatcagccccacctctgtgcagggcaaggctgacatccgcatccgggtggccatccccctggactatgagaccgtggacagatatgactttgacctgtttgccaatgaatctgtgcctgaccacgtgggctacgccaaggtgaagatcaccctcatcaatgaaaatgacaaccggcccatcttcagccagcccctgtacaacatcagcctgtatgaaaatgtgacagtgggcacctctgtgctgactgtgctggccacagacaatgatgctggcacctttggagaggtgtcctacttcttcagtgatgatcctgaccgcttcagcctggacaaggacaccggcctcatcatgctgattgcccggctggactatgagctgatccagcgcttcaccctgaccatcatcgccagagatggcggcggggaggagaccaccggccgggtgcgcatcaacgtgctggatgtgaatgacaacgtgcccaccttccagaaggatgcctacgtgggcgccctgagagaaaatgagcccagcgtgacccagctggtgcggctgcgggccacagatgaggacagcccccccaacaaccagatcacctacagcatcgtgtctgccagcgccttcggcagctactttgacatcagcctgtatgagggctatggagtcatctctgtgtcccggcccctggactatgagcagatcagcaatggcctcatctacctgactgtgatggccatggatgctggcaacccccccctgaacagcacagtgcctgtgaccatcgaggtgtttgatgaaaatgacaacccccccaccttcagcaagccagcctactttgtgtctgtggtggagaacatcatggccggggccaccgtgctcttcctgaatgccacagacctggacaggagccgggagtatggccaggagagcatcatctacagcctggagggcagcacccagttccgcatcaatgcccggagcggggagatcaccaccaccagcctgctggaccgggagaccaagtctgagtacatcctgattgtgcgggctgtggatggaggagtgggccacaaccagaagacaggcatcgccaccgtgaacatcaccctgctggacatcaatgacaaccaccccacctggaaggatgccccctactacatcaacctggtggagatgaccccaccagacagtgatgtgaccaccgtggtggccgtggaccctgacctgggggagaatggcaccctggtgtacagcatccagccccccaacaagttctacagcctgaacagcaccaccgggaagatccgcaccacccacgccatgctggaccgggagaacccagacccccatgaagctgagctgatgaggaagatcgtggtgtctgtgacagactgtggccggccccccctgaaggccaccagcagcgccaccgtgtttgtgaacctgctggacctgaatgacaatgaccccaccttccagaacctgccctttgtggccgaggtgctggagggcatcccagctggggtgtccatctaccaggtggtggccatcgacctggatgagggcctgaatggcctggtgtcctacaggatgcctgtgggcatgcccaggatggacttcctgatcaacagcagcagtggagtggtggtgaccaccacagagctggaccgggagagaattgctgagtaccagctgcgggtggtggccagtgatgctggcacccccaccaagagcagcaccagcaccctgaccatccacgtgctggatgtgaatgatgagacccccaccttcttccctgctgtgtacaacgtgtctgtgtctgaagatgtgccccgggagttccgggtggtgtggctgaactgcacagacaatgatgtgggcctgaatgctgagctgagctacttcatcaccggggccgccccagccagcgcccacctgtgccggcccccaggggccctgcccccacccctgcctgatggccagcctgactag

SEQ ID NO: 145685 - DNA, 3345 bp, Artificial Sequence
  Description of Artificial Sequence: Synthetic coding sequence
atggtgaagagccccatgaaccgggagctggtggccacctatgaggtgaccctgtctgtgattgacaatgccagtgacctgcctgagaggtctgtgtctgtgcccaatgccaagctgactgtgaatgtgctggatgtgaatgacaacaccccccagttcaagcccttcggcatcacctactacatggagcgcatcctggagggcgccaccccaggcaccaccctgattgctgtggccgctgtggaccctgacaagggcctgaatggcctggtgacctacaccctgctggacctggtgcccccaggctacgtgcagctggaggacagcagcgctgggaaggtgattgccaacagaacagtggactatgaggaggtgcactggctgaacttcaccgtgcgggccagtgacaatggcagcccccccagggctgctgagatccctgtgtacctggagatcgtggacatcaatgacaacaaccccatctttgaccagcccagctaccaggaggccgtgtttgaagatgtgcctgtgggcaccatcatcctgactgtgacagccacagatgctgacagcggcaactttgccctgattgagtacagcctgggagatggagagagcaagtttgccatcaaccccaccaccggggacatctacgtgctgagcagcctggaccgggagaagaaggaccactacatcctgacagccctggccaaggacaaccctggagatgtggccagcaacagaagagagaacagcgtgcaggtggtgatccaggtgctggatgtgaatgactgccggccccagttcagcaagccccagttcagcacctctgtgtatgaaaatgaacctgctggcaccagcgtcatcaccatgatggccacagaccaggatgagggccccaatggagagctgacctacagcctggagggccctggggtggaggccttccacgtggacatggacagcggcctggtgaccacccagaggcccctgcagagctatgagaagttcagcctgactgtggtggccacagatggaggagagccccccctgtggggcaccaccatgctgctggtggaggtgattgatgtgaatgacaacagacctgtgtttgtgcggccccccaacggcaccatcctgcacatccgggaggagatccccctgcggagcaatgtgtatgaggtgtatgccacagacaaggatgagggcctgaatggagctgtgcgctacagcttcctgaagacagctggcaacagagactgggagttcttcatcatcgaccccatcagcggcctcatccagacagcccagaggctggaccgggagagccaggccgtgtacagcctcatcctggtggccagtgacctgggccagcctgtgccctatgagaccatgcagcccctgcaggtggccctggaggacattgatgacaatgagcccctgtttgtgcggccccccaagggcagcccccagtaccagctgctgactgtgcctgagcacagcccccggggcaccctggtgggcaatgtgactggagctgtggatgctgatgagggccccaatgccatcgtgtactacttcatcgctgctggaaatgaggagaagaacttccacctgcagccagatggctgcctgctggtgctgcgggacctggaccgggagcgggaggccatcttctccttcatcgtgaaggccagcagcaacagatcctggaccccaccccggggccccagccccaccctggacctggtggccgacctgaccctgcaggaggtgcgggtggtgctggaggacatcaatgaccagcccccacgcttcaccaaggccgagtacacagctggggtggccacagatgccaaggtgggcagcgagctgatccaggtgctggccctggatgctgacatcggcaacaacagcctggtgttctacagcatcctggccatccactacttccgggccctggccaatgacagtgaagatgtgggccaggtgttcaccatgggctccatggatggcatcctgcggacctttgacctcttcatggcctacagccctggctactttgtggtggacatcgtggcccgggacctggccggccacaatgacacagccatcatcggcatctacatcctgagagatgaccagagggtgaagatcgtcatcaatgagatcccagacagagtgcggggctttgaggaggagttcatccacctgctgagcaacatcactggagccatcgtgaacacagacaacgtgcagttccacgtggacaagaagggccgggtgaactttgcccagacagagctgctgatccacgtggtgaacagagacaccaaccgcatcctggatgtggacagagtcatccagatgattgatgagaacaaggagcagctgaggaacctcttcaggaactacaacgtgctggatgtgcagcctgccatctctgtgcggctgcctgatgacatgtctgccctgcagatggccatcatcgtgctggccatcctgctcttcctggccgccatgctgtttgtgctgatgaactggtactacagaacagtgcacaagaggaagctgaaggccatcgtggccggcagcgctggcaacagaggcttcatcgacatcatggacatgcccaacaccaacaagtacagctttgatggagccaaccctgtgtggctggaccccttctgcaggaacctggagctggccgcccaggccgagcatgaagatgacctgcctgagaacctgtctgaaattgctgacctgtggaacagccccaccaggacccacggcaccttcggccgggagcctgctgctgtgaagccagatgatgaccgctacctgcgggccgccatccaggagtatgacaacatcgccaagctgggccagatcatccgggagggccccatcaagggcagcctgctgaaggtggtgctggaggactacctgcggctgaagaagctgtttgcccagaggatggtgcagaaggccagcagctgccacagcagcatcagcgagctgatccagacagagctggatgaggagcccggggaccacagccctggccagggcagcctgcgcttccgccacaagccccctgtggagctgaagggcccagatggcatccacgtggtgcacggcagcacaggcaccctgctggccacagacctgaacagcctgcctgaggaggaccagaagggcctgggccgcagcctggagaccctgacagctgctgaggccacagcctttgaaagaaatgccaggacagaaagtgccaagagcacccccctgcacaagctgagagatgtgatcatggagacccccctggagatcacagagctgtag

SEQ ID NO: 145686 - DNA, 1368 bp, Artificial Sequence
  Description of Artificial Sequence: Synthetic coding sequence
atgagggccagcctgggcgtgtgtggcacagccagctccatggtgattgtgtatgtggaggacatcaatgatgaggcccctgtgttcacccagcagcagtacagccggctgggcctgcgggagacagctggcatcggcaccagcgtcatcgtggtgcaggccacagaccgggacagcggagatggcggcctggtgaactaccgcatcctgtctggagctgagggcaagtttgaaattgatgagagcacaggcctcatcatcaccgtgaactacctggactatgagaccaagaccagctacatgatgaatgtgtctgccacagaccaggccccacccttcaaccagggcttctgcagcgtgtacatcaccctgctgaatgagctggatgaagctgtgcagttcagcaatgccagctatgaagctgccatcctggagaacctggccctgggcacagaaattgtgcgggtgcaggcctacagcattgacaacctgaaccagatcacctaccgcttcaatgcctacaccagcacccaggccaaggccctcttcaagattgatgccatcactggagtcatcaccgtgcagggcctggtggaccgggagaagggggacttctacaccctgactgtggtggctgatgatggcggccccaaggtggacagcacagtggtgtacatcaccgtgctggatgaaaatgacaacagccccaggtttgacttcaccagtgacagcgctgtgtccatccctgaggactgccctgtgggccagagggtggccaccgtgaaggcctgggaccctgatgctggcagcaatggccaggtggtgttcagcctggccagcggcaacattgctggggcctttgaaattgtgaccaccaatgacagcatcggggaggtgtttgtggcccggcccctggaccgggaggagctggaccactacatcctgcaggtggtggccagtgaccggggcaccccacccaggaagaaggaccacatcctgcaggtgaccatcctggacatcaatgacaacccccctgtgattgagagccccttcggctacaacgtgtctgtgaatgaaaatgtgggcggcggcacagctgtggtgcaggtgcgggccacagaccgggacatcggcatcaacagcgtgctgagctactacatcacagagggcaacaaggacatggccttcaggatggaccgcatcagcggggagatcgccaccaggcctgcccccccagaccgggagcggcagagcttctaccacctggtggccaccgtggaggatgagggcacccccaccctgtctgtgtctgatggcggcggccaccgggaggagcgggtgggccagggcagcagcgccagcgagtag

SEQ ID NO: 145687 - DNA, 1593 bp, Artificial Sequence
  Description of Artificial Sequence: Synthetic coding sequence
atgggccgccacgtggccaccagctgccacgtggcctggctgctggtgctgatcagcggctgctggggccaggtgaaccggctgcccttcttcaccaaccacttctttgacacctacctgctgatcagcgaggacacccctgtgggcagctctgtgacccagctgctggcccaggacatggacaatgaccccctggtgtttggagtgtctggagaggaggccagccgcttctttgctgtggagccagacaccggggtggtgtggctgcggcagcccctggaccgggagaccaagtctgagttcaccgtggagttctctgtgtctgaccaccagggcgtcatcaccaggaaggtgaacatccaggtgggagatgtgaatgacaatgcccccaccttccacaaccagccctacagcgtgcgcatccctgagaacacccctgtgggcacccccatcttcatcgtgaatgccacagatcctgacctgggcgccggcggctctgtgctgtacagcttccagccccccagccagttctttgccatcgacagcgcccggggcatcgtgaccgtcatccgggagctggactatgagaccacccaggcctaccagctgactgtgaatgccacagaccaggacaagacccggcccctgagcaccctggccaacctggccatcatcatcacagatgtgcaggacatggaccccatcttcatcaacctgccctacagcaccaacatctatgagcacagccccccaggcaccaccgtgcgcatcatcacagccatcgaccaggacaagggccggccccggggcatcggctacaccatcgtgtctggcaacaccaacagcatctttgccctggactacatcagcggcgtgctgaccctgaatggcctgctggaccgggagaaccccctgtacagccacggcttcatcctgactgtgaagggcacagagctgaatgatgacaggacccccagtgatgccaccgtgaccaccaccttcaacatcctggtgattgacatcaatgacaatgcccctgagttcaacagcagcgagtacagcgtggccatcacagagctggcccaggtgggctttgccctgcccctcttcatccaggtggtggacaaggatgagaacctgggcctgaacagcatgtttgaggtgtacctggtgggcaacaacagccaccacttcatcatcagccccacctctgtgcagggcaaggctgacatccgcatccgggtggccatccccctggactatgaaacagtggacagatatgactttgacctgtttgccaatgaatctgtgcctgaccacgtgggctacgccaaggtgaagatcaccctcatcaatgaaaatgacaaccggcccatcttcagccagcccctgtacaacatcagcctgtatgaaaatgtgacagtgggcacctctgtgctgactgtgctggtgagcccccgcttcaccgctggccccctgagcagccctggccccaccgtggtgcgccaccctgagggcttctgcccccgggacctgagcaaccagggcagaagacacccccagatccctgagctgtgcctgctggtgtactag

SEQ ID NO: 145688 - DNA, 3639 bp, Artificial Sequence
  Description of Artificial Sequence: Synthetic coding sequence
atgggccgccacgtggccaccagctgccacgtggcctggctgctggtgctgatcagcggctgctggggccaggtgaaccggctgcccttcttcaccaaccacttctttgacacctacctgctgatcagcgaggacacccctgtgggcagctctgtgacccagctgctggcccaggacatggacaatgaccccctggtgtttggagtgtctggagaggaggccagccgcttctttgctgtggagccagacaccggggtggtgtggctgcggcagcccctggaccgggagaccaagtctgagttcaccgtggagttctctgtgtctgaccaccagggcgtcatcaccaggaaggtgaacatccaggtgggagatgtgaatgacaatgcccccaccttccacaaccagccctacagcgtgcgcatccctgagaacacccctgtgggcacccccatcttcatcgtgaatgccacagatcctgacctgggcgccggcggctctgtgctgtacagcttccagccccccagccagttctttgccatcgacagcgcccggggcatcgtgaccgtcatccgggagctggactatgagaccacccaggcctaccagctgactgtgaatgccacagaccaggacaagacccggcccctgagcaccctggccaacctggccatcatcatcacagatgtgcaggacatggaccccatcttcatcaacctgccctacagcaccaacatctatgagcacagccccccaggcaccaccgtgcgcatcatcacagccatcgaccaggacaagggccggccccggggcatcggctacaccatcgtgtctggcaacaccaacagcatctttgccctggactacatcagcggcgtgctgaccctgaatggcctgctggaccgggagaaccccctgtacagccacggcttcatcctgactgtgaagggcacagagctgaatgatgacaggacccccagtgatgccaccgtgaccaccaccttcaacatcctggtgattgacatcaatgacaatgcccctgagttcaacagcagcgagtacagcgtggccatcacagagctggcccaggtgggctttgccctgcccctcttcatccaggtggtggacaaggatgagacccagggcctgaacagcatgtttgaggtgtacctggtgggcaacaacagccaccacttcatcatcagccccacctctgtgcagggcaaggctgacatccgcatccgggtggccatccccctggactatgaaacagtggacagatatgactttgacctgtttgccaatgaatctgtgcctgaccacgtgggctacgccaaggtgaagatcaccctcatcaatgaaaatgacaaccggcccatcttcagccagcccctgtacaacatcagcctgtatgaaaatgtgacagtgggcacctctgtgctgactgtgctggccacagacaatgatgctggcaccttcggggaggtgtcctacttcttcagtgatgatcctgaccgcttcagcctggacaaggacaccggcctcatcatgctgattgcccggctggactatgagctgatccagcgcttcaccctgaccatcatcgccagagatggcggcggggaggagaccaccggccgggtgcgcatcaacgtgctggatgtgaatgacaacgtgcccaccttccagaaggatgcctacgtgggcgccctgcgggagaatgagcccagcgtgacccagctggtgcggctgcgggccacagatgaggacagcccccccaacaaccagatcacctacagcatcgtgtctgccagcgccttcggcagctactttgacatcagcctgtatgagggctacggcgtcatctctgtgtcccggcccctggactatgagcagatcagcaatggcctcatctacctgactgtgatggccatggatgctggcaacccccccctgaacagcacagtgcctgtgaccatcgaggtgtttgatgaaaatgacaacccccccaccttcagcaagccagcctactttgtgtctgtggtggagaacatcatggccggggccaccgtgctcttcctgaatgccacagacctggacaggagccgggagtatggccaggagagcatcatctacagcctggagggcagcacccagttccgcatcaatgcccggtctggagagatcaccaccaccagcctgctggaccgggagaccaagtctgagtacatcctgattgtgcgggctgtggatggcggcgtgggccacaaccagaagacaggaattgccaccgtgaacatcaccctgctggacatcaatgacaaccaccccacctggaaggatgccccctactacatcaacctggtggagatgaccccaccagacagtgatgtgaccaccgtggtggccgtggaccctgacctgggagaaaatggcaccctggtgtacagcatccagccccccaacaagttctacagcctgaacagcaccaccgggaagatccgcaccacccacgccatgctggacagagaaaatccagacccccatgaggccgagctgatgaggaagatcgtggtgtctgtgacagactgtggccggccccccctgaaggccaccagcagcgccaccgtgtttgtgaacctgctggacctgaatgacaatgaccccaccttccagaacctgccctttgtggccgaggtgctggagggcatcccagctggggtgtccatctaccaggtggtggccatcgacctggatgagggcctgaatggcctggtgtcctacaggatgcctgtgggcatgcccaggatggacttcctgatcaacagcagcagcggcgtggtggtgaccaccacagagctggaccgggagagaattgctgagtaccagctgcgggtggtggccagtgatgctggcacccccaccaagagcagcaccagcaccctgaccatccacgtgctggatgtgaatgatgagacccccaccttcttccctgctgtgtacaacgtgtctgtgtctgaagatgtgccccgggagttccgggtggtgtggctgaactgcacagacaatgatgtgggcctgaatgctgagctgagctacttcatcactggaggaaatgtggatggcaagttctctgtgggctacagagatgctgtggtgaggacagtggtgggcctggaccgggagaccacagctgcctacatgctgatcctggaggccatcgacaatggacctgtgggcaagaggcacactggaacagccaccgtgtttgtgacagtgctggatgtgaatgacaaccggcccatcttcctgcagagcagctatgaggcctctgtgcctgaggacatccctgagggccacagcatcctgcaggaggaggacctggccagcccctgcatcagccctgccccaccccggcgggccttccagagcagcggggagaaggagaccagccagtttcctgggaaggagctgcggcgggagcccggccccagcaaggcccagaacagagctgccttcacagagcccctggccgaggcccccctgctgggcagcaagcaggcccaggaggagcgggcccccctgccccgggagcaggcccagcagctgcagggcagcgagggggagaagggcggcccctag

SEQ ID NO: 145689 - DNA, 1593 bp, Artificial Sequence
  Description of Artificial Sequence: Synthetic coding sequence
atgggccgccacgtggccaccagctgccacgtggcctggctgctggtgctgatcagcggctgctggggccaggtgaaccggctgcccttcttcaccaaccacttctttgacacctacctgctgatcagcgaggacacccctgtgggcagctctgtgacccagctgctggcccaggacatggacaatgaccccctggtgtttggagtgtctggagaggaggccagccgcttctttgctgtggagccagacaccggggtggtgtggctgcggcagcccctggaccgggagaccaagtctgagttcaccgtggagttctctgtgtctgaccaccagggcgtcatcaccaggaaggtgaacatccaggtgggagatgtgaatgacaatgcccccaccttccacaaccagccctacagcgtgcgcatccctgagaacacccctgtgggcacccccatcttcatcgtgaatgccacagatcctgacctgggcgccggcggctctgtgctgtacagcttccagccccccagccagttctttgccatcgacagcgcccggggcatcgtgaccgtcatccgggagctggactatgagaccacccaggcctaccagctgactgtgaatgccacagaccaggacaagacccggcccctgagcaccctggccaacctggccatcatcatcacagatgtgcaggacatggaccccatcttcatcaacctgccctacagcaccaacatctatgagcacagccccccaggcaccaccgtgcgcatcatcacagccatcgaccaggacaagggccggccccggggcatcggctacaccatcgtgtctggcaacaccaacagcatctttgccctggactacatcagcggcgtgctgaccctgaatggcctgctggaccgggagaaccccctgtacagccacggcttcatcctgactgtgaagggcacagagctgaatgatgacaggacccccagtgatgccaccgtgaccaccaccttcaacatcctggtgattgacatcaatgacaatgcccctgagttcaacagcagcgagtacagcgtggccatcacagagctggcccaggtgggctttgccctgcccctcttcatccaggtggtggacaaggatgagacctggggcctgaacagcatgtttgaggtgtacctggtgggcaacaacagccaccacttcatcatcagccccacctctgtgcagggcaaggctgacatccgcatccgggtggccatccccctggactatgaaacagtggacagatatgactttgacctgtttgccaatgaatctgtgcctgaccacgtgggctacgccaaggtgaagatcaccctcatcaatgaaaatgacaaccggcccatcttcagccagcccctgtacaacatcagcctgtatgaaaatgtgacagtgggcacctctgtgctgactgtgctggtgagcccccgcttcaccgctggccccctgagcagccctggccccaccgtggtgcgccaccctgagggcttctgcccccgggacctgagcaaccagggcagaagacacccccagatccctgagctgtgcctgctggtgtactag

SEQ ID NO: 145690 - DNA, 9960 bp, Artificial Sequence
  Description of Artificial Sequence: Synthetic coding sequence
atgggccgccacgtggccaccagctgccacgtggcctggctgctggtgctgatcagcggctgctggggccaggtgaaccggctgcccttcttcaccaaccacttctttgacacctacctgctgatcagcgaggacacccctgtgggcagctctgtgacccagctgctggcccaggacatggacaatgaccccctggtgtttggagtgtctggagaggaggccagccgcttctttgctgtggagccagacaccggggtggtgtggctgcggcagcccctggaccgggagaccaagtctgagttcaccgtggagttctctgtgtctgaccaccagggcgtcatcaccaggaaggtgaacatccaggtgggagatgtgaatgacaatgcccccaccttccacaaccagccctacagcgtgcgcatccctgagaacacccctgtgggcacccccatcttcatcgtgaatgccacagatcctgacctgggcgccggcggctctgtgctgtacagcttccagccccccagccagttctttgccatcgacagcgcccggggcatcgtgaccgtcatccgggagctggactatgagaccacccaggcctaccagctgactgtgaatgccacagaccaggacaagacccggcccctgagcaccctggccaacctggccatcatcatcacagatgtgcaggacatggaccccatcttcatcaacctgccctacagcaccaacatctatgagcacagccccccaggcaccaccgtgcgcatcatcacagccatcgaccaggacaagggccggccccggggcatcggctacaccatcgtgtctggcaacaccaacagcatctttgccctggactacatcagcggcgtgctgaccctgaatggcctgctggaccgggagaaccccctgtacagccacggcttcatcctgactgtgaagggcacagagctgaatgatgacaggacccccagtgatgccaccgtgaccaccaccttcaacatcctggtgattgacatcaatgacaatgcccctgagttcaacagcagcgagtacagcgtggccatcacagagctggcccaggtgggctttgccctgcccctcttcatccaggtggtggacaaggatgagacccagggcctgaacagcatgtttgaggtgtacctggtgggcaacaacagccaccacttcatcatcagccccacctctgtgcagggcaaggctgacatccgcatccgggtggccatccccctggactatgaaacagtggacagatatgactttgacctgtttgccaatgaatctgtgcctgaccacgtgggctacgccaaggtgaagatcaccctcatcaatgaaaatgacaaccggcccatcttcagccagcccctgtacaacatcagcctgtatgaaaatgtgacagtgggcacctctgtgctgactgtgctggccacagacaatgatgctggcaccttcggggaggtgtcctacttcttcagtgatgatcctgaccgcttcagcctggacaaggacaccggcctcatcatgctgattgcccggctggactatgagctgatccagcgcttcaccctgaccatcatcgccagagatggcggcggggaggagaccaccggccgggtgcgcatcaacgtgctggatgtgaatgacaacgtgcccaccttccagaaggatgcctacgtgggcgccctgcgggagaatgagcccagcgtgacccagctggtgcggctgcgggccacagatgaggacagcccccccaacaaccagatcacctacagcatcgtgtctgccagcgccttcggcagctactttgacatcagcctgtatgagggctacggcgtcatctctgtgtcccggcccctggactatgagcagatcagcaatggcctcatctacctgactgtgatggccatggatgctggcaacccccccctgaacagcacagtgcctgtgaccatcgaggtgtttgatgaaaatgacaacccccccaccttcagcaagccagcctactttgtgtctgtggtggagaacatcatggccggggccaccgtgctcttcctgaatgccacagacctggacaggagccgggagtatggccaggagagcatcatctacagcctggagggcagcacccagttccgcatcaatgcccggtctggagagatcaccaccaccagcctgctggaccgggagaccaagtctgagtacatcctgattgtgcgggctgtggatggcggcgtgggccacaaccagaagacaggaattgccaccgtgaacatcaccctgctggacatcaatgacaaccaccccacctggaaggatgccccctactacatcaacctggtggagatgaccccaccagacagtgatgtgaccaccgtggtggccgtggaccctgacctgggagaaaatggcaccctggtgtacagcatccagccccccaacaagttctacagcctgaacagcaccaccgggaagatccgcaccacccacgccatgctggacagagaaaatccagacccccatgaggccgagctgatgaggaagatcgtggtgtctgtgacagactgtggccggccccccctgaaggccaccagcagcgccaccgtgtttgtgaacctgctggacctgaatgacaatgaccccaccttccagaacctgccctttgtggccgaggtgctggagggcatcccagctggggtgtccatctaccaggtggtggccatcgacctggatgagggcctgaatggcctggtgtcctacaggatgcctgtgggcatgcccaggatggacttcctgatcaacagcagcagcggcgtggtggtgaccaccacagagctggaccgggagagaattgctgagtaccagctgcgggtggtggccagtgatgctggcacccccaccaagagcagcaccagcaccctgaccatccacgtgctggatgtgaatgatgagacccccaccttcttccctgctgtgtacaacgtgtctgtgtctgaagatgtgccccgggagttccgggtggtgtggctgaactgcacagacaatgatgtgggcctgaatgctgagctgagctacttcatcactggaggaaatgtggatggcaagttctctgtgggctacagagatgctgtggtgaggacagtggtgggcctggaccgggagaccacagctgcctacatgctgatcctggaggccatcgacaatggacctgtgggcaagaggcacactggaacagccaccgtgtttgtgacagtgctggatgtgaatgacaaccggcccatcttcctgcagagcagctatgaggcctctgtgcctgaggacatccctgagggccacagcatcctgcagctgaaggccacagatgctgatgaaggagaatttggccgggtgtggtaccgcatcctgcacggcaaccacggcaacaacttccgcatccacgtgtccaatggcctgctgatgaggggcccccggcccctggaccgggagaggaacagcagccacgtgctgattgtggaggcctacaaccacgacctgggccccatgaggagctctgtgcgggtgattgtgtatgtggaggacatcaatgatgaggcccctgtgttcacccagcagcagtacagccggctgggcctgcgggagacagctggcatcggcacctctgtgattgtggtgcaggccacagaccgggacagcggagatggcggcctggtgaactaccgcatcctgagcggggctgagggcaagtttgaaattgatgagagcacaggcctcatcatcaccgtgaactacctggactatgagaccaagaccagctacatgatgaatgtgtctgccacagaccaggccccacccttcaaccagggcttctgcagcgtgtacatcaccctgctgaatgagctggatgaggccgtgcagttcagcaatgccagctatgaggccgccatcctggagaacctggccctgggcacagagatcgtgcgggtgcaggcctacagcattgacaacctgaaccagatcacctaccgcttcaatgcctacaccagcacccaggccaaggccctcttcaagattgatgccatcaccggggtcatcaccgtgcagggcctggtggaccgggagaagggggacttctacaccctgactgtggtggctgatgatggcggccccaaggtggacagcacagtgcaggtgtacatcaccgtgctggatgaaaatgacaacagccccaggtttgacttcaccagtgacagcgctgtgtccatccctgaggactgccctgtgggccagagggtggccaccgtgaaggcctgggaccctgatgctggcagcaatggccaggtggtgttcagcctggccagcggcaacattgctggggcctttgaaattgtgaccaccaatgacagcatcggggaggtgtttgtggcccggcccctggaccgggaggagctggaccactacatcctgcaggtggtggccagtgaccggggcaccccacccaggaagaaggaccacatcctgcaggtgaccatcctggacatcaatgacaacccccctgtgattgagagccccttcggctacaacgtgtctgtgaatgaaaatgtgggcggcggcacagctgtggtgcaggtgcgggccacagaccgggacatcggcatcaacagcgtgctgagctactacatcacagagggcaacaaggacatggccttcaggatggaccgcatcagcggggagatcgccaccaggcctgcccccccagaccgggagcggcagagcttctaccacctggtggccaccgtggaggatgagggcacccccaccctgagcgccaccacccacgtgtatgtgaccatcgtggatgaaaatgacaatgcccccatgttccagcagccccactatgaggtgctgctggatgagggccctgacaccctgaacaccagcctcatcaccatccaggccctggacctggatgagggccccaatggaacagtgacctacgccatcgtggccggcaacatcgtgaacaccttcagaattgacagacacatgggcgtcatcacagctgccaaggagctggactatgagatcagccacggccgctacaccctcatcgtgacagccacagaccagtgccccatcctgagccaccggctgaccagcaccaccaccgtgctggtgaatgtgaatgacatcaatgacaacgtgcccaccttcccccgggactatgagggcccctttgaggtgacagagggccagcccggcccccgggtgtggaccttcctggcccatgaccgggacagcggccccaacggccaggtggagtacagcatcatggatggagaccccctgggggagtttgtgatcagccctgtggagggcgtgctgcgggtgaggaaggatgtggagctggaccgggagaccatcgccttctacaacctgaccatctgtgcccgggaccggggcatgccacccctgagcagcaccatgctggtgggcatccgggtgctggacatcaatgacaatgaccctgtgctgctgaacctgcccatgaacatcaccatcagcgagaacagccctgtgagcagctttgtggcccacgtgctggccagtgatgctgacagcggctgcaatgcccggctgaccttcaacatcacagctggcaaccgggagcgggccttcttcatcaatgccaccactggaattgtgacagtgaaccggcccctggaccgggagcgcatccctgagtacaagctgaccatctctgtgaaggacaaccctgagaaccccagaattgcccggcgggactatgacctgctgctgatcttcctgagtgatgaaaatgacaaccaccccctcttcaccaagagcacctaccaggccgaggtgatggagaacagccctgctggcacccccctgactgtgctgaatggccccatcctggccctggatgctgaccaggacatctatgctgtggtgacctaccagctgctgggcgcccagagcggcctgtttgacatcaacagcagcactggagtggtgacagtgcgctctggagtcatcatcgaccgggaggccttcagcccccccatcctggagctgctgctgctggccgaggacatcggcctgctgaacagcacagcccacctgctgatcaccatcctggatgacaatgacaaccggcccaccttctccccagccaccctgactgtgcacctgctggagaactgccccccaggcttctctgtgctgcaggtgacagccacagatgaggacagcggcctgaatggagagctggtgtaccgcatcgaggccggggcccaggaccgcttcctgatccacctggtgactggagtcatccgggtgggcaatgccaccatcgaccgggaggagcaggagagctaccgcctgactgtggtggccacagaccggggcaccgtgcccctgtctggaacagccatcgtgaccatcctgattgatgacatcaatgacagcaggcctgagttcctgaaccccatccagacagtgtctgtgctggagagcgctgagcccggcaccgtgattgccaacatcacagccatcgaccatgacctgaaccccaagctggagtaccacatcgtgggcatcgtggccaaggatgacacagaccggctggtgcccaaccaggaggatgcctttgctgtgaacatcaacacaggctctgtgatggtgaagagccccatgaaccgggagctggtggccacctatgaggtgaccctgtctgtgattgacaatgccagtgacctgcctgagaggtctgtgtctgtgcccaatgccaagctgactgtgaatgtgctggatgtgaatgacaacaccccccagttcaagcccttcggcatcacctactacatggagcgcatcctggagggcgccaccccaggcaccaccctgattgctgtggccgctgtggaccctgacaagggcctgaatggcctggtgacctacaccctgctggacctggtgcccccaggctacgtgcagctggaggacagcagcgctgggaaggtgattgccaacagaacagtggactatgaggaggtgcactggctgaacttcaccgtgcgggccagtgacaatggcagcccccccagggctgctgagatccctgtgtacctggagatcgtggacatcaatgacaacaaccccatctttgaccagcccagctaccaggaggccgtgtttgaagatgtgcctgtgggcaccatcatcctgactgtgacagccacagatgctgacagcggcaactttgccctgattgagtacagcctgggagatggagagagcaagtttgccatcaaccccaccaccggggacatctacgtgctgagcagcctggaccgggagaagaaggaccactacatcctgacagccctggccaaggacaaccctggagatgtggccagcaacagaagagagaacagcgtgcaggtggtgatccaggtgctggatgtgaatgactgccggccccagttcagcaagccccagttcagcacctctgtgtatgaaaatgaacctgctggcaccagcgtcatcaccatgatggccacagaccaggatgagggccccaatggagagctgacctacagcctggagggccctggggtggaggccttccacgtggacatggacagcggcctggtgaccacccagaggcccctgcagagctatgagaagttcagcctgactgtggtggccacagatggaggagagccccccctgtggggcaccaccatgctgctggtggaggtgattgatgtgaatgacaacagacctgtgtttgtgcggccccccaacggcaccatcctgcacatccgggaggagatccccctgcggagcaatgtgtatgaggtgtatgccacagacaaggatgagggcctgaatggagctgtgcgctacagcttcctgaagacagctggcaacagagactgggagttcttcatcatcgaccccatcagcggcctcatccagacagcccagaggctggaccgggagagccaggccgtgtacagcctcatcctggtggccagtgacctgggccagcctgtgccctatgagaccatgcagcccctgcaggtggccctggaggacattgatgacaatgagcccctgtttgtgcggccccccaagggcagcccccagtaccagctgctgactgtgcctgagcacagcccccggggcaccctggtgggcaatgtgactggagctgtggatgctgatgagggccccaatgccatcgtgtactacttcatcgctgctggaaatgaggagaagaacttccacctgcagccagatggctgcctgctggtgctgcgggacctggaccgggagcgggaggccatcttctccttcatcgtgaaggccagcagcaacagatcctggaccccaccccggggccccagccccaccctggacctggtggccgacctgaccctgcaggaggtgcgggtggtgctggaggacatcaatgaccagcccccacgcttcaccaaggccgagtacacagctggggtggccacagatgccaaggtgggcagcgagctgatccaggtgctggccctggatgctgacatcggcaacaacagcctggtgttctacagcatcctggccatccactacttccgggccctggccaatgacagtgaagatgtgggccaggtgttcaccatgggctccatggatggcatcctgcggacctttgacctcttcatggcctacagccctggctactttgtggtggacatcgtggcccgggacctggccggccacaatgacacagccatcatcggcatctacatcctgagagatgaccagagggtgaagatcgtcatcaatgagatcccagacagagtgcggggctttgaggaggagttcatccacctgctgagcaacatcactggagccatcgtgaacacagacaacgtgcagttccacgtggacaagaagggccgggtgaactttgcccagacagagctgctgatccacgtggtgaacagagacaccaaccgcatcctggatgtggacagagtcatccagatgattgatgagaacaaggagcagctgaggaacctcttcaggaactacaacgtgctggatgtgcagcctgccatctctgtgcggctgcctgatgacatgtctgccctgcagatggccatcatcgtgctggccatcctgctcttcctggccgccatgctgtttgtgctgatgaactggtactacagaacagtgcacaagaggaagctgaaggccatcgtggccggcagcgctggcaacagaggcttcatcgacatcatggacatgcccaacaccaacaagtacagctttgatggagccaaccctgtgtggctggaccccttctgcaggaacctggagctggccgcccaggccgagcatgaagatgacctgcctgagaacctgtctgaaattgctgacctgtggaacagccccaccaggacccacggcaccttcggccgggagcctgctgctgtgaagccagatgatgaccgctacctgcgggccgccatccaggagtatgacaacatcgccaagctgggccagatcatccgggagggccccatcaagctgatccagacagagctggatgaggagcccggggaccacagccctggccagggcagcctgcgcttccgccacaagccccctgtggagctgaagggcccagatggcatccacgtggtgcacggcagcacaggcaccctgctggccacagacctgaacagcctgcctgaggaggaccagaagggcctgggccgcagcctggagaccctgacagctgctgaggccacagcctttgaaagaaatgccaggacagagagcgccaagagcacccccctgcacaagctgagagatgtgatcatggagacccccctggagatcacagagctgtag

SEQ ID NO: 145691 - DNA, 10080 bp, Artificial Sequence
  Description of Artificial Sequence: Synthetic coding sequence
atgggccgccacgtggccaccagctgccacgtggcctggctgctggtgctgatcagcggctgctggggccaggtgaaccggctgcccttcttcaccaaccacttctttgacacctacctgctgatcagcgaggacacccctgtgggcagctctgtgacccagctgctggcccaggacatggacaatgaccccctggtgtttggagtgtctggagaggaggccagccgcttctttgctgtggagccagacaccggggtggtgtggctgcggcagcccctggaccgggagaccaagtctgagttcaccgtggagttctctgtgtctgaccaccagggcgtcatcaccaggaaggtgaacatccaggtgggagatgtgaatgacaatgcccccaccttccacaaccagccctacagcgtgcgcatccctgaggtgggcgccactggaaacacccctgtgggcacccccatcttcatcgtgaatgccacagatcctgacctgggcgctgggggctctgtgctgtacagcttccagccccccagccagttctttgccattgattctgcccggggcatcgtgaccgtcatccgggagctggactatgagaccacccaggcctaccagctgactgtgaatgccacagaccaggacaagacccggcccctgagcaccctggccaacctggccatcatcatcacagatgtgcaggacatggaccccatcttcatcaacctgccctacagcaccaacatctatgagcacagccccccaggcaccaccgtgcgcatcatcacagccatcgaccaggacaagggccggccccggggcatcggctacaccatcgtgtctgtggccggcaacaccaacagcatctttgccctggactacatctctggagtgctgaccctgaatggcctgctggaccgggagaaccccctgtacagccacggcttcatcctgactgtgaagggcacagagctgaatgatgacaggacccccagtgatgccaccgtgaccaccaccttcaacatcctggtgattgacatcaatgacaatgcccctgagttcaacagcagcgagtacagcgtggccatcacagagctggcccaggtgggctttgccctgcccctcttcatccaggtggtggacaaggatgagggcctgaacagcatgtttgaggtgtacctggtgggcaacaacagccaccacttcatcatcagccccacctctgtgcagggcaaggctgacatccgcatccgggtggccatccccctggactatgagaccgtggacagatatgactttgacctgtttgccaatgaatctgtgcctgaccacgtgggctacgccaaggtgaagatcaccctcatcaatgaaaatgacaaccggcccatcttcagccagcccctgtacaacatcagcctgtatgaaaatgtgacagtgggcacctctgtgctgactgtgctggccacagacaatgatgctggcacctttggagaggtgtcctacttcttcagtgatgatcctgaccgcttcagcctggacaaggacaccggcctcatcatgctgattgcccggctggactatgagctgatccagcgcttcaccctgaccatcatcgccagagatggcggcggggaggagaccaccggccgggtgcgcatcaacgtgctggatgtgaatgacaacgtgcccaccttccagaaggatgcctacgtgggcgccctgagagaaaatgagcccagcgtgacccagctggtgcggctgcgggccacagatgaggacagcccccccaacaaccagatcacctacagcatcgtgtctgccagcgccttcggcagctactttgacatcagcctgtatgagggctatggagtcatctctgtgtcccggcccctggactatgagcagatcagcaatggcctcatctacctgactgtgatggccatggatgctggcaacccccccctgaacagcacagtgcctgtgaccatcgaggtgtttgatgaaaatgacaacccccccaccttcagcaagccagcctactttgtgtctgtggtggagaacatcatggccggggccaccgtgctcttcctgaatgccacagacctggacaggagccgggagtatggccaggagagcatcatctacagcctggagggcagcacccagttccgcatcaatgcccggagcggggagatcaccaccaccagcctgctggaccgggagaccaagtctgagtacatcctgattgtgcgggctgtggatggaggagtgggccacaaccagaagacaggcatcgccaccgtgaacatcaccctgctggacatcaatgacaaccaccccacctggaaggatgccccctactacatcaacctggtggagatgaccccaccagacagtgatgtgaccaccgtggtggccgtggaccctgacctgggggagaatggcaccctggtgtacagcatccagccccccaacaagttctacagcctgaacagcaccaccgggaagatccgcaccacccacgccatgctggaccgggagaacccagacccccatgaagctgagctgatgaggaagatcgtggtgtctgtgacagactgtggccggccccccctgaaggccaccagcagcgccaccgtgtttgtgaacctgctggacctgaatgacaatgaccccaccttccagaacctgccctttgtggccgaggtgctggagggcatcccagctggggtgtccatctaccaggtggtggccatcgacctggatgagggcctgaatggcctggtgtcctacaggatgcctgtgggcatgcccaggatggacttcctgatcaacagcagcagtggagtggtggtgaccaccacagagctggaccgggagagaattgctgagtaccagctgcgggtggtggccagtgatgctggcacccccaccaagagcagcaccagcaccctgaccatccacgtgctggatgtgaatgatgagacccccaccttcttccctgctgtgtacaacgtgtctgtgtctgaagatgtgccccgggagttccgggtggtgtggctgaactgcacagacaatgatgtgggcctgaatgctgagctgagctacttcatcaccggcggcaatgtggatggcaagttctctgtgggctacagagatgctgtggtgaggacagtggtgggcctggaccgggagaccacagctgcctacatgctgatcctggaggccatcgacaatggacctgtgggcaagaggcacactggaacagccaccgtgtttgtgacagtgctggatgtgaatgacaaccggcccatcttcctgcagagcagctatgaggcctctgtgcctgaggacatccctgagggccacagcatcctgcagctgaaggccacagatgctgatgaaggagaatttggccgggtgtggtaccgcatcctgcacggcaaccacggcaacaacttccgcatccacgtgtccaatggcctgctgatgaggggcccccggcccctggaccgggagaggaacagcagccacgtgctgattgtggaggcctacaaccacgacctgggccccatgaggagctctgtgcgggtcatcgtgtatgtggaggacatcaatgatgaggcccctgtgttcacccagcagcagtacagccggctgggcctgcgggagacagctggcatcggcaccagcgtcatcgtggtgcaggccacagaccgggacagcggagatggcggcctggtgaactaccgcatcctgtctggagctgagggcaagtttgaaattgatgagagcacaggcctcatcatcaccgtgaactacctggactatgagaccaagaccagctacatgatgaatgtgtctgccacagaccaggccccacccttcaaccagggcttctgcagcgtgtacatcaccctgctgaatgagctggatgaagctgtgcagttcagcaatgccagctatgaagctgccatcctggagaacctggccctgggcacagaaattgtgcgggtgcaggcctacagcattgacaacctgaaccagatcacctaccgcttcaatgcctacaccagcacccaggccaaggccctcttcaagattgatgccatcactggagtcatcaccgtgcagggcctggtggaccgggagaagggggacttctacaccctgactgtggtggctgatgatggcggccccaaggtggacagcacagtgcaggtgtacatcaccgtgctggatgaaaatgacaacagccccaggtttgacttcaccagtgacagcgctgtgtccatccctgaggactgccctgtgggccagagggtggccaccgtgaaggcctgggaccctgatgctggcagcaatggccaggtggtgttcagcctggccagcggcaacattgctggggcctttgagatcgtgaccaccaatgacagcattggagaggtgtttgtggcccggcccctggaccgggaggagctggaccactacatcctgcaggtggtggccagtgaccggggcaccccacccaggaagaaggaccacatcctgcaggtgaccatcctggacatcaatgacaacccccctgtgattgagagccccttcggctacaacgtgtctgtgaatgaaaatgtgggcggcggcacagctgtggtgcaggtgcgggccacagaccgggacatcggcatcaacagcgtgctgagctactacatcacagagggcaacaaggacatggccttcaggatggaccgcatctctggagagatcgccaccaggcctgcccccccagaccgggagcggcagagcttctaccacctggtggccaccgtggaggatgagggcacccccaccctgagcgccaccacccacgtgtatgtgaccatcgtggatgaaaatgacaatgcccccatgttccagcagccccactatgaggtgctgctggatgagggccctgacaccctgaacaccagcctcatcaccatccaggccctggacctggatgagggccccaacggcaccgtgacctacgccatcgtggccggcaacatcgtgaacaccttcagaattgacagacacatgggcgtcatcacagctgccaaggagctggactatgagatcagccacggccgctacaccctgattgtgacagccacagaccagtgccccatcctgagccaccggctgaccagcaccaccaccgtgctggtgaatgtgaatgacatcaatgacaacgtgcccaccttcccccgggactatgagggcccctttgaggtgacagagggccagcccggcccccgggtgtggaccttcctggcccatgaccgggacagcggccccaacggccaggtggagtacagcatcatggatggagaccccctgggggagtttgtgatcagccctgtggagggcgtgctgcgggtgaggaaggatgtggagctggaccgggagaccatcgccttctacaacctgaccatctgtgcccgggaccggggcatgccacccctgagcagcaccatgctggtgggcatccgggtgctggacatcaatgacaatgaccctgtgctgctgaacctgcccatgaacatcaccatcagcgagaacagccctgtgtcctcctttgtggcccacgtgctggccagtgatgctgacagcggctgcaatgcccggctgaccttcaacatcacagctggcaaccgggagcgggccttcttcatcaatgccaccaccggcatcgtgacagtgaaccggcccctggaccgggagcgcatccctgagtacaagctgaccatctctgtgaaggacaaccctgagaacccccgcatcgcccggcgggactatgacctgctgctgatcttcctgagtgatgaaaatgacaaccaccccctcttcaccaagagcacctaccaggccgaggtgatggagaacagccctgctggcacccccctgactgtgctgaatggccccatcctggccctggatgctgaccaggacatctatgctgtggtgacctaccagctgctgggcgcccagagcggcctgtttgacatcaacagcagcactggagtggtgacagtgcgcagcggggtcatcatcgaccgggaggccttcagcccccccatcctggagctgctgctgctggctgaagatattggcctgctgaacagcacagcccacctgctgatcaccatcctggatgacaatgacaaccggcccaccttcagccctgccaccctgactgtgcacctgctggagaactgccccccaggcttctctgtgctgcaggtgacagccacagatgaagattctggcctgaatggagagctggtgtacagaattgaagctggggcccaggaccgcttcctgatccacctggtgactggagtcatccgggtgggcaatgccaccatcgaccgggaggagcaggagagctaccgcctgactgtggtggccacagaccggggcaccgtgcccctgagcggcacagccatcgtgaccatcctgattgatgacatcaatgacagcaggcctgagttcctgaaccccatccagacagtgtctgtgctggagagcgctgagcccggcaccgtcatcgccaacatcacagccatcgaccatgacctgaaccccaagctggagtaccacatcgtgggcatcgtggccaaggatgacacagaccggctggtgcccaaccaggaggatgcctttgctgtgaacatcaacacaggctctgtgatggtgaagagccccatgaaccgggagctggtggccacctatgaggtgaccctgagcgtcatcgacaatgccagtgacctgcctgagaggtctgtgtctgtgcccaatgccaagctgactgtgaatgtgctggatgtgaatgacaacaccccccagttcaagcccttcggcatcacctactacatggagcgcatcctggagggcgccaccccaggcaccaccctgattgctgtggccgctgtggaccctgacaagggcctgaatggcctggtgacctacaccctgctggacctggtgcccccaggctacgtgcagctggaggacagcagcgctgggaaggtgattgccaacagaacagtggactatgaggaggtgcactggctgaacttcaccgtgcgggccagtgacaatggcagcccccccagggctgctgagatccctgtgtacctggagatcgtggacatcaatgacaacaaccccatctttgaccagcccagctaccaggaggccgtgtttgaagatgtgcctgtgggcaccatcatcctgactgtgacagccacagatgctgacagcggcaactttgccctgattgagtacagcctgggagatggagagagcaagtttgccatcaaccccaccactggagacatctacgtgctgagcagcctggaccgggagaagaaggaccactacatcctgacagccctggccaaggacaaccctggagatgtggccagcaacagaagagaaaattctgtgcaggtggtgatccaggtgctggatgtgaatgactgccggccccagttcagcaagccccagttcagcacctctgtgtatgaaaatgaacctgctggcaccagcgtcatcaccatgatggccacagaccaggatgagggccccaacggggagctgacctacagcctggagggccctggggtggaggccttccacgtggacatggattctggcctggtgaccacccagaggcccctgcagagctatgagaagttcagcctgactgtggtggccacagatggaggagagccccccctgtggggcaccaccatgctgctggtggaggtgattgatgtgaatgacaacagacctgtgtttgtgcggcccccaaatggcaccatcctgcacatccgggaggagatccccctgcggagcaatgtgtatgaggtgtatgccacagacaaggatgagggcctgaatggagctgtgcgctacagcttcctgaagacagctggcaacagagactgggagttcttcatcatcgaccccatcagcggcctcatccagacagcccagaggctggaccgggagagccaggccgtgtacagcctcatcctggtggccagtgacctgggccagcctgtgccctatgagaccatgcagcccctgcaggtggccctggaggacattgatgacaatgagcccctgtttgtgcggccccccaagggcagcccccagtaccagctgctgactgtgcctgagcacagcccccggggcaccctggtgggcaatgtgactggagctgtggatgctgatgagggccccaatgccatcgtgtactacttcatcgctgctggaaatgaggagaagaacttccacctgcagccagatggctgcctgctggtgctgcgggacctggaccgggagcgggaggccatcttctccttcatcgtgaaggccagcagcaacagatcctggaccccaccccggggccccagccccaccctggacctggtggccgacctgaccctgcaggaggtgcgggtggtgctggaggacatcaatgaccagcccccacgcttcaccaaggccgagtacacagctggggtggccacagatgccaaggtgggcagcgagctgatccaggtgctggccctggatgctgacatcggcaacaacagcctggtgttctacagcatcctggccatccactacttccgggccctggccaatgattctgaagatgtgggccaggtgttcaccatgggctccatggatggcatcctgcggacctttgacctcttcatggcctacagccctggctactttgtggtggacatcgtggcccgggacctggccggccacaatgacacagccatcatcggcatctacatcctgagagatgaccagagggtgaagatcgtcatcaatgagatcccagacagagtgcggggctttgaggaggagttcatccacctgctgagcaacatcaccggggccatcgtgaacacagacaacgtgcagttccacgtggacaagaagggccgggtgaactttgcccagacagagctgctgattcatgtggtgaacagagacaccaaccgcatcctggatgtggacagagtcatccagatgattgatgagaacaaggagcagctgaggaacctcttcaggaactacaacgtgctggatgtgcagcctgccatctctgtgcggctgcctgatgacatgtctgccctgcagatggccatcatcgtgctggccatcctgctcttcctggccgccatgctgtttgtgctgatgaactggtactacagaacagtgcacaagaggaagctgaaggccatcgtggccggcagcgctggcaacagaggcttcatcgacatcatggacatgcccaacaccaacaagtacagctttgatggagccaaccctgtgtggctggaccccttctgcaggaacctggagctggccgcccaggccgagcatgaagatgacctgcctgagaacctgtctgaaattgctgacctgtggaacagccccaccaggacccacggcaccttcggccgggagcctgctgctgtgaagccagatgatgaccgctacctgcgggccgccatccaggagtatgacaacatcgccaagctgggccagatcatccgggagggccccatcaagggcagcctgctgaaggtggtgctggaggactacctgcggctgaagaagctgtttgcccagaggatggtgcagaaggccagcagctgccacagcagcatcagcgagctgatccagacagagctggatgaggagcccggggaccacagccctggccagggcagcctgcgcttccgccacaagccccctgtggagctgaagggcccagatggcatccacgtggtgcacggcagcacaggcaccctgctggccacagacctgaacagcctgcctgaggaggaccagaagggcctgggccgcagcctggagaccctgacagctgctgaggccacagcctttgaaagaaatgccaggacagagagcgccaagagcacccccctgcacaagctgagagatgtgatcatggagacccccctggagatcacagagctgtag

SEQ ID NO: 145692 - DNA, 1338 bp, Artificial Sequence
  Description of Artificial Sequence: Synthetic coding sequence
atggacaatgaccccctggtgtttggagtgtctggagaggaggccagccgcttctttgctgtggagccagacacaggagtggtgtggctgcggcagcccctggaccgggagaccaagtctgagttcaccgtggagttctctgtgtctgaccaccagggcgtcatcaccaggaaggtgaacatccaggtgggagatgtgaatgacaatgcccccaccttccacaaccagccctacagcgtgcgcatccctgagaacacccctgtgggcacccccatcttcatcgtgaatgccacagatcctgacctgggcgctgggggctctgtgctgtacagcttccagccccccagccagttctttgccattgattctgcccggggcatcgtgaccgtcatccgggagctggactatgagaccacccaggcctaccagctgactgtgaatgccctggccatcatcatcaccaacctgccctacagcaccaacatctatgagcacagccccccaggcaccaccgtgcgcatcatcacagccatcgaccaggacaagggccggccccggggcatcggctacaccatcgtgtctggcaacaccaacagcatctttgccctggactacatctctggagtgctgaccctgaatggcctgctggaccgggagaaccccctgtacagccacggcttcatcctgactgtgaagggcacagagctgaatgatgacaggacccccagtgatgccaccgtgaccaccaccttcaacatcctggtgattgacatcaatgacaatgcccctgagttcaacagcagcgagtacagcgtggccatcacagagctggcccaggtgggctttgccctgcccctcttcatccaggtggtggacaaggatgagggcctgaacagcatgtttgaggtgtacctggtgggcaacaacagccaccacttcatcatcagccccacctctgtgcagggcaaggctgacatccgcatccgggtggccatccccctggactatgagaccgtggacagatatgactttgacctgtttgccaatgaatctgtgcctgaccacgtgggctacgccaaggtgaagatcaccctcatcaatgaaaatgacaaccggcccatcttcagccagcccctgtacaacatcagcctgtatgaaaatgtgacagtgggcacctctgtgctgactgtgctggtgagcccccgcttcaccgctggccccctgagcagccctggccccaccgtggtgcgccaccctgagggcttctgcccccgggacctgagcaaccagggccgccgccacccccagatccctgagctgtgcctgctggtgtactag

SEQ ID NO: 145693 - DNA, 2187 bp, Artificial Sequence
  Description of Artificial Sequence: Synthetic coding sequence
gccacagacaatgatgctggcacctttggagaggtgtcctacttcttcagtgatgatcctgaccgcttcagcctggacaaggacaccggcctcatcatgctgattgcccggctggactatgagctgatccagcgcttcaccctgaccatcatcgccagagatggcggcggggaggagaccaccggccgggtgcgcatcaacgtgctggatgtgaatgacaacgtgcccaccttccagaaggatgcctacgtgggcgccctgagagaaaatgagcccagcgtgacccagctggtgcggctgcgggccacagatgaggacagcccccccaacaaccagatcacctacagcatcgtgtctgccagcgccttcggcagctactttgacatcagcctgtatgagggctatggagtcatctctgtgtcccggcccctggactatgagcagatcagcaatggcctcatctacctgactgtgatggccatggatgctggcaacccccccctgaacagcacagtgcctgtgaccatcgaggtgtttgatgaaaatgacaacccccccaccttcagcaagccagcctactttgtgtctgtggtggagaacatcatggccggggccaccgtgctcttcctgaatgccacagacctggacaggagccgggagtatggccaggagagcatcatctacagcctggagggcagcacccagttccgcatcaatgcccggagcggggagatcaccaccaccagcctgctggaccgggagaccaagtctgagtacatcctgattgtgcgggctgtggatggaggagtgggccacaaccagaagacaggcatcgccaccgtgaacatcaccctgctggacatcaatgacaaccaccccacctggaaggatgccccctactacatcaacctggtggagatgaccccaccagacagtgatgtgaccaccgtggtggccgtggaccctgacctgggggagaatggcaccctggtgtacagcatccagccccccaacaagttctacagcctgaacagcaccaccgggaagatccgcaccacccacgccatgctggaccgggagaacccagacccccatgaagctgagctgatgaggaagatcgtggtgtctgtgacagactgtggccggccccccctgaaggccaccagcagcgccaccgtgtttgtgaacctgctggacctgaatgacaatgaccccaccttccagaacctgccctttgtggccgaggtgctggagggcatcccagctggggtgtccatctaccaggtggtggccatcgacctggatgagggcctgaatggcctggtgtcctacaggatgcctgtgggcatgcccaggatggacttcctgatcaacagcagcagtggagtggtggtgaccaccacagagctggaccgggagagaattgctgagtaccagctgcgggtggtggccagtgatgctggcacccccaccaagagcagcaccagcaccctgaccatccacgtgctggatgtgaatgatgagacccccaccttcttccctgctgtgtacaacgtgtctgtgtctgaagatgtgccccgggagttccgggtggtgtggctgaactgcacagacaatgatgtgggcctgaatgctgagctgagctacttcatcaccggcggcaatgtggatggcaagttctctgtgggctacagagatgctgtggtgaggacagtggtgggcctggaccgggagaccacagctgcctacatgctgatcctggaggccatcgacaatggacctgtgggcaagaggcacactggaacagccaccgtgtttgtgacagtgctggatgtgaatgacaaccggcccatcttcctgcagagcagctatgaggcctctgtgcctgaggacatccctgagggccacagcatcctgcaggaggacctggccagcccctgcatcagccctgccccaccccggcgggccttccagagcagcggggagaaggagaccagccagtttcctgggaaggagctgcggcgggagcccggccccagcaaggcccagaacagagctgccttcacagagcccctggccgaggcccccctgctgggcagcaagcaggcccaggaggagcgggcccccctgccccgggagcaggcccagcagctgcagggcagcgagggggagaagggcggcccctag

SEQ ID NO: 145694 - DNA, 2238 bp, Artificial Sequence
  Description of Artificial Sequence: Synthetic coding sequence
atgaggcgctgccgctgggccgccctggccctgggcctgctgcggctgtgcctggcccaggccaactttgccccccacttctttgacaacggggtgggcagcaccaacggcaacatggccctcttcagcctgcctgaggacacccctgtgggcagccacgtgtacaccctgaatggaacagatcctgagggggaccccatctcctaccacatcagctttgaccccagcaccaggtctgtgttttctgtggaccccacctttggaaacatcaccctggtggaggagctggaccgggagagagaagatgaaattgaggccatcatcagcatcagtgatggcctgaacctggtggccgagaaggtggtgatcctggtgacagatgccaatgatgaggccccccgcttcatccaggagccctacgtggccctggtgcctgaggacatcccagctggcagcatcatcttcaaggtgcatgctgtggaccgggacaccggcagcggcggctctgtgacctacttcctgcagaacctgcacagcccctttgctgtggacagacattctggagtgctgcggctgcaggccggggccaccctggactatgaaagaagcaggacccactacatcaccgtggtggccaaggatggcggcggccgcctgcacggggctgatgtggtgttttctgccaccaccaccgtgacagtgaatgtggaggatgtgcaggacatggcccctgtgtttgtgggcaccccctactacggctacgtgtatgaggacaccctgcccggcagcgaggtgctgaaggtggtggccatggatggagaccggggcaagcccaaccgcatcctgtacagcctggtgaatggaaatgatggagcctttgagatcaatgagaccagcggggccatcagcatcacccagagccctgcccagctgcagcgggaggtgtatgagctgcacgtgcaggtgacagagatgagccctgctggcagccctgctgcccaggccaccgtgcctgtgaccatcagaattgtggacctgaacaaccacccccccaccttctacggggagagcggcccccagaacagatttgagctgtccatgaatgagcaccccccccagggcgagatcctgcggggcctgaagatcaccgtgaatgacagcgaccagggcgccaatgccaagttcaacctgcagctggtgggcccccggggcatcttccgggtggtgccccagacagtgctgaatgaggcccaggtgaccatcatcgtggagaacagcgctgccatcgactttgagaagagcaaggtgctgaccttcaagctgctggccgtggaggtgaacaccccagagaagttcagcagcacagcagatgtggtgatccagctgctggacaccaatgacaacgtgcccaagtttgacagcctgtactacgtggcccgcatcccagaaaatgcccctgggggcagctctgtggtggccgtgacagctgtggaccctgacaccggcccctggggcgaggtgaagtacagcacctacggcaccggggctgacctcttcctgatccaccccagcacaggcctcatctacacccagccctgggccagcctggatgctgaggccacagcccgctacaacttctacgtgaaggccgaggacatggagggcaagtacagcgtggccgaggtgttcatcaccctgctggatgtgaatgaccaccccccccagtttgggaagtctgtgcagaagaagaccatggtgctgggcacccctgtgaagattgaggccattgatgaagatgctgaggagcccaacaacctggtggactacagcatcacccacgccgagcccgccaacgtgtttgacatcaacagccacactggagagatctggctgaagaacagcatccgcagcctggatgccctgcacaacatcaccccaggccgggactgcctgtggagcctggaggtgcaggccaaggaccggggcagccccagcttcagcaccacagccctgctgaagattgacatcacagatgctgaggtgcggcggctgcgctacatgaagaacagcaacttccctggcaccaccaagtctgtgaggaagcccaagttcaagcccaagaagccccacagcagccagggcctcttcctgcacccccactgtgaaattgccctcttcaacctgagcaatgtgaacctgtacagcagggtcttccagggcgccgcccaggccagctag

SEQ ID NO: 145695 - DNA, 2580 bp, Artificial Sequence
  Description of Artificial Sequence: Synthetic coding sequence
atgaggcgctgccgctgggccgccctggccctgggcctgctgcggctgtgcctggcccaggccaactttgccccccacttctttgacaacggggtgggcagcaccaacggcaacatggccctcttcagcctgcctgaggacacccctgtgggcagccacgtgtacaccctgaatggaacagatcctgagggggaccccatctcctaccacatcagctttgaccccagcaccaggtctgtgttttctgtggaccccacctttggaaacatcaccctggtggaggagctggaccgggagagagaagatgaaattgaggccatcatcagcatcagtgatggcctgaacctggtggccgagaaggtggtgatcctggtgacagatgccaatgatgaggccccccgcttcatccaggagccctacgtggccctggtgcctgaggacatcccagctggcagcatcatcttcaaggtgcatgctgtggaccgggacaccggcagcggcggctctgtgacctacttcctgcagaacctgcacagcccctttgctgtggacagacattctggagtgctgcggctgcaggccggggccaccctggactatgaaagaagcaggacccactacatcaccgtggtggccaaggatggcggcggccgcctgcacggggctgatgtggtgttttctgccaccaccaccgtgacagtgaatgtggaggatgtgcaggacatggcccctgtgtttgtgggcaccccctactacggctacgtgtatgaggacaccctgcccggcagcgaggtgctgaaggtggtggccatggatggagaccggggcaagcccaaccgcatcctgtacagcctggtgaatggaaatgatggagcctttgagatcaatgagaccagcggggccatcagcatcacccagagccctgcccagctgcagcgggaggtgtatgagctgcacgtgcaggtgacagagatgagccctgctggcagccctgctgcccaggccaccgtgcctgtgaccatcagaattgtggacctgaacaaccacccccccaccttctacggggagagcggcccccagaacagatttgagctgtccatgaatgagcaccccccccagggcgagatcctgcggggcctgaagatcaccgtgaatgacagcgaccagggcgccaatgccaagttcaacctgcagctggtgggcccccggggcatcttccgggtggtgccccagacagtgctgaatgaggcccaggtgaccatcatcgtggagaacagcgctgccatcgactttgagaagagcaaggtgctgaccttcaagctgctggccgtggaggtgaacaccccagagaagttcagcagcacagcagatgtggtgatccagctgctggacaccaatgacaacgtgcccaagtttgacagcctgtactacgtggcccgcatcccagaaaatgcccctgggggcagctctgtggtggccgtgacagctgtggaccctgacaccggcccctggggcgaggtgaagtacagcacctacggcaccggggctgacctcttcctgatccaccccagcacaggcctcatctacacccagccctgggccagcctggatgctgaggccacagcccgctacaacttctacgtgaaggccgaggacatggagggcaagtacagcgtggccgaggtgttcatcaccctgctggatgtgaatgaccaccccccccagtttgggaagtctgtgcagaagaagaccatggtgctgggcacccctgtgaagattgaggccattgatgaagatgctgaggagcccaacaacctggtggactacagcatcacccacgccgagcccgccaacgtgtttgacatcaacagccacactggagagatctggctgaagaacagcatccgcagcctggatgccctgcacaacatcaccccaggccgggactgcctgtggagcctggaggtgcaggccaaggaccggggcagccccagcttcagcaccacagccctgctgaagattgacatcacagatgctgagaccctgagccgcagccccatggccgccttcctgatccagaccaaggacaaccccatgaaggctgtgggcgtgctggccggcaccatggccaccgtggtggccatcaccgtgctgatcagcacagccaccttctggaggaacaagaagagcaacaaggtgctgcccatgagaagagtgctgaggaagaggcccagccctgcccccaggaccatcagaattgagtggctgaagagcaagagcaccaaggccgccaccaagttcatgctgaaggagaagcccccaaatgaaaactgcaacaacaacagccctgagagcagcctgctgccccgggccccagccctgcccccacctccttctgtggcccccagcactggagctgcccagtggacagtgcccaccgtgtctggcagcctgaccccccagcccacccagcccccacccaagcccaagaccatgggcagccctgtgcagagcaccctcatcagcgagctgaagcagaagtttgagaagaagtctgtgcacaacaaggcctacttctag

SEQ ID NO: 145696 - DNA, 1692 bp, Artificial Sequence
  Description of Artificial Sequence: Synthetic coding sequence
atggcccctgtgtttgtgggcaccccctactacggctacgtgtatgaggacaccctgcccggcagcgaggtgctgaaggtggtggccatggatggagaccggggcaagcccaaccgcatcctgtacagcctggtgaatggaaatgatggagcctttgagatcaatgagaccagcggggccatcagcatcacccagagccctgcccagctgcagcgggaggtgtatgagctgcacgtgcaggtgacagagatgagccctgctggcagccctgctgcccaggccaccgtgcctgtgaccatccgcatcgtggacctgaacaaccacccccccaccttctatggagagagcggcccccagaacagatttgagctgtccatgaatgagcaccccccccagggcgagatcctgcggggcctgaagatcaccgtgaatgacagcgaccagggcgccaatgccaagttcaacctgcagctggtgggcccccggggcatcttccgggtggtgccccagacagtgctgaatgaggcccaggtgaccatcatcgtggagaacagcgctgccatcgactttgagaagagcaaggtgctgaccttcaaggctgtggaccctgacaccggcccctggggcgaggtgaagtacagcacctacggcaccggggctgacctcttcctgatccaccccagcacaggcctcatctacacccagccctgggccagcctggatgctgaggccacagcccgctacaacttctacgtgaaggccgaggacatggagggcaagtacagcgtggccgaggtgttcatcaccctgctggatgtgaatgaccaccccccccagtttgggaagtctgtgcagaagaagaccatggtgctgggcacccctgtgaagattgaggccattgatgaagatgctgaggagcccaacaacctggtggactacagcatcacccacgccgagcccgccaacgtgtttgacatcaacagccacactggagagatctggctgaagaacagcatccgcagcctggatgccctgcacaacatcaccccaggccgggactgcctgtggagcctggaggtgcaggccaaggaccggggcagccccagcttcagcaccacagccctgctgaagattgacatcacagatgctgagaccctgagccgcagccccatggccgccttcctgatccagaccaaggacaaccccatgaaggctgtgggcgtgctggccggcaccatggccaccgtggtggccatcaccgtgctgatcagcacagccaccttctggaggaacaagaagagcaacaaggtgctgcccatgagaagagtgctgaggaagaggcccagccctgcccccaggaccatcagaattgagtggctgaagagcaagagcaccaaggccgccaccaagttcatgctgaaggagaagcccccaaatgaaaactgcaacaacaacagccctgagagcagcctgctgccccgggccccagccctgcccccacctccttctgtggcccccagcactggagctgcccagtggacagtgcccaccgtgtctggcagcctgaccccccagcccacccagcccccacccaagcccaagaccatgggcagccctgtgcagagcaccctcatcagcgagctgaagcagaagtttgagaagaagtctgtgcacaacaaggcctacttctag

SEQ ID NO: 145697 - DNA, 1464 bp, Artificial Sequence
  Description of Artificial Sequence: Synthetic coding sequence
atgggctcctgggccctgctgtggccacccctgctcttcaccggcctgctggtgcggcccccaggcaccatggcccaggcccagtactgcagcgtgaacaaggacatctttgaggtggaggagaacaccaacgtgacagagcccctggtggacatccacgtgcctgagggccaggaggtgaccctgggcgccctgagcaccccatttgccttccgcatccagggcaaccagctgttcctgaatgtgaccccagactatgaggagaagagcctgctggaggcccagctgctgtgccagagcggcggcaccctggtgacccagctgcgggtgtttgtgtctgtgctggatgtgaatgacaatgcccctgagttccccttcaagaccaaggagatccgggtggaggaggacaccaaggtgaacagcaccgtcatccctgagacccagctgcaggccgaggaccgggacaaggatgacatcctcttctacaccctgcaggagatgacagctggggccagtgactacttcagcctggtgtctgtgaacagacctgccctgcggctggaccggcccctggacttctatgaaagacccaacatgaccttctggctgctggtgcgggacaccccaggagaaaatgtggagcccagccacacagccacagccaccctggtgctgaatgtggtgcctgctgacctgcggcccccctggttcctgccctgcaccttcagtgatggctacgtgtgcatccaggcccagtaccacggggctgtgcccaccggccacatcctgcccagccccctggtgctgcggcccggccccatctatgcagaagatggagaccggggcatcaaccagcccatcatctacagcatcttcagaggaaatgtgaatggcaccttcatcatccacccagacagcggcaacctgactgtggcccggtctgtgcccagccccatgaccttcctgctgctggtgaagggccagcaggccgacctggcccgctacagcgtgacccaggtgacagtggaggccgtggccgccgccggcagccccccacgcttcccccagaggctgtaccggggcaccgtggcccggggagctggagctggggtggtggtgaaggatgctgctgcccccagccagcccctgcgcatccaggcccaggaccctgagttcagtgacctgaacagcgccatcacctaccgcatcaccaaccacagccacttcaggatggagggggaggtggtgctgaccaccaccaccctggcccaggccggggccttctacgccgagccccccacctgcaccggggacctgcggcacccagcccacctgcggcccccagccccagaccccacccagaggctgcctggagaggccgaggagcccatgcagacccccaaggccacccacctgggcgctgggggcctgaagcacctgcccggggtgctggtgcccttctag

SEQ ID NO: 145698 - DNA, 1956 bp, Artificial Sequence
  Description of Artificial Sequence: Synthetic coding sequence
atgggctcctgggccctgctgtggccacccctgctcttcaccggcctgctggtgcggcccccaggcaccatggcccaggcccagtactgcagcgtgaacaaggacatctttgaggtggaggagaacaccaacgtgacagagcccctggtggacatccacgtgcctgagggccaggaggtgaccctgggcgccctgagcaccccatttgccttccgcatccagggcaaccagctgttcctgaatgtgaccccagactatgaggagaagagcctgctggaggcccagctgctgtgccagagcggcggcaccctggtgacccagctgcgggtgtttgtgtctgtgctggatgtgaatgacaatgcccctgagttccccttcaagaccaaggagatccgggtggaggaggacaccaaggtgaacagcaccgtcatccctgagacccagctgcaggccgaggaccgggacaaggatgacatcctcttctacaccctgcaggagatgacagctggggccagtgactacttcagcctggtgtctgtgaacagacctgccctgcggctggaccggcccctggacttctatgaaagacccaacatgaccttctggctgctggtgcgggacaccccaggagaaaatgtggagcccagccacacagccacagccaccctggtgctgaatgtggtgcctgctgacctgcggcccccctggttcctgccctgcaccttcagtgatggctacgtgtgcatccaggcccagtaccacggggctgtgcccaccggccacatcctgcccagccccctggtgctgcggcccggccccatctatgcagaagatggagaccggggcatcaaccagcccatcatctacagcatcttcagaggaaatgtgaatggcaccttcatcatccacccagacagcggcaacctgactgtggcccggtctgtgcccagccccatgaccttcctgctgctggtgaagggccagcaggccgacctggcccgctacagcgtgacccaggtgacagtggaggccgtggccgccgccggcagccccccacgcttcccccagaggctgtaccggggcaccgtggcccggggagctggagctggggtggtggtgaaggatgctgctgcccccagccagcccctgcgcatccaggcccaggaccctgagttcagtgacctgaacagcgccatcacctaccgcatcaccaaccacagccacttcaggatggagggggaggtggtgctgaccaccaccaccctggcccaggccggggccttctacgccgaggtggaggcccacaacacagtgaccagcggcacagccaccaccgtgattgagatccaggtgtctgagcaggagccccccagcactggaggcggccccagcgaggacaagcgcttctctgtggtggacatggccgccctgggcggcgtgctgggcgccctgctgctgctggccctgctgggcctggccgtgctggtgcacaagcactacggcccccggctgaagtgctgctgcggcaaggcccctgagccccagccccagggctttgacaaccaggccttcctgcctgaccacaaggccaactgggcccctgtgcccagccccacccatgaccccaagccagctgaggcccccatgcctgctgagcccgcccctcctggccctgccagccctggaggagcccctgagcccccagctgctgcccgggccggcggcagccccacagctgtgcgcagcatcctgaccaaggagcggcggcctgagggcggctacaaggctgtgtggtttggagaagatattggaacagaagcagatgtggtggtgctgaatgcccccaccctggatgtggatggagccagtgacagcggcagcggagatgaaggagagggcgccggccggggcggcggcccctatgatgcccctggaggagatgacagctacatctag

SEQ ID NO: 145699 - DNA, 2538 bp, Artificial Sequence
  Description of Artificial Sequence: Synthetic coding sequence
atgggctcctgggccctgctgtggccacccctgctcttcaccggcctgctggtgcggcccccaggcaccatggcccaggcccagtactgcagcgtgaacaaggacatctttgaggtggaggagaacaccaacgtgacagagcccctggtggacatccacgtgcctgagggccaggaggtgaccctgggcgccctgagcaccccatttgccttccgcatccagggcaaccagctgttcctgaatgtgaccccagactatgaggagaagagcctgctggaggcccagctgctgtgccagagcggcggcaccctggtgacccagctgcgggtgtttgtgtctgtgctggatgtgaatgacaatgcccctgagttccccttcaagaccaaggagatccgggtggaggaggacaccaaggtgaacagcaccgtcatccctgagacccagctgcaggccgaggaccgggacaaggatgacatcctcttctacaccctgcaggagatgacagctggggccagtgactacttcagcctggtgtctgtgaacagacctgccctgcggctggaccggcccctggacttctatgaaagacccaacatgaccttctggctgctggtgcgggacaccccaggagaaaatgtggagcccagccacacagccacagccaccctggtgctgaatgtggtgcctgctgacctgcggcccccctggttcctgccctgcaccttcagtgatggctacgtgtgcatccaggcccagtaccacggggctgtgcccaccggccacatcctgcccagccccctggtgctgcggcccggccccatctatgcagaagatggagaccggggcatcaaccagcccatcatctacagcatcttcagaggaaatgtgaatggcaccttcatcatccacccagacagcggcaacctgactgtggcccggtctgtgcccagccccatgaccttcctgctgctggtgaagggccagcaggccgacctggcccgctacagcgtgacccaggtgacagtggaggccgtggccgccgccggcagccccccacgcttcccccagaggctgtaccggggcaccgtggcccggggagctggagctggggtggtggtgaaggatgctgctgcccccagccagcccctgcgcatccaggcccaggaccctgagttcagtgacctgaacagcgccatcacctaccgcatcaccaaccacagccacttcaggatggagggggaggtggtgctgaccaccaccaccctggcccaggccggggccttctacgccgaggtggaggcccacaacacagtgaccagcggcacagccaccaccgtgattgagatccaggtgtctgagcaggagccccccagcacagatgtgccccccagccctgaggccggcggcaccaccggcccctggaccagcaccaccagcgaggtgccccggcccccagagcccagccagggccccagcaccaccagcagcggcggcggcaccggcccccacccccccagcggcaccaccctgcggccccccaccagcagcacccctgggggccccccaggagctgagaacagcaccagccaccagcctgccaccccaggaggagacacagcccagacccccaagccaggcaccagccagcccatgcctcctggggtgggcaccagcaccagccaccagcctgccaccccatctgggggcacagcccagaccccagagcccggcaccagccagcccatgcctccttccatgggcaccagcaccagccaccagcctgccaccccaggcggcggcacagcccagaccccagaggccggcaccagccagcccatgcctcctggcatgggcaccagcaccagccaccagcccaccacccctgggggcggcacagcccagaccccagagcccggcaccagccagcccatgcccctgagcaagagcacccccagcagcggcggcggccccagcgaggacaagcgcttctctgtggtggacatggccgccctgggcggcgtgctgggcgccctgctgctgctggccctgctgggcctggccgtgctggtgcacaagcactacggcccccggctgaagtgctgctgcggcaaggcccctgagccccagccccagggctttgacaaccaggccttcctgcctgaccacaaggccaactgggcccctgtgcccagccccacccatgaccccaagccagctgaggcccccatgcctgctgagcccgcccctcctggccctgccagccctggaggagcccctgagcccccagctgctgcccgggccggcggcagccccacagctgtgcgcagcatcctgaccaaggagcggcggcctgagggcggctacaaggctgtgtggtttggagaagatattggaacagaagcagatgtggtggtgctgaatgcccccaccctggatgtggatggagccagtgacagcggcagcggagatgaaggagagggcgccggccggggcggcggcccctatgatgcccctggaggagatgacagctacatctag

SEQ ID NO: 145700 - DNA, 2538 bp, Artificial Sequence; identical to SEQ ID NO: 145699
  Description of Artificial Sequence: Synthetic coding sequence

SEQ ID NO: 145701 - DNA, 786 bp, Artificial Sequence
  Description of Artificial Sequence: Synthetic coding sequence
atggccgagagccacctgcagagcagcctcatcacagccagccagttctttgagatctggctgcactttgatgctgatggcagcggctacctggagggcaaggagctgcagaacctgatccaggagctgcagcaggccaggaagaaggccggcctggagctgagccctgagatgaagacctttgtggaccagtatggccagagagatgatggcaagattggaattgtggagctggcccacgtgctgcccacagaggagaacttcctgctgctcttccgctgccagcagctgaagagctgtgaggagttcatgaagacctggaggaaatatgacacagaccacagcggcttcatcgagacagaggagctgaagaacttcctgaaggacctgctggagaaggccaacaagacagtggatgacaccaagctggccgagtacacagacctgatgctgaagctgtttgacagcaacaatgatggcaagctggagctgacagagatggcccggctgctgcctgtgcaggagaacttcctgctgaagttccagggcatcaagatgtgtgggaaggagttcaacaaggcctttgagctgtatgaccaggatggaaatggctacattgatgaaaatgagctggatgccctgctgaaggacctgtgtgagaagaacaagcaggacctggacatcaacaacatcaccacctacaagaagaacatcatggccctgagtgatggcggcaagctgtacagaacagacctggccctgatcctgtgtgccggggacaactag

SEQ ID NO: 145702 - DNA, 615 bp, Artificial Sequence
  Description of Artificial Sequence: Synthetic coding sequence
atgaagacctttgtggaccagtatggccagagagatgatggcaagattggcatcgtggagctggcccacgtgctgcccacagaggagaacttcctgctgctcttccgctgccagcagctgaagagctgtgaggagttcatgaagacctggaggaaatatgacacagaccacagcggcttcattgaaacagaggagctgaagaacttcctgaaggacctgctggagaaggccaacaagacagtggatgacaccaagctggccgagtacacagacctgatgctgaagctgtttgacagcaacaatgatggcaagctggagctgacagagatggcccggctgctgcctgtgcaggagaacttcctgctgaagttccagggcatcaagatgtgtgggaaggagttcaacaaggcctttgagctgtatgaccaggatggaaatggctacattgatgaaaatgagctggatgccctgctgaaggacctgtgtgagaagaacaagcaggacctggacatcaacaacatcaccacctacaagaagaacatcatggccctgagtgatggcggcaagctgtacagaacagacctggccctgatcctgtgtgccggggacaactag

SEQ ID NO: 145703 - DNA, 816 bp, Artificial Sequence
  Description of Artificial Sequence: Synthetic coding sequence
atggccggcccccagcagcagcccccctacctgcacctggccgagctgacagccagccagttcctggagatctggaagcactttgatgctgatggaaatggctacatcgagggcaaggagctggagaacttcttccaggagctggagaaggccaggaaaggaagtggcatgatgagcaagagtgacaactttggagagaagatgaaggagttcatgcagaagtatgacaagaacagtgatggcaagattgagatggccgagctggcccagatcctgcccacagaggagaacttcctgctgtgcttccggcagcacgtgggcagcagcgctgagttcatggaggcctggaggaaatatgacacagacaggagcggctacatcgaggccaatgagctgaagggcttcctgagtgacctgctgaagaaggccaaccggccctatgatgagcccaagctgcaggagtacacccagaccatcctgaggatgtttgacctgaatggagatggcaagctgggcctgtctgagatgagccggctgctgcctgtgcaggagaacttcctgctgaagttccagggcatgaagctgaccagcgaggagttcaatgccatcttcaccttctatgacaaggacaggagcggctacattgatgagcacgagctggatgccctgctgaaggacctgtatgagaagaacaagaaggagatgaacatccagcagctgaccaactacaggaagtctgtgatgagcctggccgaggccggcaagctgtacaggaaggacctggagatcgtgctgtgcagcgagccccccatgtag

SEQ ID NO: 145704 - DNA, 579 bp, Artificial Sequence
  Description of Artificial Sequence: Synthetic coding sequence
atggccggcccccagcagcagcccccctacctgcacctggccgagctgacagccagccagttcctggagatctggaagcactttgatgctgatggaaatggctacatcgagggcaaggagctggagaacttcttccaggagctggagaaggccaggaaaggaagtggcatgatgagcaagagtgacaactttggagagaagatgaaggagttcatgcagaagtatgacaagaacagtgatggcaagattgagatggccgagctggcccagatcctgcccacagaggagaacttcctgctgtgcttccggcagcacgtgggcagcagcgctgagttcatggaggcctggaggaaatatgacacagacaggagcggctacatcgaggccaatgagctgaagggcttcctgagtgacctgctgaagaaggccaaccggccctatgatgagcccaagctgcaggagtacacccagaccatcctgaggatgtttgacctgaatggagatggcaagctgggcctgtctgagatgagcagaattgaagctgccaccctgacctccatgtcctggatgcccttctag

SEQ ID NO: 145705 - DNA, 6663 bp, Artificial Sequence
  Description of Artificial Sequence: Synthetic coding sequence
atgatcagaattgctgccctgaatgccagcagcaccattgaagatgaccacgagggcagcttcaagagccacaagacccagaccaaggaggcccaggaggccgaggcctttgccctgtaccacaaggccctggacctgcagaagcatgacagatttgaggagagcgccaaggcctaccacgagctgctggaggccagcctgctgcgggaggccgtgtcctctggagatgagaaggagggcctgaagcaccctggcctcatcctgaagtacagcacctacaagaacctggcccagctggccgcccagcgggaggacctggagacagccatggagttctacctggaggccgtgatgctggacagcacagatgtgaacctgtggtacaagattggccacgtggccctgcggctcatccgcatccccctggcccggcatgcctttgaggagggcctgcgctgcaacccagaccactggccctgcctggacaacctgatcaccgtgctgtacaccctgagtgactacaccacctgcctgtacttcatctgcaaggccctggagaaggactgccgctacagcaagggcctggtgctgaaggagaagatctttgaggagcagccctgcctgaggaaggacagcctgaggatgttcctgaagtgtgacatgagcatccatgatgtgtctgtgtctgctgctgagacccaggccatcgtggatgaggccctgggcctgaggaagaagaggcaggccctgattgtgcgggagaaggagccagacctgaagctggtgcagcccatccccttcttcacctggaagtgcctgggggagagcctgctggccatgtacaaccacctgaccacctgtgagcccccccggcccagcctgggcaagagaattgacctgagtgactaccaggaccccagccagcccctggagagctccatggtggtgacccctgtgaatgtcatccagcccagcacagtgtccaccaacccagctgtggccgtggccgagcctgtggtgtcctacacctctgtggccaccaccagcttccccctgcacagccctggcctgctggagaccggggcccctgtgggggacatcagcggcggggacaagagcaagaagggcgtgaagaggaagaagatcagcgaggagagcggggagacagccaagagaagaagtgcccgggtgaggaacaccaagtgcaagaaggaggagaaggtggacttccaggagctgctgatgaagttcctgcccagccggctgaggaagctggaccctgaggaggaggatgacagcttcaacaactatgaggtgcagagcgaggccaagctggagagcttccccagcatcggcccccagaggctgagctttgacagcgccaccttcatggagagcgagaagcaggatgtgcatgagttcctgctggagaacctgaccaatggaggcatcctggagctgatgatgagatacctgaaggccatgggccacaagttcctggtgcgctggcccccaggcctggccgaggtggtgctgtctgtgtaccacagctggaggaggcacagcaccagcctgcccaaccccctgctgcgggactgcagcaacaagcacatcaaggacatgatgctgatgagcctgagctgcatggagctgcagctggaccagtggctgctgaccaagggccgcagcagcgctgtgagccccaggaactgcccagctggcatggtgaatggccgcttcggccctgacttccctggcacccactgcctgggggacctgctgcagctgagctttgccagcagccagagggacctgtttgaagatggctggctggagtttgtggtgcgggtgtactggctgaaggcccgcttcctggccctgcagggcgacatggagcaggccctggagaactatgacatctgcacagagatgctgcagagcagcacagccatccaggtggaggccggggctgagcggcgggacatcgtcatccggctgcccaacctgcacaatgattctgtggtgtccctggaggagattgacaagaacctgaagagcctggagcgctgccagagcctggaggagatccagaggctgtatgaggccggggactacaaggctgtggtgcacctgctgcggcccaccctgtgcaccagcggctttgaccgggccaagcacctggagttcatgaccagcatccctgagaggcctgcccagctgctgctgctgcaggacagcctgctgcggctgaaggactaccggcagtgctttgagtgcagtgatgtggccctgaatgaagctgtgcagcagatggtgaacagcggggaggccgccgccaaggaggagtgggtggccaccgtgacccagctgctgatgggcatcgagcaggccctgtctgctgacagcagcggcagcatcctgaaggtgagcagcagcaccaccggcctggtgcggctgaccaacaacctgatccaggtgattgactgcagcatggctgtgcaggaggaggccaaggagccccacgtgtcctctgtgctgccctggatcatcctgcaccgcatcatctggcaggaggaggacaccttccacagcctgtgccaccagcagcagctgcagaacccagctgaggagggcatgtctgagacccccatgctgcccagcagcctgatgctgctgaacacagcccacgagtacctgggcagaagatcctggtgctgcaacagtgatggagccctgctgcgcttctacgtgcgggtgctgcagaaggagctggccgccagcaccagcgaggacacccacccctacaaggaggagctggagacagccctggagcagtgcttctactgcctgtacagcttccccagcaagaagagcaaggcccgctacctggaggagcacagcgcccagcaggtggacctgatctgggaggatgccctcttcatgtttgagtacttcaagcccaagaccctgcctgagtttgacagctacaagaccagcacagtgtctgctgacctggccaacctgctgaagagaattgccaccatcgtgcccaggacagagaggcctgccctgagcctggacaaggtgtctgcctacatcgagggcaccagcacagaggtgccctgcctgcctgagggcgctgaccccagcccccctgtggtgaatgagctgtactacctgctggccgactaccacttcaagaacaaggagcagagcaaggccatcaagttctacatgcatgacatctgcatctgccccaacagatttgacagctgggccggcatggccctggcccgggccagccgcatccaggacaagctgaacagcaatgagctgaagagtgatggccccatctggaagcacgccacccctgtgctgaactgcttccggcgggccctggagattgacagcagcaacctgagcctgtggattgaatatggcaccatgtcctatgccctgcacagctttgccagccggcagctgaagcagtggagaggagagctgcccccagagctggtgcagcagatggagggcagaagagacagcatgctggagacagccaagcactgcttcaccagcgctgcccgctgtgaaggagatggagatgaggaggagtggctgatccactacatgctgggcaaggtggccgagaagcagcagcagccccccaccgtgtacctgctgcactaccggcaggccggccactacctgcacgaggaggccgcccgctaccccaagaagatccactaccacaaccccccagagctggccatggaggccctggaggtgtacttccggctgcacgccagcatcctgaagctgctgggcaagccagacagcggcgtgggcgctgaggtgctggtgaacttcatgaaggaggccgctgagggcccctttgcccggggggaggagaagaacacccccaaggccagcgagaaggagaaggcctgcctggtggatgaggacagccacagcagcgctggcaccctgcccggccctggggccagcctgcccagcagcagcggccctggcctgaccagccccccctacacagccacccccatcgaccatgactatgtgaagtgcaagaagccccaccagcaggccaccccagatgacaggagccaggacagcacagctgtggccctgagtgacagcagcagcacccaggacttcttcaatgagcccaccagcctgctggagggcagcaggaagagctacacagagaagaggctgcccatcctgagcagccaggccggggccaccgggaaggacctgcagggcgccacagaggagcggggcaagaatgaggagagcctggagagcacagagggcttccgggctgctgagcagggcgtgcagaagccagctgctgagaccccagccagcgcctgcatccctgggaagcccagcgccagcacccccaccctgtgggatggcaagaagagaggagacctgcctggagagcctgtggccttcccccagggcctgcctgctggagctgaggagcagaggcagttcctgacagagcagtgcatcgccagcttccggctgtgcctgagccgcttcccccagcactacaagagcctgtaccgcctggccttcctgtacacctacagcaagacccacaggaacctgcagtgggccagagatgtgctgctgggcagcagcatcccctggcagcagctgcagcacatgcctgcccagggcctcttctgtgaaagaaacaagaccaacttcttcaacggcatctggagaattcctgtggatgaaattgacaggcctggcagctttgcctggcacatgaacagaagcatcgtgctgctgctgaaggtgctggcccagctgcgggaccacagcaccctgctgaaggtgtcctccatgctgcagaggaccccagaccagggcaagaagtacctgagagatgctgaccggcaggtgctggcccagagggccttcatcctgactgtgaaggtgctggaggacaccctgtctgagctggccgagggcagcgagcggcccggccccaaggtgtgtggcctgcccggggccaggatgaccacagatgtgagccacaaggccagcccagaagatggccaggagggcctgccccagcccaagaagccacccctggctgatggcagcggccctggccctgagcccggcggcaaggtgggcctgctgaaccacaggcctgtggccatggatgctggggacagcgctgaccagagcggggagaggaaggacaaggagagccccagggctggccccacagagcccatggacaccagcgaggccaccgtgtgccacagcgacctggagaggaccccacccctgctgcccggccggcctgcccgggaccggggccctgagagccggcccacagagctgagcctggaggagctgagcatcagcgcccggcagcagcccacccccctgaccccagcccagcctgccccagccccagccccagccaccaccaccggcacccgggccggcggccaccctgaggagcccctgagccggctgagcaggaagaggaagctgctggaggacacagaaagtggcaagaccctgctgctggatgcctacagagtgtggcagcagggccagaagggcgtggcctatgacctgggccgggtggagcgcatcatgtctgagacctacatgctgatcaagcaggtggatgaggaggccgccctggagcaggccgtgaagttctgccaggtgcacctgggcgctgctgcccagaggcaggccagcggggacacccccaccacccccaagcaccccaaggacagccgggagaacttcttccctgtgacagtggtgcccacagccccagaccctgtgcctgctgacagcgtgcagaggcccagtgatgcccacaccaagcccaggcctgccctggccgccgccaccaccatcatcacctgcccccccagcgccagcgccagcaccctggaccagagcaaggaccccggccccccccggccccacaggcctgaggccacccccagcatggccagcctgggccctgagggggaggagctggcccgggtggccgagggcaccagcttccccccccaggagcccaggcacagcccccaggtgaagatggcccccaccagcagccctgctgagccccactgctggccagctgaggccgccctgggcaccggggctgagcccacctgcagccaggagggcaagctgcggcctgagcccaggagagatggagaggcccaggaggccgccagcgagacccagcccctgagcagccccccaacagctgccagcagcaaggcccccagcagcggcagcgcccagcccccagagggccaccctgggaagccagagcccagccgggccaagagccggcccctgcccaacatgcccaagctggtgatccccagcgctgccaccaagtttcctcctgagatcaccgtgaccccacccacccccaccctgctgagccccaagggcagcatcagcgaggagaccaagcagaagctgaagagcgccatcctgagcgcccagagcgctgccaacgtgaggaaggagagcctgtgccagcctgccctggaggtgctggagaccagcagccaggagagcagcctggagagcgagacagatgaagatgatgactacatggacatctag

SEQ ID NO: 145706 - DNA, 6663 bp, Artificial Sequence; identical to SEQ ID NO: 145705
  Description of Artificial Sequence: Synthetic coding sequence

SEQ ID NO: 145707 - DNA, 1770 bp, Artificial Sequence
  Description of Artificial Sequence: Synthetic coding sequence
atgcccaggaggagccggcggggcatctggagaattcctgtggatgaaattgaccggcccggcagctttgcctggcacatgaacagaagcatcgtgctgctgctgaaggtgctggcccagctgcgggaccacagcaccctgctgaaggtgtcctccatgctgcagaggaccccagaccagggcaagaagtacctgagagatgctgaccggcaggtgctggcccagagggccttcatcctgactgtgaaggtgctggaggacaccctgtctgagctggccgagggcagcgagaggcctggccccaaggtgtgtggcctgcccggggccaggatgaccacagatgtgagccacaaggccagcccagaagatggccaggagggcctgccccagcccaagaagccacccctggctgatggcagcggccctggccctgagcccggcggcaaggtgggcctgctgaaccacaggcctgtggccatggatgctggggacagcgctgaccagagcggggagaggaaggacaaggagagcccccgggccggccccacagagcccatggacaccagcgaggccaccgtgtgccacagcgacctggagaggaccccacccctgctgcccggccgcccagcccgggaccggggccctgagagccggcccacagagctgagcctggaggagctgagcatcagcgcccggcagcagcccacccccctgaccccagcccagcctgccccagccccagccccagccaccaccaccggcaccagggctgggggccaccctgaggagcccctgagccggctgagcaggaagaggaagctgctggaggacacagagagcggcaagaccctgctgctggatgcctacagagtgtggcagcagggccagaagggcgtggcctatgacctgggccgggtggagcgcatcatgtctgagacctacatgctgatcaagcaggtggatgaggaggccgccctggagcaggccgtgaagttctgccaggtgcacctgggcctgcccccccgggaccggccccgggacacccccaccacccccaagcaccccaaggacagccgggagaacttcttccctgtgacagtggtgcccacagccccagaccctgtgcctgctgacagcgtgcagaggcccagtgatgcccacaccaagcccaggcctgccctggccgccgccaccaccatcatcacctgcccccccagcgccagcgccagcaccctggaccagagcaaggaccccggccccccccggccccacaggcctgaggccacccccagcatggccagcctgggccctgagggcaagctgcggcctgagcccaggagagatggagaggcccaggaggccgccagcgagacccagcccctgagcagccccccaacagctgccagcagcaaggcccccagcagcggcagcgcccagcccccagagggccaccctgggaagccagagcccagccgggccaagagccggcccctgcccaacatgcccaagctggtgatccccagcgctgccaccaagttccccccagagatcaccgtgaccccacccacccccaccctgctgagccccaagggcagcatcagcgaggagaccaagcagaagctgaagagcgccatcctgagcgcccagagcgctgccaacgtgaggaaggagagcctgtgccagcctgccctggaggtgctggagaccagcagccaggagagcagcctggagagcgagacagatgaagatgatgactacatggacatctag

SEQ ID NO: 145708 - DNA, 1224 bp, Artificial Sequence
  Description of Artificial Sequence: Synthetic coding sequence
atgatcagaattgctgccctgaatgccagcagcaccattgaagatgaccacgagggcagcttcaagagccacaagacccagaccaaggaggcccaggaggccgaggcctttgccctgtaccacaaggccctggacctgcagaagcatgacagatttgaggagagcgccaaggcctaccacgagctgctggaggccagcctgctgcgggaggccgtgtcctctggagatgagaaggagggcctgaagcaccctggcctcatcctgaagtacagcacctacaagaacctggcccagctggccgcccagcgggaggacctggagacagccatggagttctacctggaggccgtgatgctggacagcacagatgtgaacctgtggtacaagattggccacgtggccctgcggctcatccgcatccccctggcccggcatgcctttgaggagggcctgcgctgcaacccagaccactggccctgcctggacaacctgatcaccgtgctgtacaccctgagtgactacaccacctgcctgtacttcatctgcaaggccctggagaaggactgccgctacagcaagggcctggtgctgaaggagaagatctttgaggagcagccctgcctgaggaaggacagcctgaggatgttcctgaagtgtgacatgagcatccatgatgtgtctgtgtctgctgctgagacccaggccatcgtggatgaggccctgggcctgaggaagaagaggcaggccctgattgtgcgggagaaggagccagacctgaagctggtgcagcccatccccttcttcacctggaagtgcctgggggagagcctgctggccatgtacaaccacctgaccacctgtgagcccccccggcccagcctgggcaagagaattgacctgagtgactaccaggaccccagccagcccctggagagctccatggtggtgacccctgtgaatgtcatccagcccagcacagtgtccaccaacccagctgtggccgtggccgagcctgtggtgtcctacacctctgtggccaccaccagcttccccctgcacagccctggcctgctggagaccggggcccctgtgggggacatcagcggcggggacaagagcaagaagggcgtgaagaggaagaagatcagcgaggagagcggggagacagccaagagaagaagtgcccgggtgaggaacaccaagtgcaagaaggaggagaagtag

SEQ ID NO: 145709 - DNA, 1527 bp, Artificial Sequence
  Description of Artificial Sequence: Synthetic coding sequence
atgcagttcagcggggagaagatcagcggccagagggacctgcagaagagcaagatgaggttcaccttcaccagccgctgcctggccctcttcctgctgctgaaccaccccacccccatcctgcctgccttcagcaaccagacctaccccaccatcgagcccaagcccttcctgtatgtggtgggcaggaagaagatgatggatgcccagtacaagtgctatgacaggatgcagcagctgcctgcctaccagggcgagggcccctactgcaacagaacctgggatggctggctgtgctgggatgacaccccagctggggtgctgagctaccagttctgcccagactacttcccagactttgaccccagcgagaaggtgaccaagtactgtgatgagaagggcgtgtggttcaagcaccctgagaacaacagaacctggagcaactacaccatgtgcaatgccttcaccccagagaagctgaagaatgcctacgtgctgtactacctggccatcgtgggccacagcctgagcatcttcaccctggtgatcagcctgggcatctttgtgttcttcaggaagctgaccaccatcttccccctgaactggaagtacaggaaggccctgagcctgggctgccagagggtgaccctgcacaagaacatgttcctgacctacatcctgaacagcatgatcatcatcatccacctggtggaggtggtgcccaacggggagctggtgagaagagatcctgtgtcctgcaagatcctgcacttcttccaccagtacatgatggcctgcaactacttctggatgctgtgtgagggcatctacctgcacaccctcatcgtggtggccgtgttcacagagaagcagaggctgcgctggtactacctgctgggctggggcttccccctggtgcccaccaccatccacgccatcaccagggctgtgtacttcaatgacaactgctggctgtctgtggagacccacctgctgtacatcatccacggccctgtgatggccgccctggtggtgaacttcttcttcctgctgaacatcgtgcgggtgctggtgaccaagatgagggagacccatgaagctgagagccacatgtacctgaaggctgtgaaggccaccatgatcctggtgcccctgctgggcatccagtttgtggtgttcccctggaggcccagcaacaagatgctgggcaagatctatgactatgtgatgcacagcctcatccacttccagggcttctttgtggccaccatctactgcttctgcaacaatgaggtgcagaccaccgtgaagaggcagtgggcccagttcaagatccagtggaaccagcgctggggcagaagacccagcaacagaagtgcccgggctgctgctgctgctgctgaggccggggacatccccatctacatctgccaccaggagctgagaaatgaaccagccaacaaccagggcgaggagagcgctgagatcatccccctgaacatcatcgagcaggagagcagcgcctag

SEQ ID NO: 145710 - DNA, 1473 bp, Artificial Sequence
  Description of Artificial Sequence: Synthetic coding sequence
atgaggttcaccttcaccagccgctgcctggccctcttcctgctgctgaaccaccccacccccatcctgcctgccttcagcaaccagacctaccccaccatcgagcccaagcccttcctgtatgtggtgggcaggaagaagatgatggatgcccagtacaagtgctatgacaggatgcagcagctgcctgcctaccagggcgagggcccctactgcaacagaacctgggatggctggctgtgctgggatgacaccccagctggggtgctgagctaccagttctgcccagactacttcccagactttgaccccagcgagaaggtgaccaagtactgtgatgagaagggcgtgtggttcaagcaccctgagaacaacagaacctggagcaactacaccatgtgcaatgccttcaccccagagaagctgaagaatgcctacgtgctgtactacctggccatcgtgggccacagcctgagcatcttcaccctggtgatcagcctgggcatctttgtgttcttcaggaagctgaccaccatcttccccctgaactggaagtacaggaaggccctgagcctgggctgccagagggtgaccctgcacaagaacatgttcctgacctacatcctgaacagcatgatcatcatcatccacctggtggaggtggtgcccaacggggagctggtgagaagagatcctgtgtcctgcaagatcctgcacttcttccaccagtacatgatggcctgcaactacttctggatgctgtgtgagggcatctacctgcacaccctcatcgtggtggccgtgttcacagagaagcagaggctgcgctggtactacctgctgggctggggcttccccctggtgcccaccaccatccacgccatcaccagggctgtgtacttcaatgacaactgctggctgtctgtggagacccacctgctgtacatcatccacggccctgtgatggccgccctggtggtgaacttcttcttcctgctgaacatcgtgcgggtgctggtgaccaagatgagggagacccatgaagctgagagccacatgtacctgaaggctgtgaaggccaccatgatcctggtgcccctgctgggcatccagtttgtggtgttcccctggaggcccagcaacaagatgctgggcaagatctatgactatgtgatgcacagcctcatccacttccagggcttctttgtggccaccatctactgcttctgcaacaatgaggtgcagaccaccgtgaagaggcagtgggcccagttcaagatccagtggaaccagcgctggggcagaagacccagcaacagaagtgcccgggctgctgctgctgctgctgaggccggggacatccccatctacatctgccaccaggagctgagaaatgaaccagccaacaaccagggcgaggagagcgctgagatcatccccctgaacatcatcgagcaggagagcagcgcctag

SEQ ID NO: 145711 - DNA, 1425 bp, Artificial Sequence
  Description of Artificial Sequence: Synthetic coding sequence
atgaggttcaccttcaccagccgctgcctggccctcttcctgctgctgaaccaccccacccccatcctgcctgccttcagcaaccagacctaccccaccatcgagcccaagcccttcctgtatgtggtgggcaggaagaagatgatggatgcccagtacaagtgctatgacaggatgcagcagctgcctgcctaccagggcgagggcccctactgcaacagaacctgggatggctggctgtgctgggatgacaccccagctggggtgctgagctaccagttctgcccagactacttcccagactttgaccccagcgagaaggtgaccaagtactgtgatgagaagggcgtgtggttcaagcaccctgagaacaacagaacctggagcaactacaccatgtgcaatgccttcaccccagagaagctgaagaatgcctacgtgctgtactacctggccatcgtgggccacagcctgagcatcttcaccctggtgatcagcctgggcatctttgtgttcttccgcagcctgggctgccagagggtgaccctgcacaagaacatgttcctgacctacatcctgaacagcatgatcatcatcatccacctggtggaggtggtgcccaacggggagctggtgagaagagatcctgtgtcctgcaagatcctgcacttcttccaccagtacatgatggcctgcaactacttctggatgctgtgtgagggcatctacctgcacaccctcatcgtggtggccgtgttcacagagaagcagaggctgcgctggtactacctgctgggctggggcttccccctggtgcccaccaccatccacgccatcaccagggctgtgtacttcaatgacaactgctggctgtctgtggagacccacctgctgtacatcatccacggccctgtgatggccgccctggtggtgaacttcttcttcctgctgaacatcgtgcgggtgctggtgaccaagatgagggagacccatgaagctgagagccacatgtacctgaaggctgtgaaggccaccatgatcctggtgcccctgctgggcatccagtttgtggtgttcccctggaggcccagcaacaagatgctgggcaagatctatgactatgtgatgcacagcctcatccacttccagggcttctttgtggccaccatctactgcttctgcaacaatgaggtgcagaccaccgtgaagaggcagtgggcccagttcaagatccagtggaaccagcgctggggcagaagacccagcaacagaagtgcccgggctgctgctgctgctgctgaggccggggacatccccatctacatctgccaccaggagctgagaaatgaaccagccaacaaccagggcgaggagagcgctgagatcatccccctgaacatcatcgagcaggagagcagcgcctag

SEQ ID NO: 145712 - DNA, 825 bp, Artificial Sequence
  Description of Artificial Sequence: Synthetic coding sequence
atgaggttcaccttcaccagccgctgcctggccctcttcctgctgctgaaccaccccacccccatcctgcctgccttcagcaaccagacctaccccaccatcgagcccaagcccttcctgtatgtggtgggcaggaagaagatgatggatgcccagtacaagtgctatgacaggatgcagcagctgcctgcctaccagggcgagggcccctactgcaacagaacctgggatggctggctgtgctgggatgacaccccagctggggtgctgagctaccagttctgcccagactacttcccagactttgaccccagcgagaaggtgaccaagtactgtgatgagaagggcgtgtggttcaagcaccctgagaacaacagaacctggagcaactacaccatgtgcaatgccttcaccccagagaagctgaagaatgcctacgtgctgtactacctggccatcgtgggccacagcctgagcatcttcaccctggtgatcagcctgggcatctttgtgttcttccgcagcctgggctgccagagggtgaccctgcacaagaacatgttcctgacctacatcctgaacagcatgatcatcatcatccacctggtggaggtggtgcccaacggggagctggtgagaagagatcctgtgtcctgcaagatcctgcacttcttccaccagtacatgatggcctgcaactacttctggatgctgtgtgagggcatctacctgcacaccctcatcgtggtggccgtgttcacagagaagcagaggctgcgctggtactacctgctgggctgggccccagccttccaccgggactag

SEQ ID NO: 145713 - DNA, 1473 bp, Artificial Sequence; identical to SEQ ID NO: 145710
  Description of Artificial Sequence: Synthetic coding sequence

SEQ ID NO: 145714 - DNA, 873 bp, Artificial Sequence
  Description of Artificial Sequence: Synthetic coding sequence
atgaggttcaccttcaccagccgctgcctggccctcttcctgctgctgaaccaccccacccccatcctgcctgccttcagcaaccagacctaccccaccatcgagcccaagcccttcctgtatgtggtgggcaggaagaagatgatggatgcccagtacaagtgctatgacaggatgcagcagctgcctgcctaccagggcgagggcccctactgcaacagaacctgggatggctggctgtgctgggatgacaccccagctggggtgctgagctaccagttctgcccagactacttcccagactttgaccccagcgagaaggtgaccaagtactgtgatgagaagggcgtgtggttcaagcaccctgagaacaacagaacctggagcaactacaccatgtgcaatgccttcaccccagagaagctgaagaatgcctacgtgctgtactacctggccatcgtgggccacagcctgagcatcttcaccctggtgatcagcctgggcatctttgtgttcttcaggaagctgaccaccatcttccccctgaactggaagtacaggaaggccctgagcctgggctgccagagggtgaccctgcacaagaacatgttcctgacctacatcctgaacagcatgatcatcatcatccacctggtggaggtggtgcccaacggggagctggtgagaagagatcctgtgtcctgcaagatcctgcacttcttccaccagtacatgatggcctgcaactacttctggatgctgtgtgagggcatctacctgcacaccctcatcgtggtggccgtgttcacagagaagcagaggctgcgctggtactacctgctgggctgggccccagccttccaccgggactag

SEQ ID NO: 145715 - DNA, 1425 bp, Artificial Sequence; identical to SEQ ID NO: 145711
  Description of Artificial Sequence: Synthetic coding sequence

SEQ ID NO: 145716 - DNA, 489 bp, Artificial Sequence
  Description of Artificial Sequence: Synthetic coding sequence
atgaggttcaccttcaccagccgctgcctggccctcttcctgctgctgaaccaccccacccccatcctgcctgccttcagcaaccagacctaccccaccatcgagcccaagcccttcctgtatgtggtgggcaggaagaagatgatggatgcccagtacaagtgctatgacaggatgcagcagctgcctgcctaccagggcgagggcccctactgcaacagaacctgggatggctggctgtgctgggatgacaccccagctggggtgctgagctaccagttctgcccagactacttcccagactttgaccccagcgagaaggtgaccaagtactgtgatgagaagggcgtgtggttcaagcaccctgagaacaacagaacctggagcaactacaccatgtgcaatgccttcaccccagagaagctgaagaatgcctacgtgctgtactacctggccatcgtgggccacagctgccagttcagcccctag

SEQ ID NO: 145717 - DNA, 1386 bp, Artificial Sequence
  Description of Artificial Sequence: Synthetic coding sequence
atggagaagaagtgcaccctgaacttcctggtgctgctgcccttcttcatgatcctggtgacagctgagctggaggagagcccagaagattccatccagctgggcgtgaccaggaacaagatcatgacagcccagtatgagtgctaccagaagatcatgcaggaccccatccagcaggccgagggcgtgtactgcaacagaacctgggatggctggctgtgctggaatgatgtggccgccggcacagagagcatgcagctgtgcccagactacttccaggactttgaccccagcgagaaggtgaccaagatctgtgaccaggacggcaactggttccgccacccagccagcaacagaacctggaccaactacacccagtgcaatgtgaacacccatgagaaggtgaagacagccctgaacctcttctacctgaccatcattggacatggcctgagcatcgccagcctgctgatcagcctgggcatcttcttctacttcaagagcctgagctgccagaggatcaccctgcacaagaacctcttcttctcctttgtgtgcaacagcgtggtgaccatcatccacctgacagctgtggccaacaaccaggccctggtggccaccaaccctgtgtcctgcaaggtgtcccagttcatccacctgtacctgatgggctgcaactacttctggatgctgtgtgagggcatctacctgcacaccctgattgtggtggccgtgtttgctgagaagcagcacctgatgtggtactacttcctgggctggggcttccccctcatcccagcctgcatccacgccatcgcccggagcctgtactacaatgacaactgctggatcagcagtgacacccacctgctgtacatcatccacggccccatctgtgccgccctgctggtgaacctcttcttcctgctgaacatcgtgcgggtgctgatcaccaagctgaaggtgacccaccaggccgagagcaacctgtacatgaaggctgtgcgggccaccctcatcctggtgcccctgctgggcattgaatttgtgctgatcccctggaggcctgagggcaagattgctgaggaggtgtatgactacatcatgcacatcctgatgcacttccagggcctgctggtgtccaccatcttctgcttcttcaacggggaggtgcaggccatcctgcggaggaactggaaccagtacaagatccagtttggaaacagcttcagcaacagcgaggccctgcggagcgccagctacacagtgtccaccatcagtgatggccctggctacagccatgactgccccagcgagcacctgaatggcaagagcatccatgacattgaaaatgtgctgctgaagccagaaaatctctacaactag

SEQ ID NO: 145718 - DNA, 1386 bp, Artificial Sequence; identical to SEQ ID NO: 145717
  Description of Artificial Sequence: Synthetic coding sequence

SEQ ID NO: 145719 - DNA, 1386 bp, Artificial Sequence; identical to SEQ ID NO: 145717
  Description of Artificial Sequence: Synthetic coding sequence

SEQ ID NO: 145720 - DNA, 114 bp, Artificial Sequence
  Description of Artificial Sequence: Synthetic coding sequence
atggagaagaagtgcaccctgaacttcctggtgctgctgcccttcttcatgatcctggtgacagctgagctggaggagagcccagaagattccatccagctgggcgtgacctag

SEQ ID NO: 145721 - DNA, 237 bp, Artificial Sequence
  Description of Artificial Sequence: Synthetic coding sequence
atggagaagaagtgcaccctgaacttcctggtgctgctgcccttcttcatgatcctggtgacagctgagctggaggagagcccagaagattccatccagctgggcgtgaccaggaacaagatcatgacagcccagtatgagtgctaccagaagatcatgcaggaccccatccagcaggccgagggcgtgtactgcaacagaacctgggatggctggctgtgctggaatgatgtgtag

SEQ ID NO: 145722 - DNA, 426 bp, Artificial Sequence
  Description of Artificial Sequence: Synthetic coding sequence
atgggcttccagaagttcagccccttcctggccctgagcatcctggtgctgctgcaggccggcagcctgcatgctgcccccttccgcagcgccctggagagcagccctgctgaccctgccaccctgtctgaagatgaggcccggctgctgctggccgccctggtgcagaactacgtgcagatgaaggccagcgagctggagcaggagcaggagcgggagggcagcagcctggacagccccaggagcaagagatgtggcaacctgagcacctgcatgctgggcacctacacccaggacttcaacaagttccacaccttcccccagacagccatcggcgtgggcgcccctgggaagaagagggacatgagcagtgacctggagcgggaccaccggccccacgtgtccatgccccagaatgccaactag

SEQ ID NO: 145723 - DNA, 426 bp, Artificial Sequence
  Description of Artificial Sequence: Synthetic coding sequence
atgggcttccagaagttcagccccttcctggccctgagcatcctggtgctgctgcaggccggcagcctgcatgctgcccccttccgcagcgccctggagagcagccctgctgaccctgccaccctgtctgaagatgaggcccggctgctgctggccgccctggtgcagaactacgtgcagatgaaggccagcgagctggagcaggagcaggagcgggagggcagcagcctggacagccccaggagcaagagatgtggcaacctgagcacctgcatgctgggcacctacacccaggacttcaacaagttccacaccttcccccagacagccatcggcgtgggcgcccctgggaagaagagggacatgagcagtgacctggagcgggaccaccggccccacaaccactgcccagaggagagcctgtag

SEQ ID NO: 145724 - DNA, 387 bp, Artificial Sequence
  Description of Artificial Sequence: Synthetic coding sequence
atgggcttccagaagttcagccccttcctggccctgagcatcctggtgctgctgcaggccggcagcctgcatgctgcccccttccgcagcgccctggagagcagccctgctgaccctgccaccctgtctgaagatgaggcccggctgctgctggccgccctggtgcagaactacgtgcagatgaaggccagcgagctggagcaggagcaggagcgggagggcagccgcatcatcgcccagaagagggcctgtgacacagccacctgtgtgacccaccggctggccggcctgctgagccgctctggaggagtggtgaagaacaactttgtgcccaccaacgtgggcagcaaggcctttggaagaagaagaagagacctgcaggcctag

SEQ ID NO: 145725 - DNA, 426 bp, Artificial Sequence; identical to SEQ ID NO: 145722
  Description of Artificial Sequence: Synthetic coding sequence

SEQ ID NO: 145726 - DNA, 387 bp, Artificial Sequence; identical to SEQ ID NO: 145724
  Description of Artificial Sequence: Synthetic coding sequence

SEQ ID NO: 145727 - DNA, 384 bp, Artificial Sequence
  Description of Artificial Sequence: Synthetic coding sequence
atgggcttcaggaagttcagccccttcctggccctgagcatcctggtgctgtaccaggccggcagcctgcaggccgcccccttccgcagcgccctggagagcagcccagaccctgccaccctgagcaaggaggatgcccggctgctgctggccgccctggtgcaggactatgtgcagatgaaggccagcgagctgaagcaggagcaggagacccagggcagcagcagcgctgcccagaagagggcctgcaacacagccacctgtgtgacccaccggctggccggcctgctgagccgcagcggcggcatggtgaagagcaactttgtgcccaccaacgtgggcagcaaggccttcggcagaagaagaagagacctgcaggcctag

SEQ ID NO: 145728 - DNA, 417 bp, Artificial Sequence
  Description of Artificial Sequence: Synthetic coding sequence
atgaagaaggaggccaacctgcagaggggcggcatgggcttcaggaagttcagccccttcctggccctgagcatcctggtgctgtaccaggccggcagcctgcaggccgcccccttccgcagcgccctggagagcagcccagaccctgccaccctgagcaaagaagatgcccggctgctgctggccgccctggtgcaggactatgtgcagatgaaggccagcgagctgaagcaggagcaggagacccagggcagcagcagcgctgcccagaagagggcctgcaacacagccacctgtgtgacccaccggctggccggcctgctgagccgcagcggcggcatggtgaagagcaactttgtgcccaccaacgtgggcagcaaggcctttggaagaagaagaagagacctgcaggcctag

SEQ ID NO: 145729 - DNA, 384 bp, Artificial Sequence; identical to SEQ ID NO: 145727
  Description of Artificial Sequence: Synthetic coding sequence

SEQ ID NO: 145730 - DNA, 1206 bp, Artificial Sequence
  Description of Artificial Sequence: Synthetic coding sequence
atgcctgtgcagctgtctgagcaccctgagtggaatgaatccatgcacagcctgcgcatctctgtgggcggcctgcctgtgctggcctccatgaccaaggctgctgacccccgcttccggccccgctggaaggtgatcctgaccttctttgtgggcgccgccatcctgtggctgctgtgcagccacaggcctgcccctggccggccccccacccacaatgcccacaactggaggctgggccaggccccagccaactggtacaatgacacctaccccctgagccccccccagaggaccccagctggcatccgctacagaattgctgtgattgctgacctggacacagagagccgggcccaggaggagaacacctggttctcctacctgaagaagggctacctgaccctgagtgacagcggggacaaggtggccgtggagtgggacaaggaccatggagtgctggagagccacctggccgagaagggccggggcatggagctgagtgacctgattgtgttcaacgggaagctgtacagcgtggatgacagaactggagtggtgtaccagatcgagggcagcaaggctgtgccctgggtgatcctgagtgatggagatggcaccgtggagaagggcttcaaggccgagtggctggccgtgaaggatgagcggctgtatgtgggcggcctgggcaaggagtggaccaccaccactggagatgtggtgaatgaaaatcctgagtgggtgaaggtggtgggctacaagggctctgtggaccacgagaactgggtgagcaactacaatgccctgcgggctgctgctggcatccagcccccaggctacctgattcatgaaagtgcctgctggagcgacaccctgcagcgctggttcttcctgccccggcgggccagccaggagcgctacagcgagaaggatgatgagaggaaaggagccaacctgctgctgagcgccagcccagactttggagacattgctgtgagccacgtgggcgctgtggtgcccacccacggcttcagcagcttcaagttcatccccaacacagatgaccagatcatcgtggccctgaagtcagaagaagattctggccgggtggccagctacatcatggccttcaccctggatggccgcttcctgctgcctgagaccaagattggctctgtgaagtatgagggcatcgagttcatctag

SEQ ID NO: 145731 - DNA, 1053 bp, Artificial Sequence
  Description of Artificial Sequence: Synthetic coding sequence
atgcctgtgcagctgtctgagcaccctgagtggaatgaatccatgcacagcctgcgcatctctgtgggcggcctgcctgtgctggcctccatgaccaaggctgctgacccccgcttccggcccaggagccccccccagaggaccccagctggcatccgctacagaattgctgtgattgctgacctggacacagagagccgggcccaggaggagaacacctggttctcctacctgaagaagggctacctgaccctgagtgacagcggggacaaggtggccgtggagtgggacaaggaccacggcgtgctggagagccacctggccgagaagggccggggcatggagctgagtgacctgattgtgttcaacgggaagctgtacagcgtggatgacagaactggagtggtgtaccagatcgagggcagcaaggctgtgccctgggtgatcctgagtgatggagatggcaccgtggagaagggcttcaaggccgagtggctggccgtgaaggatgagcggctgtatgtgggcggcctgggcaaggagtggaccaccaccactggagatgtggtgaatgaaaatcctgagtgggtgaaggtggtgggctacaagggctctgtggaccacgagaactgggtgagcaactacaatgccctgcgggctgctgctggcatccagcccccaggctacctgatccacgagagcgcctgctggagcgacaccctgcagcgctggttcttcctgccccggcgggccagccaggagcgctacagcgagaaggatgatgagaggaagggggccaacctgctgctgagcgccagcccagactttggagacattgctgtgagccacgtgggcgctgtggtgcccacccacggcttcagcagcttcaagttcatccccaacacagatgaccagatcatcgtggccctgaagtctgaggaggacagcggccgggtggccagctacatcatggccttcaccctggatggccgcttcctgctgcctgagaccaagattggctctgtgaagtatgagggcatcgagttcatctag

SEQ ID NO: 145732 - DNA, 1206 bp, Artificial Sequence; identical to SEQ ID NO: 145730
  Description of Artificial Sequence: Synthetic coding sequence

SEQ ID NO: 145733 - DNA, 738 bp, Artificial Sequence
  Description of Artificial Sequence: Synthetic coding sequence
atgcctgtgcagctgtctgagcaccctgagtggaatgaatccatgcacagcctgcgcatctctgtgggcggcctgcctgtgctggcctccatgaccaaggctgctgacccccgcttccggccccgctggaaggtgatcctgaccttctttgtgggcgccgccatcctgtggctgctgtgcagccacaggcctgcccctggccggccccccacccacaatgcccacaactggaggctgggccaggccccagccaactggtacaatgacacctaccccctgagccccccccagaggaccccagctggcatccgctacagaattgctgtgattgctgacctggacacagagagccgggcccaggaggagaacacctggttctcctacctgaagaagggctacctgaccctgagtgacagcggggacaaggtggccgtggagtgggacaaggaccatggagtgctggagagccacctggccgagaagggccggggcatggagctgagtgacctgattgtgttcaacgggaagctgtacagcgtggatgacagaactggagtggtgtaccagatcgagggcagcaaggctgtgccctgggtgatcctgagtgatggagatggcaccgtggagaagggcgtgggcggggagtgggaggccgtgcgggagatcgtgaggaagcgctggaggctggtgaagcaggtgagccacgtgggcgtgctgggccagtggatccagaggtag

SEQ ID NO: 145734 - DNA, 663 bp, Artificial Sequence
  Description of Artificial Sequence: Synthetic coding sequence
atgggcaactgtgccaagaggccctggaggcggggccccaaggaccccctgcagtggctgggcagccccccccggggcagctgccccagccccagcagcagccccaaggagcagggcgaccctgcccctggggtgcagggctacagcgtgctgaacagcctggtgggccctgcctgcatcttcctgcggcccagcattgctgccacccagctggaccgggagctgcggcctgaggagattgaggagctgcaggtggccttccaggagtttgaccgggacagagatggctacatcggctgccgggagctgggcgcctgcatgaggaccctgggctacatgcccacagagatggagctgattgagatcagccagcagatcagcggcggcaaggtggactttgaggactttgtggagctgatgggccccaagctgctggccgagacagctgacatgattggagtgcgggagctgagagatgccttccgggagtttgacaccaatggagatggccgcatctctgtgggggagctgcgggccgccctgaaggccctgctgggggagcggctgagccagcgggaggtggatgagatcctgcaggatgtggacctgaatggagatggcctggtggactttgaggagtttgtgaggatgatgagcaggtag

SEQ ID NO: 145735 - DNA, 1026 bp, Artificial Sequence
  Description of Artificial Sequence: Synthetic coding sequence
atgcccttcccctttgggaagagccacaagagccctgctgacatcgtgaagaacctgaaggagagcatggctgtgctggagaagcaggacatcagtgacaagaaggccgagaaggccacagaggaggtgtccaagaacctggtggccatgaaggagatcctgtatggcaccaatgagaaggagccccagacagaggccgtggcccagctggcccaggagctgtacaacagcggcctgctgagcaccctggtggccgacctgcagctgattgactttgagggcaagaaggatgtggcccagatcttcaacaacatcctgcggcggcagatcggcaccaggacccccaccgtggagtacatctgcacccagcagaacatcctcttcatgctgctgaagggctatgagagccctgagatcgccctgaactgtggcatcatgctgcgggagtgcatcagacatgagcccctggccaagatcatcctgtggagcgagcagttctatgacttcttccgctacgtggagatgagcacctttgacatcgccagtgatgcctttgccaccttcaaggacctgctgaccaggcacaagctgctgtctgctgagttcctggagcagcactatgaccgcttcttctctgaatatgagaagctgctgcacagtgaaaattatgtgaccaagaggcagagcctgaagctgctgggggagctgctgctggacagacacaacttcaccatcatgaccaagtacatcagcaagccagagaacctgaagctgatgatgaacctgctgcgggacaagagcaggaacatccagtttgaggccttccacgtgttcaaggtgtttgtggccaaccccaacaagacccagcccatcctggacatcctgctgaagaaccaggccaagctgattgagttcctgagcaagttccagaatgacagaacagaagatgagcagttcaatgatgagaagacctacctggtgaagcagatccgggacctgaagaggcctgcccagcaggaggcctag

SEQ ID NO: 145736 - DNA, 1026 bp, Artificial Sequence; identical to SEQ ID NO: 145735
  Description of Artificial Sequence: Synthetic coding sequence

SEQ ID NO: 145737 - DNA, 1026 bp, Artificial Sequence; identical to SEQ ID NO: 145735
  Description of Artificial Sequence: Synthetic coding sequence

SEQ ID NO: 145738 - DNA, 1014 bp, Artificial Sequence
  Description of Artificial Sequence: Synthetic coding sequence
atgaagaagatgcccctcttcagcaagagccacaagaacccagctgagatcgtgaagatcctgaaggacaacctggccatcctggagaagcaggacaagaagacagacaaggccagcgaggaggtgtccaagagcctgcaggccatgaaggagatcctgtgtggcaccaatgagaaggagcccccaacagaagctgtggcccagctggcccaggagctgtacagcagcggcctgctggtgaccctgattgctgacctgcagctgattgactttgagggcaagaaggatgtgacccagatcttcaacaacatcctgcggcggcagatcggcaccaggagccccaccgtggagtacatcagcgcccacccccacatcctcttcatgctgctgaagggctatgaggccccccagatcgccctgcgctgtggcatcatgctgcgggagtgcatcagacatgagcccctggccaagatcatcctcttcagcaaccagttccgggacttcttcaagtatgtggagctgagcacctttgatattgccagtgatgcctttgccaccttcaaggacctgctgaccaggcacaaggtgctggtggccgacttcctggagcagaactatgacaccatctttgaagattatgagaagctgctgcagagcgagaactacgtgaccaagaggcagagcctgaagctgctgggggagctgatcctggacagacacaactttgccatcatgaccaagtacatcagcaagccagagaacctgaagctgatgatgaacctgctgcgggacaagagccccaacatccagtttgaggccttccacgtgttcaaggtgtttgtggccagcccccacaagacccagcccatcgtggagatcctgctgaagaaccagcccaagctgattgagttcctgagcagcttccagaaggagaggacagatgatgagcagtttgctgatgagaagaactacctgatcaagcagatccgggacctgaagaagacagccccctag

SEQ ID NO: 145739 - DNA, 1014 bp, Artificial Sequence; identical to SEQ ID NO: 145738
  Description of Artificial Sequence: Synthetic coding sequence

SEQ ID NO: 145740 - DNA, 945 bp, Artificial Sequence
  Description of Artificial Sequence: Synthetic coding sequence
atgcccctcttcagcaagagccacaagaacccagctgagatcgtgaagatcctgaaggacaacctggccatcctggagaagcaggacaagaagacagacaaggccagcgaggaggtgtccaagagcctgcaggccatgaaggagatcctgtgtggcaccaatgagaaggagcccccaacagaggccgtggcccagctggcccaggagctgtacagcagcggcctgctggtgaccctgattgctgacctgcagctgattgactttgagggcaagaaggatgtgacccagatcttcaacaacatcctgcggcggcagatcggcaccaggagccccaccgtggagtacatcagcgcccacccccacatcctcttcatgctgctgaagggctatgaggccccccagatcgccctgcgctgtggcatcatgctgcgggagtgcatcagacatgagcccctggccaagatcatcctcttcagcaaccagttccgggacttcttcaagtatgtggagctgagcacctttgacatcgccagtgatgcctttgccaccttcaagatctttgaggactatgagaagctgctgcagagtgaaaattatgtgaccaagaggcagagcctgaagctgctgggggagctgatcctggacagacacaactttgccatcatgaccaagtacatcagcaagccagagaacctgaagctgatgatgaacctgctgcgggacaagagccccaacatccagtttgaggccttccacgtgttcaaggtgtttgtggccagcccccacaagacccagcccatcgtggagatcctgctgaagaaccagcccaagctgattgagttcctgagcagcttccagaaggagaggacagatgatgagcagtttgctgatgagaagaactacctgatcaagcagatccgggacctgaagaagacagccccctag

SEQ ID NO: 145741 - DNA, 282 bp, Artificial Sequence
  Description of Artificial Sequence: Synthetic coding sequence
atgaagaagatgcccctcttcagcaagagccacaagaacccagctgagatcgtgaagatcctgaaggacaacctggccatcctggagaagcaggacaagaagacagacaaggccagcgaggaggtgtccaagagcctgcaggccatgaaggagatcctgtgtggcaccaatgagaaggagcccccaacagaagctgtggcccagctggcccaggagctgtacagcagcggcctgctggtgaccctgattgctgacctgcagctgattgactttgaggtgtag

SEQ ID NO: 145742 - DNA, 1014 bp, Artificial Sequence; identical to SEQ ID NO: 145738
  Description of Artificial Sequence: Synthetic coding sequence

SEQ ID NO: 145743 - DNA, 1014 bp, Artificial Sequence; identical to SEQ ID NO: 145738
  Description of Artificial Sequence: Synthetic coding sequence

SEQ ID NO: 145744 - DNA, 387 bp, Artificial Sequence
  Description of Artificial Sequence: Synthetic coding sequence
atgaagaagatgcccctcttcagcaagagccacaagaacccagctgagatcgtgaagatcctgaaggacaacctggccatcctggagaagcaggacaagaagacagacaaggccagcgaggaggtgtccaagagcctgcaggccatgaaggagatcctgtgtggcaccaatgagaaggagcccccaacagaagctgtggcccagctggcccaggagctgtacagcagcggcctgctggtgaccctgattgctgacctgcagctgattgactttgagggcaagaaggatgtgacccagatcttcaacaacatcctgcggcggcagatcggcaccaggagccccaccgtggagtacatcagcgcccacccccacatcctcttcatgtag

SEQ ID NO: 145745 - DNA, 567 bp, Artificial Sequence
  Description of Artificial Sequence: Synthetic coding sequence
atgaagaagatgcccctcttcagcaagagccacaagaacccagctgagatcgtgaagatcctgaaggacaacctggccatcctggagaagcaggacaagaagacagacaaggccagcgaggaggtgtccaagagcctgcaggccatgaaggagatcctgtgtggcaccaatgagaaggagcccccaacagaagctgtggcccagctggcccaggagctgtacagcagcggcctgctggtgaccctgattgctgacctgcagctgattgactttgagggcaagaaggatgtgacccagatcttcaacaacatcctgcggcggcagatcggcaccaggagccccaccgtggagtacatcagcgcccacccccacatcctcttcatgctgctgaagggctatgaggccccccagatcgccctgcgctgtggcatcatgctgcgggagtgcatcagacatgagcccctggccaagatcatcctcttcagcaaccagttccgggacttcttcaagtatgtggagctgagcacctttgatattgccagtgatgcctttgccaccttcaagtag

SEQ ID NO: 145746 - DNA, 828 bp, Artificial Sequence
  Description of Artificial Sequence: Synthetic coding sequence
atgaccacagagcaggcccggggccagcagggccccaacctggccatcggccggcagaagcccccagctggggtggtgacccccaagagtgatgctgaggagccccccctgaccaggaagaggagcaagaaggagcggggcctgcggggcagcaggaagaggacaggcagcagcggggagcagacaggccctgaggcccctggcagcagcaacaacccccccagcactggagagggccctgctggggcccccccagccagccctggccctgccagcagccggcagagccaccgccacaggccagacagcctgcatgatgctgcccagaggacctacggccccctgctgaacagagtgtttgggaaggaccgggagctgggccctgaggagctggatgagctgcaggccgcctttgaggagtttgacacagacagagatggctacatcagccaccgggagctgggggactgcatgaggaccctgggctacatgcccacagagatggagctgctggaggtgtcccagcacatcaagatgaggatgggcggccgggtggactttgaggagtttgtggagctgattggccccaagctgcgggaggagacagcccacatgctgggcgtgcgggagctgagaattgccttccgggagtttgaccgggacagagatggccgcatcaccgtggccgagctgcgggaggccgtgcctgccctgctgggggagcccctggccggccctgagctggatgagatgctgcgggaggtggacctgaatggagatggcaccgtggactttgatgaatttgtgatgatgctgagccgccactag

SEQ ID NO: 145747 - DNA, 513 bp, Artificial Sequence
  Description of Artificial Sequence: Synthetic coding sequence
atgacagagccctggctggccctgggcacctcctggaccctgcccctgcaggaccgggagctgggccctgaggagctggatgagctgcaggccgcctttgaggagtttgacacagacagagatggctacatcagccaccgggagctgggggactgcatgaggaccctgggctacatgcccacagagatggagctgctggaggtgtcccagcacatcaagatgaggatgggcggccgggtggactttgaggagtttgtggagctgattggccccaagctgcgggaggagacagcccacatgctgggcgtgcgggagctgcgcatcgccttccgggagtttgaccgggacagagatggccgcatcaccgtggccgagctgcgggaggccgtgcctgccctgctgggggagcccctggccggccctgagctggatgagatgctgcgggaggtggacctgaatggagatggcaccgtggactttgatgaatttgtgatgatgctgagccgccactag

SEQ ID NO: 145748 - DNA, 522 bp, Artificial Sequence
  Description of Artificial Sequence: Synthetic coding sequence
atgcagttccccatgggccctgcctgcatcttcctgaggaagggcattgctgagaagcagcgggagcggcccctgggccaggatgaaattgaggagctgcgggaggccttcctggagtttgacaaggacagagatggcttcatcagctgcaaggacctgggcaacctgatgaggaccatgggctacatgcccacagagatggagctgattgagctgggccagcagatccgcatgaacctgggcggccgggtggactttgatgactttgtggagctgatgacccccaagctgctggccgagacagctggcatgattggagtgcaggagatgagagatgccttcaaggagtttgacaccaatggagatggagagatcaccctggtggagctgcagcaggccatgcagaggctgctgggggagcggctgaccccccgggagatcagcgaggtggtgcgggaggctgatgtgaatggagatggcaccgtggactttgaggagtttgtgaagatgatgagcaggtag

SEQ ID NO: 145749 - DNA, 846 bp, Artificial Sequence
  Description of Artificial Sequence: Synthetic coding sequence
atggagaagagcacagacacagatgaagataatgtgaccaggacagagtacagcgacaagaccacccagttccccagcgtgtatgctgtgcctggaacagagcagacagaggccgtgggcggcctgagcagcaagccagccacccccaagaccaccaccccacccagcagccccccacccacagctgtgtccccagagtttgcctacgtgcctgctgaccctgcccagctggccgcccagatgctggccatggccaccagcgagcggggccagcccccaccctgcagcaacatgtggaccctgtactgcctgacagacaagaaccagcagggccaccccagccccccaccagcccctggccccttcccccaggccaccctgtacctgcccaaccccaaggacccccagttccagcagcacccccccaaggtgaccttccccacctacgtgatgggagacaccaagaagaccagcgccccacccttcatcctggtgggcagcaatgtgcaggaggcccagggctggaagcccctgcccggccatgctgtggtgtcccagagtgatgtgctgcgctacgtggccatgcaggtgcccatcgctgtgcctgcagatgagaagtaccagaagcacaccctgagcccccagaatgccaaccccccatctggccaggatgtgccccggcccaagagccctgtgttcctgtctgtggccttccctgtggaggatgtggccaagaagagcagcggcagcggggacaagtgtgcccccttcggcagctatggaattgctggggaggtgacagtgaccacagcccacaagaggaggaaggccgagacagagaactag

SEQ ID NO: 145750 - DNA, 1188 bp, Artificial Sequence
  Description of Artificial Sequence: Synthetic coding sequence
atggagaagagcacagacacagatgaagataatgtgaccaggacagagtacagcgacaagaccacccagttccccagcgtgtatgctgtgcctggaacagagcagacagaggccgtgggcggcctgagcagcaagccagccacccccaagaccaccaccccacccagcagccccccacccacagctgtgtccccagagtttgcctacgtgcctgctgaccctgcccagctggccgcccagatgctgggcaaggtgagcagcatccacagcgaccagagtgatgtgctgatggtggatgtggccacctccatgcctgtggtgatcaaggaggtgcccagcagcgaggccgcagaagatgtgatggtggccgcccccctggtgtgcagcggcaaggtgctggaggtgcaggtggtgaaccagacctctgtgcacgtggacctgggcagccagcccaaggaaaatgaggccgagcccagcacagccagctctgtgcccctgcaggatgagcaggagcccccagcctatgaccaggcccctgaggtgaccctgcaggccgacatcgaggtgatgagcacagtgcacatcagctctgtgtacaatgatgtgcctgtgacagaaggagtggtgtacatcgagcagctgcctgagcagatcgtcatccccttcacagaccaggtggcctgcctgaaggaaaatgagcagagcaaagaaaatgagcagagcccccgggtgagccccaagtctgtggtggagaagaccaccagcggcatgagcaagaagtctgtggagagcgtgaagctggcccagctggaggagaatgccaagtacagctctgtgtacatggaggccgaggccacagccctgctgagtgacaccagcctgaagggccagcctgaggtgcctgcccagctgctggatgctgagggcgccatcaagattggcagcgagaagagcctgcacctggaggtggagatcaccagcatcgtgtctgacaacacaggccaggaggagagcggggagaacagcgtgccccaggagatggagggcaagcctgtgctgagcggggaggccgctgaggccgtgcacagcggcacctctgtgaagagcagcagcggccccttccccccagcccctgagggcctgacagcccctgagattgagcctgagggggagagcacagctgagtag

SEQ ID NO: 145751 - DNA, 1140 bp, Artificial Sequence
  Description of Artificial Sequence: Synthetic coding sequence
atgatcagcagcaagccccggctggtggtgccctacggcctgaagaccctgctggagggcatcagcagagctgtgctgaagaccaaccccagcaacatcaaccagtttgctgctgcctacttccaggagctgaccatgtaccggggcaacaccaccatggacatcaaggacctggtgaagcagttccaccagatcaaggtggagaagtggagcgagggcaccaccccccagaagaagctggagtgcctgaaggagcccgggaagacctctgtggagagcaaggtgcccacccagatggagaagagcacagacacagatgaagataatgtgaccaggacagagtacagcgacaagaccacccagttccccagcgtgtatgctgtgcctggaacagagcagacagaggccgtgggcggcctgagcagcaagccagccacccccaagaccaccaccccacccagcagccccccacccacagctgtgtccccagagtttgcctacgtgcctgctgaccctgcccagctggccgcccagatgctggccatggccaccagcgagcggggccagcccccaccctgcagcaacatgtggaccctgtactgcctgacagacaagaaccagcagggccaccccagccccccaccagcccctggccccttcccccaggccaccctgtacctgcccaaccccaaggacccccagttccagcagcacccccccaaggtgaccttccccacctacgtgatgggagacaccaagaagaccagcgccccacccttcatcctggtgggcagcaatgtgcaggaggcccagggctggaagcccctgcccggccatgctgtggtgtcccagagtgatgtgctgcgctacgtggccatgcaggtgcccatcgctgtgcctgcagatgagaagtaccagaagcacaccctgagcccccagaatgccaaccccccatctggccaggatgtgccccggcccaagagccctgtgttcctgtctgtggccttccctgtggaggatgtggccaagaagagcagcggcagcggggacaagtgtgcccccttcggcagctatggaattgctggggaggtgacagtgaccacagcccacaagaggaggaaggccgagacagagaactag

SEQ ID NO: 145752 - DNA, 1140 bp, Artificial Sequence; identical to SEQ ID NO: 145751
  Description of Artificial Sequence: Synthetic coding sequence

SEQ ID NO: 145753 - DNA, 666 bp, Artificial Sequence
  Description of Artificial Sequence: Synthetic coding sequence
atgatcagcagcaagccccggctggtggtgccctacggcctgaagaccctgctggagggcatcagcagagctgtgctgaagaccaaccccagcaacatcaaccagtttgctgctgcctacttccaggagctgaccatgtaccggggcaacaccaccatggacatcaaggacctggtgaagcagttccaccagatcaaggtggagaagtggagcgagggcaccaccccccagaagaagctggagtgcctgaaggagcccgggaagacctctgtggagagcaaggtgcccacccagatggagaagagcacagacacagatgaagataatgtgaccaggacagagtacagcgacaagaccacccagttccccagcgtgtatgctgtgcctggaacagagcagacagaggccgtgggcggcctgagcagcaagccagccacccccaagaccaccaccccacccagcagccccccacccacagctgtgtccccagagtttgcctacgtgcctgctgaccctgcccagctggccgcccagatgctggaggatgtggccaagaagagcagcggcagcggggacaagtgtgcccccttcggcagctatggaattgctggggaggtgacagtgaccacagcccacaagaggaggaaggccgagacagagaactag

SEQ ID NO: 145754 - DNA, 1482 bp, Artificial Sequence
  Description of Artificial Sequence: Synthetic coding sequence
atgatcagcagcaagccccggctggtggtgccctacggcctgaagaccctgctggagggcatcagcagagctgtgctgaagaccaaccccagcaacatcaaccagtttgctgctgcctacttccaggagctgaccatgtaccggggcaacaccaccatggacatcaaggacctggtgaagcagttccaccagatcaaggtggagaagtggagcgagggcaccaccccccagaagaagctggagtgcctgaaggagcccgggaagacctctgtggagagcaaggtgcccacccagatggagaagagcacagacacagatgaagataatgtgaccaggacagagtacagcgacaagaccacccagttccccagcgtgtatgctgtgcctggaacagagcagacagaggccgtgggcggcctgagcagcaagccagccacccccaagaccaccaccccacccagcagccccccacccacagctgtgtccccagagtttgcctacgtgcctgctgaccctgcccagctggccgcccagatgctgggcaaggtgagcagcatccacagcgaccagagtgatgtgctgatggtggatgtggccacctccatgcctgtggtgatcaaggaggtgcccagcagcgaggccgcagaagatgtgatggtggccgcccccctggtgtgcagcggcaaggtgctggaggtgcaggtggtgaaccagacctctgtgcacgtggacctgggcagccagcccaaggaaaatgaggccgagcccagcacagccagctctgtgcccctgcaggatgagcaggagcccccagcctatgaccaggcccctgaggtgaccctgcaggccgacatcgaggtgatgagcacagtgcacatcagctctgtgtacaatgatgtgcctgtgacagaaggagtggtgtacatcgagcagctgcctgagcagatcgtcatccccttcacagaccaggtggcctgcctgaaggaaaatgagcagagcaaagaaaatgagcagagcccccgggtgagccccaagtctgtggtggagaagaccaccagcggcatgagcaagaagtctgtggagagcgtgaagctggcccagctggaggagaatgccaagtacagctctgtgtacatggaggccgaggccacagccctgctgagtgacaccagcctgaagggccagcctgaggtgcctgcccagctgctggatgctgagggcgccatcaagattggcagcgagaagagcctgcacctggaggtggagatcaccagcatcgtgtctgacaacacaggccaggaggagagcggggagaacagcgtgccccaggagatggagggcaagcctgtgctgagcggggaggccgctgaggccgtgcacagcggcacctctgtgaagagcagcagcggccccttccccccagcccctgagggcctgacagcccctgagattgagcctgagggggagagcacagctgagtag

SEQ ID NO: 145755 - DNA, 1428 bp, Artificial Sequence
  Description of Artificial Sequence: Synthetic coding sequence
atgatcagcagcaagccccggctggtggtgccctacggcctgaagaccctgctggagggcatcagcagagctgtgctgaagaccaaccccagcaacatcaaccagtttgctgctgcctacttccaggagctgaccatgtacagagtggagaagtggagcgagggcaccaccccccagaagaagctggagtgcctgaaggagcccgggaagacctctgtggagagcaaggtgcccacccagatggagaagagcacagacacagatgaagataatgtgaccaggacagagtacagcgacaagaccacccagttccccagcgtgtatgctgtgcctggaacagagcagacagaggccgtgggcggcctgagcagcaagccagccacccccaagaccaccaccccacccagcagccccccacccacagctgtgtccccagagtttgcctacgtgcctgctgaccctgcccagctggccgcccagatgctgggcaaggtgagcagcatccacagcgaccagagtgatgtgctgatggtggatgtggccacctccatgcctgtggtgatcaaggaggtgcccagcagcgaggccgcagaagatgtgatggtggccgcccccctggtgtgcagcggcaaggtgctggaggtgcaggtggtgaaccagacctctgtgcacgtggacctgggcagccagcccaaggaaaatgaggccgagcccagcacagccagctctgtgcccctgcaggatgagcaggagcccccagcctatgaccaggcccctgaggtgaccctgcaggccgacatcgaggtgatgagcacagtgcacatcagctctgtgtacaatgatgtgcctgtgacagaaggagtggtgtacatcgagcagctgcctgagcagatcgtcatccccttcacagaccaggtggcctgcctgaaggaaaatgagcagagcaaagaaaatgagcagagcccccgggtgagccccaagtctgtggtggagaagaccaccagcggcatgagcaagaagtctgtggagagcgtgaagctggcccagctggaggagaatgccaagtacagctctgtgtacatggaggccgaggccacagccctgctgagtgacaccagcctgaagggccagcctgaggtgcctgcccagctgctggatgctgagggcgccatcaagattggcagcgagaagagcctgcacctggaggtggagatcaccagcatcgtgtctgacaacacaggccaggaggagagcggggagaacagcgtgccccaggagatggagggcaagcctgtgctgagcggggaggccgctgaggccgtgcacagcggcacctctgtgaagagcagcagcggccccttccccccagcccctgagggcctgacagcccctgagattgagcctgagggggagagcacagctgagtag

SEQ ID NO: 145756 - DNA, 1452 bp, Artificial Sequence
  Description of Artificial Sequence: Synthetic coding sequence
atgtccttcagtgacagcagcgccaccttcctgctgaatgaaggcagcgctgacagctacaccagccggcccagcctggacagtgatgtgtccctggaggaggaccgggagagcgcccggcgggaggtggagagccaggcccagcagcagctggagcgggccaagcacaagcctgtggcctttgctgtgaggaccaacgtgtcctactgcggcgtgctggatgaggagtgccctgtgcagggcagcggcgtgaactttgaggccaaggacttcctgcacatcaaggagaagtacagcaatgactggtggattggccgcctggtgaaggagggcggggacatcgccttcatccccagcccccagaggctggagagcatccggctgaagcaggagcagaaggccaggagaagtggcaaccccagcagcctgagtgacatcggcaacagaagaagccccccacccagcctggccaagcagaagcagaagcaggccgagcacgtgcccccctatgatgtggtgcccagcatgaggcctgtggtgctggtgggccccagcctgaagggctatgaggtgacagacatgatgcagaaggccctgtttgacttcctgaagcacagatttgatggccgcatcagcatcaccagggtgacagctgacctgagcctggccaagaggtctgtgctgaacaaccctgggaagaggaccatcatcgagaggagcagcgcccggagcagcattgctgaggtgcagagcgagattgagcgcatctttgagctggccaagagcctgcagctggtggtgctggatgctgacaccatcaaccacccagcccagctggccaagaccagcctggcccccatcatcgtgtttgtgaaggtgagcagccccaaggtgctgcagaggctcatccgcagccggggcaagagccagatgaagcacctgactgtgcagatgatggcctatgacaagctggtgcagtgccccccagagagctttgatgtgatcctggatgagaaccagctggaggatgcctgtgagcacctggccgagtacctggaggtgtactggagggccacccaccacccagcccctggccctggcctgctgggccccccatctgccatccctggcctgcagaaccagcagctgctgggggagcggggggaggagcacagccccctggagcgggacagcctgatgcccagtgatgaggccagcgagagcagccggcaggcctggacaggcagcagccagaggagcagccgccacctggaggaggactatgcagatgcctaccaggacctgtaccagccccaccggcagcacaccagcggcctgcccagcgccaacggccatgacccccaggaccggctgctggcccaggacagcgagcacaaccacagcgacaggaactggcagaggaaccggccctggcccaaggacagctactag

SEQ ID NO: 145757 - DNA, 1416 bp, Artificial Sequence
  Description of Artificial Sequence: Synthetic coding sequence
atggagggcagcgctgacagctacaccagccggcccagcctggacagtgatgtgtccctggaggaggaccgggagagcgcccggcgggaggtggagagccaggcccagcagcagctggagcgggccaagcacaagcctgtggcctttgctgtgaggaccaacgtgtcctactgcggcgtgctggatgaggagtgccctgtgcagggcagcggcgtgaactttgaggccaaggacttcctgcacatcaaggagaagtacagcaatgactggtggattggccgcctggtgaaggagggcggggacatcgccttcatccccagcccccagaggctggagagcatccggctgaagcaggagcagaaggccaggagaagtggcaaccccagcagcctgagtgacatcggcaacagaagaagccccccacccagcctggccaagcagaagcagaagcaggccgagcacgtgcccccctatgatgtggtgcccagcatgaggcctgtggtgctggtgggccccagcctgaagggctatgaggtgacagacatgatgcagaaggccctgtttgacttcctgaagcacagatttgatggccgcatcagcatcaccagggtgacagctgacctgagcctggccaagaggtctgtgctgaacaaccctgggaagaggaccatcatcgagaggagcagcgcccggagcagcattgctgaggtgcagagcgagattgagcgcatctttgagctggccaagagcctgcagctggtggtgctggatgctgacaccatcaaccacccagcccagctggccaagaccagcctggcccccatcatcgtgtttgtgaaggtgagcagccccaaggtgctgcagaggctcatccgcagccggggcaagagccagatgaagcacctgactgtgcagatgatggcctatgacaagctggtgcagtgccccccagagagctttgatgtgatcctggatgagaaccagctggaggatgcctgtgagcacctggccgagtacctggaggtgtactggagggccacccaccacccagcccctggccctggcctgctgggccccccatctgccatccctggcctgcagaaccagcagctgctgggggagcggggggaggagcacagccccctggagcgggacagcctgatgcccagtgatgaggccagcgagagcagccggcaggcctggacaggcagcagccagaggagcagccgccacctggaggaggactatgcagatgcctaccaggacctgtaccagccccaccggcagcacaccagcggcctgcccagcgccaacggccatgacccccaggaccggctgctggcccaggacagcgagcacaaccacagcgacaggaactggcagaggaaccggccctggcccaaggacagctactag

SEQ ID NO: 145758 - DNA, 1332 bp, Artificial Sequence
  Description of Artificial Sequence: Synthetic coding sequence
atgtatgatgacagctatgtgcccggctttgaagattctgaggccggcagcgctgacagctacaccagccggcccagcctggacagtgatgtgtccctggaggaggaccgggagagcgcccggcgggaggtggagagccaggcccagcagcagctggagcgggccaagaagtacagcaatgactggtggattggccgcctggtgaaggagggcggggacatcgccttcatccccagcccccagaggctggagagcatccggctgaagcaggagcagaaggccaggagaagtggcaaccccagcagcctgagtgacatcggcaacagaagaagccccccacccagcctggccaagcagaagcagaagcaggccgagcacgtgcccccctatgatgtggtgcccagcatgaggcctgtggtgctggtgggccccagcctgaagggctatgaggtgacagacatgatgcagaaggccctgtttgacttcctgaagcacagatttgatggccgcatcagcatcaccagggtgacagctgacctgagcctggccaagaggtctgtgctgaacaaccctgggaagaggaccatcatcgagaggagcagcgcccggagcagcattgctgaggtgcagagcgagattgagcgcatctttgagctggccaagagcctgcagctggtggtgctggatgctgacaccatcaaccacccagcccagctggccaagaccagcctggcccccatcatcgtgtttgtgaaggtgagcagccccaaggtgctgcagaggctcatccgcagccggggcaagagccagatgaagcacctgactgtgcagatgatggcctatgacaagctggtgcagtgccccccagagagctttgatgtgatcctggatgagaaccagctggaggatgcctgtgagcacctggccgagtacctggaggtgtactggagggccacccaccacccagcccctggccctggcctgctgggccccccatctgccatccctggcctgcagaaccagcagctgctgggggagcggggggaggagcacagccccctggagcgggacagcctgatgcccagtgatgaggccagcgagagcagccggcaggcctggacaggcagcagccagaggagcagccgccacctggaggaggactatgcagatgcctaccaggacctgtaccagccccaccggcagcacaccagcggcctgcccagcgccaacggccatgacccccaggaccggctgctggcccaggacagcgagcacaaccacagcgacaggaactggcagaggaaccggccctggcccaaggacagctactag

SEQ ID NO: 145759 - DNA, 1377 bp, Artificial Sequence
  Description of Artificial Sequence: Synthetic coding sequence
atgagcagcagcagctatgccaagaatggaacagcagatggcccccacagccccaccagccaggtggcccggggcaccaccaccaggaggagccggctgaagagaagtgatggcagcaccaccagcaccagcttcatcctgcggcagggcagcgctgacagctacaccagccggcccagcgacagtgatgtgtccctggaggaggaccgggaggccatccggcaggagcgggagcagcaggccgccatccagctggagcgggccaagagcaagcctgtggcctttgctgtgaagaccaacgtgtcctactgtggggccctggatgaagatgtgcctgtgcccagcacagccatcagctttgatgccaaggacttcctgcacatcaaggagaagtacaacaatgactggtggattggccgcctggtgaaggagggctgtgagatcggcttcatccccagccccctgcggctggagaacatccgcatccagcaggagcagaagaggggccgcttccacggcggcaagagcagcggcaacagcagcagcagcctgggggagatggtgtctggcaccttccgggccacccccaccagcacagccaagcagaagcagaaggtgacagagcacatccccccctatgatgtggtgcccagcatgaggcctgtggtgctggtgggccccagcctgaagggctatgaggtgacagacatgatgcagaaggccctgtttgacttcctgaagcacagatttgatggccgcatcagcatcaccagggtgacagctgacatcagcctggccaagaggtctgtgctgaacaaccccagcaagagggccatcatcgagaggagcaacaccaggagcagcctggccgaggtgcagagcgagattgaaagaatttttgagctggcccggagcctgcagctggtggtgctggatgctgacaccatcaaccacccagcccagctgatcaagaccagcctggcccccatcatcgtgcacgtgaaggtgagcagccccaaggtgctgcagaggctcatcaagagccggggcaagagccagagcaagcacctgaatgtgcagctggtggccgctgacaagctggcccagtgcccccccagccagaggatgaggcacagcaaccacagcacagagaacagccccatcgagcggcgcagcctgatgaccagtgatgagaactaccacaatgaaagagccaggaagagcaggaaccggctgagcagcagcagccagcacagccgggaccactaccccctggtggaggaggactacccagacagctaccaggacacctacaagccccacaggaacagaggcagccctgggggctacagccatgacagccgccaccggctgtag

SEQ ID NO: 145760 - DNA, 1509 bp, Artificial Sequence
  Description of Artificial Sequence: Synthetic coding sequence
atggatgtggtggcccggggcaccaccaccaggaggagccggctgaagagaagtgatggcagcaccaccagcaccagcttcatcctgcggcagggcagcgctgacagctacaccagccggcccagcgacagtgatgtgtccctggaggaggaccgggaggccatccggcaggagcgggagcagcaggccgccatccagctggagcgggccaagagcaagcctgtggcctttgctgtgaagaccaacgtgtcctactgtggggccctggatgaagatgtgcctgtgcccagcacagccatcagctttgatgccaaggacttcctgcacatcaaggagaagtacaacaatgactggtggattggccgcctggtgaaggagggctgtgagatcggcttcatccccagccccctgcggctggagaacatccgcatccagcaggagcagaagaggggccgcttccacggcggcaagagcagcggcaacagcagcagcagcctgggggagatggtgtctggcaccttccgggccacccccaccagcacagccaagcagaagcagaaggtgacagagcacatccccccctatgatgtggtgcccagcatgaggcctgtggtgctggtgggccccagcctgaagggctatgaggtgacagacatgatgcagaaggccctgtttgacttcctgaagcacagatttgatggccgcatcagcatcaccagggtgacagctgacatcagcctggccaagaggtctgtgctgaacaaccccagcaagagggccatcatcgagaggagcaacaccaggagcagcctggccgaggtgcagagcgagattgaaagaatttttgagctggcccggagcctgcagctggtggtgctggatgctgacaccatcaaccacccagcccagctgatcaagaccagcctggcccccatcatcgtgcacgtgaaggtgagcagccccaaggtgctgcagaggctcatcaagagccggggcaagagccagagcaagcacctgaatgtgcagctggtggccgctgacaagctggcccagtgccccccagagatgtttgatgtgatcctggatgagaaccagctggaggatgcctgtgagcacctgggggagtacctggaggcctactggagggccacccacaccaccagcagcacccccatgacccccctgctgggcaggaacctgggcagcacagccctgagcccctaccccacagccatcagcggcctgcagagccagaggatgaggcacagcaaccacagcacagagaacagccccatcgagcggcgcagcctgatgaccagtgatgagaactaccacaatgaaagagccaggaagagcaggaaccggctgagcagcagcagccagcacagccgggaccactaccccctggtggaggaggactacccagacagctaccaggacacctacaagccccacaggaacagaggcagccctgggggctacagccatgacagccgccaccggctgtag

SEQ ID NO: 145761 - DNA, 3438 bp, Artificial Sequence
  Description of Artificial Sequence: Synthetic coding sequence
atggctgtgcctgcccggacctgtggggccagcaggcctggccctgccaggacagcccggccctggccaggctgcggcccccaccctggccctggcacccggcggcccaccagcggccccccccggcccctgtggctgctgctgcccctgctgcccctgctggccgcccctggggccagcgcctacagcttcccccagcagcacaccatgcagcactgggcccggcggctggagcaggaggtggatggagtgatgaggatctttggaggagtgcagcagctgcgggagatctacaaggacaacagaaacctgtttgaggtgcaggagaatgagccccagaagctggtggagaaggtggccggggacatcgagagcctgctggacaggaaggtgcaggccctgaagaggctggctgatgctgctgagaacttccagaaggcccaccgctggcaggacaacatcaaggaggaggacatcgtgtactatgatgccaaggcagatgctgagctggatgatcctgagagtgaagatgtggagcggggcagcaaggccagcaccctgcggctggacttcatcgaggaccccaacttcaagaacaaggtgaactacagctatgctgctgtgcagatccccacagacatctacaagggcagcaccgtcatcctgaatgagctgaactggacagaggccctggagaatgtgttcatggagaacagacggcaggaccccaccctgctgtggcaggtgtttggcagcgccaccggggtgacccgctactacccagccaccccctggagggcccccaagaagattgacctgtatgatgtgagaagaagaccctggtacatccagggcgccagcagccccaaggacatggtgatcatcgtggatgtgtctggctctgtgtctggcctgaccctgaagctgatgaagacctctgtgtgtgagatgctggacaccctgagtgatgatgattatgtgaatgtggccagcttcaatgagaaggcccagcctgtgtcctgcttcacccacctggtgcaggccaacgtgaggaacaagaaggtgttcaaggaggccgtgcagggcatggtggccaagggcaccaccggctacaaggccggctttgaatatgcctttgaccagctgcagaacagcaacatcacccgggccaactgcaacaagatgatcatgatgttcacagatggaggagaggacagagtgcaggatgtgtttgagaagtacaactggcccaacagaacagtgcgggtcttcaccttctctgtgggccagcacaactatgatgtgacccccctgcagtggatggcctgtgccaacaagggctactactttgagatccccagcattggagccatccgcatcaacacccaggagtacctggatgtgctgggccggcccatggtgctggccggcaaggaggccaagcaggtgcagtggaccaacgtgtatgaagatgccctgggcctgggcctggtggtgacaggcaccctgcccgtcttcaacctgacccaggacggccctggagagaagaagaaccagctgatcctgggcgtgatgggcattgatgtggccctgaatgacatcaagaggctgacccccaactacaccctgggcgccaacggctacgtgtttgccatcgacctgaatggctacgtgctgctgcaccccaacctgaagccccagaccaccaacttccgggagcctgtgaccctggacttcctggatgctgagctggaggatgagaacaaggaggagatcagaagatccatgattgatggcaacaagggccacaagcagatccgcaccctggtgaagagcctggatgagcgctacattgatgaggtgaccaggaactacacctgggtgcccatccgcagcaccaactacagcctgggcctggtgctgcccccctacagcaccttctacctgcaggccaacctgagtgaccagatcctgcaggtgaagtactttgagttcctgctgcccagcagctttgaaagtgagggccacgtgttcatcgccccccgggagtactgcaaggacctgaatgccagtgacaacaacacagagttcctgaagaacttcatcgagctgatggagaaggtgaccccagacagcaagcagtgcaacaacttcctgctgcacaacctgatcctggacaccggcatcacccagcagctggtggagcgggtgtggagggaccaggacctgaacacctacagcctgctggccgtgtttgctgccacagatggcggcatcaccagggtcttccccaacaaggctgctgaggactggacagaaaatcctgagcccttcaatgccagcttctaccgccgcagcctggacaaccacggctacgtgttcaagccaccccaccaggatgccctgctgcggcccctggagctggagaatgacacagtgggcatcctggtgtccacagctgtggagctgagcctgggccgccgcaccctgcggcctgctgtggtgggcgtgaagctggacctggaggcctgggccgagaagttcaaggtgctggccagcaacagaacccaccaggaccagccccagaagtgtggccccaacagccactgtgagatggactgtgaggtgaacaatgaagacctgctgtgtgtgctgattgatgatggcggcttcctggtgctgagcaaccagaaccaccagtgggaccaggtgggccgcttcttcagcgaggtggatgccaacctgatgctggccctgtacaacaacagcttctacaccaggaaggagagctatgactaccaggccgcctgtgccccccagcccccaggcaacctgggcgccgccccccggggcgtgtttgtgcccaccgtggccgacttcctgaacctggcctggtggaccagcgctgctgcctggagcctcttccagcagctgctgtatggcctcatctaccacagctggttccaggccgaccctgctgaggccgagggcagccctgagacccgggagagcagctgtgtgatgaagcagacccagtactactttggatctgtgaatgccagctacaatgccatcatcgactgtggcaactgcagccgcctcttccacgcccagaggctgaccaacaccaacctgctgtttgtggtggccgagaagcccctgtgcagccagtgtgaggccggccgcctgctgcagaaggagacccactgcccagcagatggccctgagcagtgtgagctggtgcagaggccccgctacagaagaggcccccacatctgctttgactacaatgccacagaggacaccagtgactgtggccgcggggccagcttcccccccagcctgggcgtgctggtgtccctgcagctgctgctgctgctgggcctgcccccccggccccagccccaggtgctggtgcacgccagccggcggctgtag

SEQ ID NO: 145762 - DNA, 3231 bp, Artificial Sequence
  Description of Artificial Sequence: Synthetic coding sequence
atgcagcactgggcccggcggctggagcaggaggtggatggagtgatgaggatctttggaggagtgcagcagctgcgggagatctacaaggacaacagaaacctgtttgaggtgcaggagaatgagccccagaagctggtggagaaggtggccggggacatcgagagcctgctggacaggaaggtgcaggccctgaagaggctggctgatgctgctgagaacttccagaaggcccaccgctggcaggacaacatcaaggaggaggacatcgtgtactatgatgccaaggcagatgctgagctggatgatcctgagagtgaagatgtggagcggggcagcaaggccagcaccctgcggctggacttcatcgaggaccccaacttcaagaacaaggtgaactacagctatgctgctgtgcagatccccacagacatctacaagggcagcaccgtcatcctgaatgagctgaactggacagaggccctggagaatgtgttcatggagaacagacggcaggaccccaccctgctgtggcaggtgtttggaagtgccactggagtgacccgctactacccagccaccccctggagggcccccaagaagattgacctgtatgatgtgagaagaagaccctggtacatccagggcgccagcagccccaaggacatggtgatcatcgtggatgtgtctggctctgtgtctggcctgaccctgaagctgatgaagacctctgtgtgtgagatgctggacaccctgagtgatgatgattatgtgaatgtggccagcttcaatgagaaggcccagcctgtgtcctgcttcacccacctggtgcaggccaacgtgaggaacaagaaggtgttcaaggaggccgtgcagggcatggtggccaagggcaccaccggctacaaggccggctttgaatatgcctttgaccagctgcagaacagcaacatcacccgggccaactgcaacaagatgatcatgatgttcacagatggaggagaagatagagtgcaggatgtgtttgagaagtacaactggcccaacagaacagtgcgggtcttcaccttctctgtgggccagcacaactatgatgtgacccccctgcagtggatggcctgtgccaacaagggctactactttgagatccccagcatcggggccatccgcatcaacacccaggagtacctggatgtgctgggccggcccatggtgctggccggcaaggaggccaagcaggtgcagtggaccaacgtgtatgaagatgccctgggcctgggcctggtggtgacaggcaccctgcctgtgttcaacctgacccaggacggccctggagagaagaagaaccagctgatcctgggcgtgatgggcattgatgtggccctgaatgacatcaagaggctgacccccaactacaccctgggcgccaacggctacgtgtttgccatcgacctgaatggctacgtgctgctgcaccccaacctgaagccccagaccaccaacttccgggagcctgtgaccctggacttcctggatgctgagctggaggatgagaacaaggaggagatccgccgctccatgattgatggcaacaagggccacaagcagatccgcaccctggtgaagagcctggatgagcgctacattgatgaggtgaccaggaactacacctgggtgcccatccgcagcaccaactacagcctgggcctggtgctgcccccctacagcaccttctacctgcaggccaacctgagtgaccagatcctgcaggtgaagtactttgagttcctgctgcccagcagctttgagagcgagggccacgtgttcatcgccccccgggagtactgcaaggacctgaatgccagtgacaacaacacagagttcctgaagaacttcatcgagctgatggagaaggtgaccccagacagcaagcagtgcaacaacttcctgctgcacaacctgatcctggacaccggcatcacccagcagctggtggagcgggtgtggagggaccaggacctgaacacctacagcctgctggccgtgtttgctgccacagatggcggcatcaccagggtcttccccaacaaggctgctgaggactggacagagaaccctgagcccttcaatgccagcttctacagaagaagcctggacaaccacggctacgtgttcaagccaccccaccaggatgccctgctgcggcccctggagctggagaatgacacagtgggcatcctggtgtccacagctgtggagctgagcctgggccgccgcaccctgcggcctgctgtggtgggcgtgaagctggacctggaggcctgggccgagaagttcaaggtgctggccagcaacagaacccaccaggaccagccccagaagtgtggccccaacagccactgtgagatggactgtgaggtgaacaatgaagacctgctgtgtgtgctgattgatgatggcggcttcctggtgctgagcaaccagaaccaccagtgggaccaggtgggccgcttcttcagcgaggtggatgccaacctgatgctggccctgtacaacaacagcttctacaccaggaaggagagctatgactaccaggccgcctgtgccccccagcccccaggcaacctgggcgccgccccccggggcgtgtttgtgcccaccgtggccgacttcctgaacctggcctggtggaccagcgctgctgcctggagcctcttccagcagctgctgtatggcctcatctaccacagctggttccaggccgaccctgctgaggccgagggcagccctgagacccgggagagcagctgtgtgatgaagcagacccagtactacttcggctctgtgaatgccagctacaatgccatcatcgactgtggcaactgcagccgcctcttccacgcccagaggctgaccaacaccaacctgctgtttgtggtggccgagaagcccctgtgcagccagtgtgaggccggccgcctgctgcagaaggagacccactgcccagcagatggccctgagcagtgtgagctggtgcagaggccccgctaccgccggggcccccacatctgctttgactacaatgccacagaggacaccagtgactgtggccgcggggccagcttcccccccagcctgggcgtgctggtgtccctgcagctgctgctgctgctgggcctgcccccccggccccagccccaggtgctggtgcacgccagccggcggctgtag

SEQ ID NO: 145763 - DNA, 3441 bp, Artificial Sequence
  Description of Artificial Sequence: Synthetic coding sequence
atggctgtgcctgcccggacctgtggggccagcaggcctggccctgccaggacagcccggccctggccaggctgcggcccccaccctggccctggcacccggcggcccaccagcggccccccccggcccctgtggctgctgctgcccctgctgcccctgctggccgcccctggggccagcgcctacagcttcccccagcagcacaccatgcagcactgggcccggcggctggagcaggaggtggatggagtgatgaggatctttggaggagtgcagcagctgcgggagatctacaaggacaacagaaacctgtttgaggtgcaggagaatgagccccagaagctggtggagaaggtggccggggacatcgagagcctgctggacaggaaggtgcaggccctgaagaggctggctgatgctgctgagaacttccagaaggcccaccgctggcaggacaacatcaaggaggaggacatcgtgtactatgatgccaaggcagatgctgagctggatgatcctgagagtgaagatgtggagcggggcagcaaggccagcaccctgcggctggacttcatcgaggaccccaacttcaagaacaaggtgaactacagctatgctgctgtgcagatccccacagacatctacaagggcagcaccgtcatcctgaatgagctgaactggacagaggccctggagaatgtgttcatggagaacagacggcaggaccccaccctgctgtggcaggtgtttggcagcgccaccggggtgacccgctactacccagccaccccctggagggcccccaagaagattgacctgtatgatgtgagaagaagaccctggtacatccagggcgccagcagccccaaggacatggtgatcatcgtggatgtgtctggctctgtgtctggcctgaccctgaagctgatgaagacctctgtgtgtgagatgctggacaccctgagtgatgatgattatgtgaatgtggccagcttcaatgagaaggcccagcctgtgtcctgcttcacccacctggtgcaggccaacgtgaggaacaagaaggtgttcaaggaggccgtgcagggcatggtggccaagggcaccaccggctacaaggccggctttgaatatgcctttgaccagctgcagaacagcaacatcacccgggccaactgcaacaagatgatcatgatgttcacagatggaggagaggacagagtgcaggatgtgtttgagaagtacaactggcccaacagaacagtgcgggtcttcaccttctctgtgggccagcacaactatgatgtgacccccctgcagtggatggcctgtgccaacaagggctactactttgagatccccagcattggagccatccgcatcaacacccaggagtacctggatgtgctgggccggcccatggtgctggccggcaaggaggccaagcaggtgcagtggaccaacgtgtatgaagatgccctgggcctgggcctggtggtgacaggcaccctgcccgtcttcaacctgacccaggacggccctggagagaagaagaaccagctgatcctgggcgtgatgggcattgatgtggccctgaatgacatcaagaggctgacccccaactacaccctgggcgccaacggctacgtgtttgccatcgacctgaatggctacgtgctgctgcaccccaacctgaagccccagaccaccaacttccgggagcctgtgaccctggacttcctggatgctgagctggaggatgagaacaaggaggagatcagaagatccatgattgatggcaacaagggccacaagcagatccgcaccctggtgaagagcctggatgagcgctacattgatgaggtgaccaggaactacacctgggtgcccatccgcagcaccaactacagcctgggcctggtgctgcccccctacagcaccttctacctgcaggccaacctgagtgaccagatcctgcaggtgaagtactttgagttcctgctgcccagcagctttgaaagtgagggccacgtgttcatcgccccccgggagtactgcaaggacctgaatgccagtgacaacaacacagagttcctgaagaacttcatcgagctgatggagaaggtgaccccagacagcaagcagtgcaacaacttcctgctgcacaacctgatcctggacaccggcatcacccagcagctggtggagcgggtgtggagggaccaggacctgaacacctacagcctgctggccgtgtttgctgccacagatggcggcatcaccagggtcttccccaacaaggctgctgaggactggacagaaaatcctgagcccttcaatgccagcttctaccgccgcagcctggacaaccacggctacgtgttcaagccaccccaccaggatgccctgctgcggcccctggagctggagaatgacacagtgggcatcctggtgtccacagctgtggagctgagcctgggccgccgcaccctgcggcctgctgtggtgggcgtgaagctggacctggaggcctgggccgagaagttcaaggtgctggccagcaacagaacccaccaggaccagccccagaagtgtggccccaacagccactgtgagatggactgtgaggtgaacaatgaagacctgctgtgtgtgctgattgatgatggcggcttcctggtgctgagcaaccagaaccaccagtgggaccaggtgggccgcttcttcagcgaggtggatgccaacctgatgctggccctgtacaacaacagcttctacaccaggaaggagagctatgactaccaggccgcctgtgccccccagcccccaggcaacctgggcgccgccccccggggcgtgtttgtgcccaccgtggccgacttcctgaacctggcctggtggaccagcgctgctgcctggagcctcttccagcagctgctgtatggcctcatctaccacagctggttccaggccgaccctgctgaggccgagggcagccctgagacccgggagagcagctgtgtgatgaagcagacccagtactactttggatctgtgaatgccagctacaatgccatcatcgactgtggcaactgcagccgcctcttccacgcccagaggctgaccaacaccaacctgctgtttgtggtggccgagaagcccctgtgcagccagtgtgaggccggccgcctgctgcagaaggagacccactgctgcccagcagatggccctgagcagtgtgagctggtgcagaggccccgctaccgccggggcccccacatctgctttgactacaatgccacagaggacaccagtgactgtggccgcggggccagcttcccccccagcctgggcgtgctggtgtccctgcagctgctgctgctgctgggcctgcccccccggccccagccccaggtgctggtgcacgccagccggcggctgtag

SEQ ID NO: 145764 - DNA, 3432 bp, Artificial Sequence
  Description of Artificial Sequence: Synthetic coding sequence
atggctgtgcctgcccggacctgtggggccagcaggcctggccctgccaggacagcccggccctggccaggctgcggcccccaccctggccctggcacccggcggcccaccagcggccccccccggcccctgtggctgctgctgcccctgctgcccctgctggccgcccctggggccagcgcctacagcttcccccagcagcacaccatgcagcactgggcccggcggctggagcaggaggtggatggagtgatgaggatctttggaggagtgcagcagctgcgggagatctacaaggacaacagaaacctgtttgaggtgcaggagaatgagccccagaagctggtggagaaggtggccggggacatcgagagcctgctggacaggaaggtgcaggccctgaagaggctggctgatgctgctgagaacttccagaaggcccaccgctggcaggacaacatcaaggaggaggacatcgtgtactatgatgccaaggcagatgctgagctggatgatcctgagagtgaagatgtggagcggggcagcaaggccagcaccctgcggctggacttcatcgaggaccccaacttcaagaacaaggtgaactacagctatgctgctgtgcagatccccacagacatctacaagggcagcaccgtcatcctgaatgagctgaactggacagaggccctggagaatgtgttcatggagaacagacggcaggaccccaccctgctgtggcaggtgtttggcagcgccaccggggtgacccgctactacccagccaccccctggagggcccccaagaagattgacctgtatgatgtgagaagaagaccctggtacatccagggcgccagcagccccaaggacatggtgatcatcgtggatgtgtctggctctgtgtctggcctgaccctgaagctgatgaagacctctgtgtgtgagatgctggacaccctgagtgatgatgattatgtgaatgtggccagcttcaatgagaaggcccagcctgtgtcctgcttcacccacctggtgcaggccaacgtgaggaacaagaaggtgttcaaggaggccgtgcagggcatggtggccaagggcaccaccggctacaaggccggctttgaatatgcctttgaccagctgcagaacagcaacatcacccgggccaactgcaacaagatgatcatgatgttcacagatggaggagaggacagagtgcaggatgtgtttgagaagtacaactggcccaacagaacagtgcgggtcttcaccttctctgtgggccagcacaactatgatgtgacccccctgcagtggatggcctgtgccaacaagggctactactttgagatccccagcattggagccatccgcatcaacacccaggagtacctggatgtgctgggccggcccatggtgctggccggcaaggaggccaagcaggtgcagtggaccaacgtgtatgaagatgccctgggcctgggcctggtggtgacaggcaccctgcccgtcttcaacctgacccaggacggccctggagagaagaagaaccagctgatcctgggcgtgatgggcattgatgtggccctgaatgacatcaagaggctgacccccaactacaccctgggcgccaacggctacgtgtttgccatcgacctgaatggctacgtgctgctgcaccccaacctgaagccccagaccaccaacttccgggagcctgtgaccctggacttcctggatgctgagctggaggatgagaacaaggaggagatcagaagatccatgattgatggcaacaagggccacaagcagatccgcaccctggtgaagagcctggatgagcgctacattgatgaggtgaccaggaactacacctgggtgcccatccgcagcaccaactacagcctgggcctggtgctgcccccctacagcaccttctacctgcaggccaacctgagtgaccagatcctgcaggtgaagtactttgagttcctgctgcccagcagctttgaaagtgagggccacgtgttcatcgccccccgggagtactgcaaggacctgaatgccagtgacaacaacacagagttcctgaagaacttcatcgagctgatggagaaggtgaccccagacagcaagcagtgcaacaacttcctgctgcacaacctgatcctggacaccggcatcacccagcagctggtggagcgggtgtggagggaccaggacctgaacacctacagcctgctggccgtgtttgctgccacagatggcggcatcaccagggtcttccccaacaaggctgctgaggactggacagaaaatcctgagcccttcaatgccagcttctaccgccgcagcctggacaaccacggctacgtgttcaagccaccccaccaggatgccctgctgcggcccctggagctggagaatgacacagtgggcatcctggtgtccacagctgtggagctgagcctgggccgccgcaccctgcggcctgctgtggtgggcgtgaagctggacctggaggcctgggccgagaagttcaaggtgctggccagcaacagaacccaccaggaccagccccagaagtgtggccccaacagccactgtgagatggactgtgaggtgaacaatgaagacctgctgtgtgtgctgattgatgatggcggcttcctggtgctgagcaaccagaaccaccagtgggaccaggtgggccgcttcttcagcgaggtggatgccaacctgatgctggccctgtacaacaacagcttctacaccaggaaggagagctatgactaccaggccgcctgtgccccccagcccccaggcaacctgggcgccgccccccggggcgtgtttgtgcccaccgtggccgacttcctgaacctggcctggtggaccagcgctgctgcctggagcctcttccagcagctgctgtatggcctcatctaccacagctggttccaggccgaccctgctgaggccgagggcagccctgagacccgggagagcagctgtgtgatgaagcagacccagtactactttggatctgtgaatgccagctacaatgccatcatcgactgtggcaactgcagccgcctcttccacgcccagaggctgaccaacaccaacctgctgtttgtggtggccgagaagcccctgtgcagccagtgtgaggccggccgcctgctgcagaaggagacccacagtgatggccctgagcagtgtgagctggtgcagaggccccgctacagaagaggcccccacatctgctttgactacaatgccacagaggacaccagtgactgtggccgcggggccagcttcccccccagcctgggcgtgctggtgtccctgcagctgctgctgctgctgggcctgcccccccggccccagccccaggtgctggtgcacgccagccggcggctgtag

SEQ ID NO: 145765 - DNA, 3462 bp, Artificial Sequence
  Description of Artificial Sequence: Synthetic coding sequence
atggctgtgcctgcccggacctgtggggccagcaggcctggccctgccaggacagcccggccctggccaggctgcggcccccaccctggccctggcacccggcggcccaccagcggccccccccggcccctgtggctgctgctgcccctgctgcccctgctggccgcccctggggccagcgcctacagcttcccccagcagcacaccatgcagcactgggcccggcggctggagcaggaggtggatggagtgatgaggatctttggaggagtgcagcagctgcgggagatctacaaggacaacagaaacctgtttgaggtgcaggagaatgagccccagaagctggtggagaaggtggccggggacatcgagagcctgctggacaggaaggtgcaggccctgaagaggctggctgatgctgctgagaacttccagaaggcccaccgctggcaggacaacatcaaggaggaggacatcgtgtactatgatgccaaggcagatgctgagctggatgatcctgagagtgaagatgtggagcggggcagcaaggccagcaccctgcggctggacttcatcgaggaccccaacttcaagaacaaggtgaactacagctatgctgctgtgcagatccccacagacatctacaagggcagcaccgtcatcctgaatgagctgaactggacagaggccctggagaatgtgttcatggagaacagacggcaggaccccaccctgctgtggcaggtgtttggcagcgccaccggggtgacccgctactacccagccaccccctggagggcccccaagaagattgacctgtatgatgtgagaagaagaccctggtacatccagggcgccagcagccccaaggacatggtgatcatcgtggatgtgtctggctctgtgtctggcctgaccctgaagctgatgaagacctctgtgtgtgagatgctggacaccctgagtgatgatgattatgtgaatgtggccagcttcaatgagaaggcccagcctgtgtcctgcttcacccacctggtgcaggccaacgtgaggaacaagaaggtgttcaaggaggccgtgcagggcatggtggccaagggcaccaccggctacaaggccggctttgaatatgcctttgaccagctgcagaacagcaacatcacccgggccaactgcaacaagatgatcatgatgttcacagatggaggagaggacagagtgcaggatgtgtttgagaagtacaactggcccaacagaacagtgcgggtcttcaccttctctgtgggccagcacaactatgatgtgacccccctgcagtggatggcctgtgccaacaagggctactactttgagatccccagcattggagccatccgcatcaacacccaggagtacctggatgtgctgggccggcccatggtgctggccggcaaggaggccaagcaggtgcagtggaccaacgtgtatgaagatgccctgggcctgggcctggtggtgacaggcaccctgcccgtcttcaacctgacccaggacggccctggagagaagaagaaccagctgatcctgggcgtgatgggcattgatgtggccctgaatgacatcaagaggctgacccccaactacaccctgggcgccaacggctacgtgtttgccatcgacctgaatggctacgtgctgctgcaccccaacctgaagccccagaccaccaacttccgggagcctgtgaccctggacttcctggatgctgagctggaggatgagaacaaggaggagatcagaagatccatgattgatggcaacaagggccacaagcagatccgcaccctggtgaagagcctggatgagcgctacattgatgaggtgaccaggaactacacctgggtgcccatccgcagcaccaactacagcctgggcctggtgctgcccccctacagcaccttctacctgcaggccaacctgagtgaccagatcctgcaggtgaagctgcccatcagcaagctgaaggactttgagttcctgctgcccagcagctttgagagcgagggccacgtgttcatcgccccccgggagtactgcaaggacctgaatgccagtgacaacaacacagagttcctgaagaacttcatcgagctgatggagaaggtgaccccagacagcaagcagtgcaacaacttcctgctgcacaacctgatcctggacaccggcatcacccagcagctggtggagcgggtgtggagggaccaggacctgaacacctacagcctgctggccgtgtttgctgccacagatggcggcatcaccagggtcttccccaacaaggctgctgaggactggacagagaaccctgagcccttcaatgccagcttctacagaagaagcctggacaaccacggctacgtgttcaagccaccccaccaggatgccctgctgcggcccctggagctggagaatgacacagtgggcatcctggtgtccacagctgtggagctgagcctgggccgccgcaccctgcggcctgctgtggtgggcgtgaagctggacctggaggcctgggccgagaagttcaaggtgctggccagcaacagaacccaccaggaccagccccagaagtgtggccccaacagccactgtgagatggactgtgaggtgaacaatgaagacctgctgtgtgtgctgattgatgatggcggcttcctggtgctgagcaaccagaaccaccagtgggaccaggtgggccgcttcttcagcgaggtggatgccaacctgatgctggccctgtacaacaacagcttctacaccaggaaggagagctatgactaccaggccgcctgtgccccccagcccccaggcaacctgggcgccgccccccggggcgtgtttgtgcccaccgtggccgacttcctgaacctggcctggtggaccagcgctgctgcctggagcctcttccagcagctgctgtatggcctcatctaccacagctggttccaggccgaccctgctgaggccgagggcagccctgagacccgggagagcagctgtgtgatgaagcagacccagtactacttcggctctgtgaatgccagctacaatgccatcatcgactgtggcaactgcagccgcctcttccacgcccagaggctgaccaacaccaacctgctgtttgtggtggccgagaagcccctgtgcagccagtgtgaggccggccgcctgctgcagaaggagacccactgctgcccagcagatggccctgagcagtgtgagctggtgcagaggccccgctacagaagaggcccccacatctgctttgactacaatgccacagaggacaccagtgactgtggccgcggggccagcttcccccccagcctgggcgtgctggtgtccctgcagctgctgctgctgctgggcctgcccccccggccccagccccaggtgctggtgcacgccagccggcggctgtag

SEQ ID NO: 145766 - DNA, 3453 bp, Artificial Sequence
  Description of Artificial Sequence: Synthetic coding sequence
atggctgtgcctgcccggacctgtggggccagcaggcctggccctgccaggacagcccggccctggccaggctgcggcccccaccctggccctggcacccggcggcccaccagcggccccccccggcccctgtggctgctgctgcccctgctgcccctgctggccgcccctggggccagcgcctacagcttcccccagcagcacaccatgcagcactgggcccggcggctggagcaggaggtggatggagtgatgaggatctttggaggagtgcagcagctgcgggagatctacaaggacaacagaaacctgtttgaggtgcaggagaatgagccccagaagctggtggagaaggtggccggggacatcgagagcctgctggacaggaaggtgcaggccctgaagaggctggctgatgctgctgagaacttccagaaggcccaccgctggcaggacaacatcaaggaggaggacatcgtgtactatgatgccaaggcagatgctgagctggatgatcctgagagtgaagatgtggagcggggcagcaaggccagcaccctgcggctggacttcatcgaggaccccaacttcaagaacaaggtgaactacagctatgctgctgtgcagatccccacagacatctacaagggcagcaccgtcatcctgaatgagctgaactggacagaggccctggagaatgtgttcatggagaacagacggcaggaccccaccctgctgtggcaggtgtttggcagcgccaccggggtgacccgctactacccagccaccccctggagggcccccaagaagattgacctgtatgatgtgagaagaagaccctggtacatccagggcgccagcagccccaaggacatggtgatcatcgtggatgtgtctggctctgtgtctggcctgaccctgaagctgatgaagacctctgtgtgtgagatgctggacaccctgagtgatgatgattatgtgaatgtggccagcttcaatgagaaggcccagcctgtgtcctgcttcacccacctggtgcaggccaacgtgaggaacaagaaggtgttcaaggaggccgtgcagggcatggtggccaagggcaccaccggctacaaggccggctttgaatatgcctttgaccagctgcagaacagcaacatcacccgggccaactgcaacaagatgatcatgatgttcacagatggaggagaggacagagtgcaggatgtgtttgagaagtacaactggcccaacagaacagtgcgggtcttcaccttctctgtgggccagcacaactatgatgtgacccccctgcagtggatggcctgtgccaacaagggctactactttgagatccccagcattggagccatccgcatcaacacccaggagtacctggatgtgctgggccggcccatggtgctggccggcaaggaggccaagcaggtgcagtggaccaacgtgtatgaagatgccctgggcctgggcctggtggtgacaggcaccctgcccgtcttcaacctgacccaggacggccctggagagaagaagaaccagctgatcctgggcgtgatgggcattgatgtggccctgaatgacatcaagaggctgacccccaactacaccctgggcgccaacggctacgtgtttgccatcgacctgaatggctacgtgctgctgcaccccaacctgaagccccagaccaccaacttccgggagcctgtgaccctggacttcctggatgctgagctggaggatgagaacaaggaggagatcagaagatccatgattgatggcaacaagggccacaagcagatccgcaccctggtgaagagcctggatgagcgctacattgatgaggtgaccaggaactacacctgggtgcccatccgcagcaccaactacagcctgggcctggtgctgcccccctacagcaccttctacctgcaggccaacctgagtgaccagatcctgcaggtgaagctgcccatcagcaagctgaaggactttgagttcctgctgcccagcagctttgagagcgagggccacgtgttcatcgccccccgggagtactgcaaggacctgaatgccagtgacaacaacacagagttcctgaagaacttcatcgagctgatggagaaggtgaccccagacagcaagcagtgcaacaacttcctgctgcacaacctgatcctggacaccggcatcacccagcagctggtggagcgggtgtggagggaccaggacctgaacacctacagcctgctggccgtgtttgctgccacagatggcggcatcaccagggtcttccccaacaaggctgctgaggactggacagagaaccctgagcccttcaatgccagcttctacagaagaagcctggacaaccacggctacgtgttcaagccaccccaccaggatgccctgctgcggcccctggagctggagaatgacacagtgggcatcctggtgtccacagctgtggagctgagcctgggccgccgcaccctgcggcctgctgtggtgggcgtgaagctggacctggaggcctgggccgagaagttcaaggtgctggccagcaacagaacccaccaggaccagccccagaagtgtggccccaacagccactgtgagatggactgtgaggtgaacaatgaagacctgctgtgtgtgctgattgatgatggcggcttcctggtgctgagcaaccagaaccaccagtgggaccaggtgggccgcttcttcagcgaggtggatgccaacctgatgctggccctgtacaacaacagcttctacaccaggaaggagagctatgactaccaggccgcctgtgccccccagcccccaggcaacctgggcgccgccccccggggcgtgtttgtgcccaccgtggccgacttcctgaacctggcctggtggaccagcgctgctgcctggagcctcttccagcagctgctgtatggcctcatctaccacagctggttccaggccgaccctgctgaggccgagggcagccctgagacccgggagagcagctgtgtgatgaagcagacccagtactacttcggctctgtgaatgccagctacaatgccatcatcgactgtggcaactgcagccgcctcttccacgcccagaggctgaccaacaccaacctgctgtttgtggtggccgagaagcccctgtgcagccagtgtgaggccggccgcctgctgcagaaggagacccacagtgatggccctgagcagtgtgagctggtgcagaggccccgctaccgccggggcccccacatctgctttgactacaatgccacagaggacaccagtgactgtggccgcggggccagcttcccccccagcctgggcgtgctggtgtccctgcagctgctgctgctgctgggcctgcccccccggccccagccccaggtgctggtgcacgccagccggcggctgtag

SEQ ID NO: 145767 - DNA, 3276 bp, Artificial Sequence
  Description of Artificial Sequence: Synthetic coding sequence
atggccggccctggcagcccccggcgggccagcagaggagccagcgccctgctggccgccgccctgctgtatgctgccctgggagatgtggtgcgctctgagcagcagatccccctgtctgtggtgaagctgtgggccagcgcctttggaggagagatcaagagcattgctgccaagtacagcggcagccagctgctgcagaagaagtacaaggagtatgagaaggatgtggccatcgaggagattgatggcctgcagctggtgaagaagctggccaagaacatggaggagatgttccacaagaagtctgaggccgtgcggcggctggtggaggccgctgaggaggcccacctgaagcatgaatttgatgctgacctgcagtatgagtacttcaatgctgtgctgatcaatgaaagagacaaggatggcaacttcctggagctgggcaaggagttcatcctggccccaaatgaccacttcaacaacctgcctgtgaacatcagcctgagtgatgtgcaggtgcccaccaacatgtacaacaaggaccctgccatcgtgaatggagtgtactggagcgagagcctgaacaaggtgtttgtggacaactttgaccgggaccccagcctcatctggcagtacttcggcagcgccaagggcttcttccggcagtacccaggcatcaagtgggagccagatgaaaatggagtgattgcctttgactgcaggaacaggaagtggtacatccaggccgccaccagccccaaggatgtggtgatcctggtggatgtgtctggctccatgaagggcctgcggctgaccatcgccaagcagacagtgagcagcatcctggacaccctgggagatgatgacttcttcaacatcatcgcctacaatgaggagctgcactacgtggagccctgcctgaatggcaccctggtgcaggccgacaggaccaacaaggagcacttccgggagcacctggacaagctgtttgccaagggcatcggcatgctggacatcgccctgaatgaggccttcaacatcctgagtgacttcaaccacacaggccagggcagcatctgcagccaggccatcatgctgatcacagatggagctgtggacacctatgacaccatctttgccaagtacaactggccagacaggaaggtgcgcatcttcacctacctgattggccgggaggccgcctttgctgacaacctgaagtggatggcctgtgccaacaagggcttcttcacccagatcagcaccctggctgatgtgcaggagaatgtgatggagtacctgcacgtgctgagccggcccaaggtgattgaccaggagcatgatgtggtgtggacagaggcctacatcgacagcaccctgccccaggcccagaagctgacagatgaccagggccctgtgctgatgaccaccgtggccatgcctgtgttcagcaagcagaatgagaccaggagcaagggcatcctgctgggcgtggtgggcacagatgtgcctgtgaaggagctgctgaagaccatccccaagtacaagctgggcatccacggctacgcctttgccatcaccaacaacggctacatcctgacccaccctgagctgcggctgctgtatgaggagggcaagaagaggaggaagcccaactacagctctgtggacctgtctgaggtggagtgggaggacagagatgatgtgctgagaaatgccatggtgaacaggaagacaggcaagttctccatggaggtgaagaagacagtggacaagggcaagagggtgctggtgatgaccaatgactactactacacagacatcaagggcacccccttcagcctgggcgtggccctgagccggggccacggcaagtacttcttcagaggaaatgtgaccatcgaggagggcctgcatgacctggagcacccagatgtgtccctggctgatgagtggagctactgcaacacagacctgcaccctgagcaccgccacctgagccagctggaggccatcaagctgtacctgaagggcaaggagcccctgctgcagtgtgacaaggagctgatccaggaggtgctgtttgatgctgtggtgtctgcccccatcgaggcctactggaccagcctggccctgaacaagtcagaaaattctgacaagggcgtggaggtggccttcctgggcaccaggacaggcctgagccgcatcaacctgtttgtgggcgctgagcagctgaccaaccaggacttcctgaaggccggggacaaggagaacatcttcaatgctgaccacttccccctgtggtacagaagagctgctgagcagatccctggcagctttgtgtacagcatccccttcagcactggacctgtgaacaagagcaatgtggtgacagccagcaccagcatccagctgctggatgagaggaagagccctgtggtggccgctgtgggcatccagatgaagctggagttcttccagaggaagttctggacagccagccggcagtgtgccagcctggatggcaagtgcagcatcagctgtgatgatgaaacagtgaactgctacctgattgacaacaacggcttcatcctggtgtctgaggactacacccagacaggagacttcttcggggagattgaaggagctgtgatgaacaagctgctgaccatgggcagcttcaagaggatcaccctgtatgactaccaggccatgtgccgggccaacaaggagagcagtgatggagcccacggcctgctggacccctacaatgccttcctgtctgctgtgaagtggatcatgacagagctggtgctcttcctggtggagttcaacctgtgctcctggtggcacagcgacatgacagccaaggcccagaagctgaagcagaccctggagccctgtgacacagagtacccagcctttgtgtctgagaggaccatcaaggagaccaccggcaacatcgcctgtgaggactgcagcaagagctttgtgatccagcagatccccagcagcaacctcttcatggtggtggtggacagcagctgcctgtgtgagagcgtggcccccatcaccatggcccccatcgagatccgctacaatgaaagcctgaagtgtgagcggctgaaggcccagaagatcagaagaagacctgagagctgccacggcttccaccctgaggagaatgcccgggagtgtggcggggcccccagcctgcaggcccagacagtgctgctgctgctgcccctgctgctgatgctgttcagcaggtag

SEQ ID NO: 145768 - DNA, 2997 bp, Artificial Sequence
  Description of Artificial Sequence: Synthetic coding sequence
atgggagagctgcggcaggagaggagcacagccctgcagaggctggtggaggccgctgaggaggcccacctgaagcatgaatttgatgctgacctgcagtatgagtacttcaatgctgtgctgatcaatgaaagagacaaggatggcaacttcctggagctgggcaaggagttcatcctggccccaaatgaccacttcaacaacctgcctgtgaacatcagcctgagtgatgtgcaggtgcccaccaacatgtacaacaaggaccctgccatcgtgaatggagtgtactggagcgagagcctgaacaaggtgtttgtggacaactttgaccgggaccccagcctcatctggcagtacttcggcagcgccaagggcttcttccggcagtacccaggcatcaagtgggagccagatgaaaatggagtgattgcctttgactgcaggaacaggaagtggtacatccaggccgccaccagccccaaggatgtggtgatcctggtggatgtgtctggctccatgaagggcctgcggctgaccatcgccaagcagacagtgagcagcatcctggacaccctgggagatgatgacttcttcaacatcatcgcctacaatgaggagctgcactacgtggagccctgcctgaatggcaccctggtgcaggccgacaggaccaacaaggagcacttccgggagcacctggacaagctgtttgccaagggcatcggcatgctggacatcgccctgaatgaggccttcaacatcctgagtgacttcaaccacacaggccagggcagcatctgcagccaggccatcatgctgatcacagatggagctgtggacacctatgacaccatctttgccaagtacaactggccagacaggaaggtgcgcatcttcacctacctgattggccgggaggccgcctttgctgacaacctgaagtggatggcctgtgccaacaagggcttcttcacccagatcagcaccctggctgatgtgcaggagaatgtgatggagtacctgcacgtgctgagccggcccaaggtgattgaccaggagcatgatgtggtgtggacagaggcctacatcgacagcacagtgtcccaggccgagcagctgacagatgaccagggccctgtgctgatgaccaccgtggccatgcctgtgttcagcaagcagaatgagaccaggagcaagggcatcctgctgggcgtggtgggcacagatgtgcctgtgaaggagctgctgaagaccatccccaagtacaagctgggcatccacggctacgcctttgccatcaccaacaacggctacatcctgacccaccctgagctgcggctgctgtatgaggagggcaagaagaggaggaagcccaactacagctctgtggacctgtctgaggtggagtgggaggacagagatgatgtgctgagaaatgccatggtgaacaggaagacaggcaagttctccatggaggtgaagaagacagtggacaagggcaagagggtgctggtgatgaccaatgactactactacacagacatcaagggcacccccttcagcctgggcgtggccctgagccggggccacggcaagtacttcttcagaggaaatgtgaccatcgaggagggcctgcatgacctggagcacccagatgtgtccctggctgatgagtggagctactgcaacacagacctgcaccctgagcaccgccacctgagccagctggaggccatcaagctgtacctgaagggcaaggagcccctgctgcagtgtgacaaggagctgatccaggaggtgctgtttgatgctgtggtgtctgcccccatcgaggcctactggaccagcctggccctgaacaagtcagaaaattctgacaagggcgtggaggtggccttcctgggcaccaggacaggcctgagccgcatcaacctgtttgtgggcgctgagcagctgaccaaccaggacttcctgaaggccggggacaaggagaacatcttcaatgctgaccacttccccctgtggtacagaagagctgctgagcagatccctggcagctttgtgtacagcatccccttcagcactggacctgtgaacaagagcaatgtggtgacagccagcaccagcatccagctgctggatgagaggaagagccctgtggtggccgctgtgggcatccagatgaagctggagttcttccagaggaagttctggacagccagccggcagtgtgccagcctggatggcaagtgcagcatcagctgtgatgatgaaacagtgaactgctacctgattgacaacaacggcttcatcctggtgtctgaggactacacccagacaggagacttcttcggggagattgaaggagctgtgatgaacaagctgctgaccatgggcagcttcaagaggatcaccctgtatgactaccaggccatgtgccgggccaacaaggagagcagtgatggagcccacggcctgctggacccctacaatgccttcctgtctgctgtgaagtggatcatgacagagctggtgctcttcctggtggagttcaacctgtgctcctggtggcacagcgacatgacagccaaggcccagaagctgaagcagaccctggagccctgtgacacagagtacccagcctttgtgtctgagaggaccatcaaggagaccaccggcaacatcgcctgtgaggactgcagcaagagctttgtgatccagcagatccccagcagcaacctcttcatggtggtggtggacagcagctgcctgtgtgagagcgtggcccccatcaccatggcccccatcgagatcagccagcacaatgaaagcctgaagtgtgagcggctgaaggcccagaagatcagaagaagacctgagagctgccacggcttccacccagaagaaaatgccagagaatgtggcggggcccccagcctgcaggcccagacagtgctgctgctgctgcccctgctgctgatgctgttcagcaggtag

SEQ ID NO: 145769 - DNA, 3276 bp, Artificial Sequence; identical to SEQ ID NO: 145767
  Description of Artificial Sequence: Synthetic coding sequence

SEQ ID NO: 145770 - DNA, 1557 bp, Artificial Sequence
  Description of Artificial Sequence: Synthetic coding sequence
gagatcctcttccaccagatgcagaaccagatcaagaggctggtggaggccgctgaggaggcccacctgaagcatgaatttgatgctgacctgcagtatgagtacttcaatgctgtgctgatcaatgaaagagacaaggatggcaacttcctggagctgggcaaggagttcatcctggccccaaatgaccacttcaacaacctgcctgtgaacatcagcctgagtgatgtgcaggtgcccaccaacatgtacaacaaggaccctgccatcgtgaatggagtgtactggagcgagagcctgaacaaggtgtttgtggacaactttgaccgggaccccagcctcatctggcagtactttggaagtgccaagggcttcttccggcagtacccaggcatcaagtgggagccagatgaaaatggagtcatcgcctttgactgcaggaacaggaagtggtacatccaggccgccaccagccccaaggatgtggtgatcctggtggatgtgtctggctccatgaagggcctgcggctgaccatcgccaagcagacagtgagcagcatcctggacaccctgggagatgatgacttcttcaacatcatcgcctacaatgaggagctgcactacgtggagccctgcctgaatggcaccctggtgcaggccgacaggaccaacaaggagcacttccgggagcacctggacaagctgtttgccaagggcatcggcatgctggacatcgccctgaatgaggccttcaacatcctgagtgacttcaaccacacaggccagggcagcatctgcagccaggccatcatgctgatcacagatggagctgtggacacctatgacaccatctttgccaagtacaactggccagacaggaaggtgcgcatcttcacctacctgattggccgggaggccgcctttgctgacaacctgaagtggatggcctgtgccaacaagggcttcttcacccagatcagcaccctggctgatgtgcaggagaatgtgatggagtacctgcacgtgctgagccggcccaaggtgattgaccaggagcatgatgtggtgtggacagaggcctacatcgacagcaccctgacagatgaccagggccctgtgctgatgaccaccgtggccatgcctgtgttcagcaagcagaatgagaccaggagcaagggcatcctgctgggcgtggtgggcacagatgtgcctgtgaaggagctgctgaagaccatccccaagtacaagctgggcatccacggctacgcctttgccatcaccaacaacggctacatcctgacccaccctgagctgcggctgctgtatgaggagggcaagaagaggaggaagcccaactacagctctgtggacctgtctgaggtggagtgggaggacagagatgatgtgctgagaaatgccatggtgaacaggaagacaggcaagttctccatggaggtgaagaagacagtggacaagggcttccgctgtggggccttccagaggtcctgggagatcttcctgccccgggagtgcaaccacagaagaagacctgcctag

SEQ ID NO: 145771 - DNA, 3276 bp, Artificial Sequence; identical to SEQ ID NO: 145767
  Description of Artificial Sequence: Synthetic coding sequence

SEQ ID NO: 145772 - DNA, 1578 bp, Artificial Sequence
  Description of Artificial Sequence: Synthetic coding sequence
atggaggagatgttccacaagaagtctgaggccgtgcggcggctggtggaggccgctgaggaggcccacctgaagcatgaatttgatgctgacctgcagtatgagtacttcaatgctgtgctgatcaatgaaagagacaaggatggcaacttcctggagctgggcaaggagttcatcctggccccaaatgaccacttcaacaacctgcctgtgaacatcagcctgagtgatgtgcaggtgcccaccaacatgtacaacaaggaccctgccatcgtgaatggagtgtactggagcgagagcctgaacaaggtgtttgtggacaactttgaccgggaccccagcctcatctggcagtacttcggcagcgccaagggcttcttccggcagtacccaggcatcaagtgggagccagatgaaaatggagtgattgcctttgactgcaggaacaggaagtggtacatccaggccgccaccagccccaaggatgtggtgatcctggtggatgtgtctggctccatgaagggcctgcggctgaccatcgccaagcagacagtgagcagcatcctggacaccctgggagatgatgacttcttcaacatcatcgcctacaatgaggagctgcactacgtggagccctgcctgaatggcaccctggtgcaggccgacaggaccaacaaggagcacttccgggagcacctggacaagctgtttgccaagggcatcggcatgctggacatcgccctgaatgaggccttcaacatcctgagtgacttcaaccacacaggccagggcagcatctgcagccaggccatcatgctgatcacagatggagctgtggacacctatgacaccatctttgccaagtacaactggccagacaggaaggtgcgcatcttcacctacctgattggccgggaggccgcctttgctgacaacctgaagtggatggcctgtgccaacaagggcttcttcacccagatcagcaccctggctgatgtgcaggagaatgtgatggagtacctgcacgtgctgagccggcccaaggtgattgaccaggagcatgatgtggtgtggacagaggcctacatcgacagcaccctgccccaggcccagaagctgacagatgaccagggccctgtgctgatgaccaccgtggccatgcctgtgttcagcaagcagaatgagaccaggagcaagggcatcctgctgggcgtggtgggcacagatgtgcctgtgaaggagctgctgaagaccatccccaagtacaagctgggcatccacggctacgcctttgccatcaccaacaacggctacatcctgacccaccctgagctgcggctgctgtatgaggagggcaagaagaggaggaagcccaactacagctctgtggacctgtctgaggtggagtgggaggacagagatgatgtgctgagaaatgccatggtgaacaggaagacaggcaagttctccatggaggtgaagaagacagtggacaagggcttccgctgtggggccttccagaggtcctgggagatcttcctgccccgggagtgcaaccacagaagaagacctgcctag

SEQ ID NO: 145773 - DNA, 2994 bp, Artificial Sequence
  Description of Artificial Sequence: Synthetic coding sequence
atggaggagatgttccacaagaagtctgaggccgtgcggcggctggtggaggccgctgaggaggcccacctgaagcatgaatttgatgctgacctgcagtatgagtacttcaatgctgtgctgatcaatgaaagagacaaggatggcaacttcctggagctgggcaaggagttcatcctggccccaaatgaccacttcaacaacctgcctgtgaacatcagcctgagtgatgtgcaggtgcccaccaacatgtacaacaaggaccctgccatcgtgaatggagtgtactggagcgagagcctgaacaaggtgtttgtggacaactttgaccgggaccccagcctcatctggcagtacttcggcagcgccaagggcttcttccggcagtacccaggcatcaagtgggagccagatgaaaatggagtgattgcctttgactgcaggaacaggaagtggtacatccaggccgccaccagccccaaggatgtggtgatcctggtggatgtgtctggctccatgaagggcctgcggctgaccatcgccaagcagacagtgagcagcatcctggacaccctgggagatgatgacttcttcaacatcatcgcctacaatgaggagctgcactacgtggagccctgcctgaatggcaccctggtgcaggccgacaggaccaacaaggagcacttccgggagcacctggacaagctgtttgccaagggcatcggcatgctggacatcgccctgaatgaggccttcaacatcctgagtgacttcaaccacacaggccagggcagcatctgcagccaggccatcatgctgatcacagatggagctgtggacacctatgacaccatctttgccaagtacaactggccagacaggaaggtgcgcatcttcacctacctgattggccgggaggccgcctttgctgacaacctgaagtggatggcctgtgccaacaagggcttcttcacccagatcagcaccctggctgatgtgcaggagaatgtgatggagtacctgcacgtgctgagccggcccaaggtgattgaccaggagcatgatgtggtgtggacagaggcctacatcgacagcaccctgccccaggcccagaagctgacagatgaccagggccctgtgctgatgaccaccgtggccatgcctgtgttcagcaagcagaatgagaccaggagcaagggcatcctgctgggcgtggtgggcacagatgtgcctgtgaaggagctgctgaagaccatccccaagtacaagctgggcatccacggctacgcctttgccatcaccaacaacggctacatcctgacccaccctgagctgcggctgctgtatgaggagggcaagaagaggaggaagcccaactacagctctgtggacctgtctgaggtggagtgggaggacagagatgatgtgctgagaaatgccatggtgaacaggaagacaggcaagttctccatggaggtgaagaagacagtggacaagggcaagagggtgctggtgatgaccaatgactactactacacagacatcaagggcacccccttcagcctgggcgtggccctgagccggggccacggcaagtacttcttcagaggaaatgtgaccatcgaggagggcctgcatgacctggagcacccagatgtgtccctggctgatgagtggagctactgcaacacagacctgcaccctgagcaccgccacctgagccagctggaggccatcaagctgtacctgaagggcaaggagcccctgctgcagtgtgacaaggagctgatccaggaggtgctgtttgatgctgtggtgtctgcccccatcgaggcctactggaccagcctggccctgaacaagtcagaaaattctgacaagggcgtggaggtggccttcctgggcaccaggacaggcctgagccgcatcaacctgtttgtgggcgctgagcagctgaccaaccaggacttcctgaaggccggggacaaggagaacatcttcaatgctgaccacttccccctgtggtacagaagagctgctgagcagatccctggcagctttgtgtacagcatccccttcagcactggacctgtgaacaagagcaatgtggtgacagccagcaccagcatccagctgctggatgagaggaagagccctgtggtggccgctgtgggcatccagatgaagctggagttcttccagaggaagttctggacagccagccggcagtgtgccagcctggatggcaagtgcagcatcagctgtgatgatgaaacagtgaactgctacctgattgacaacaacggcttcatcctggtgtctgaggactacacccagacaggagacttcttcggggagattgaaggagctgtgatgaacaagctgctgaccatgggcagcttcaagaggatcaccctgtatgactaccaggccatgtgccgggccaacaaggagagcagtgatggagcccacggcctgctggacccctacaatgccttcctgtctgctgtgaagtggatcatgacagagctggtgctcttcctggtggagttcaacctgtgctcctggtggcacagcgacatgacagccaaggcccagaagctgaagcagaccctggagccctgtgacacagagtacccagcctttgtgtctgagaggaccatcaaggagaccaccggcaacatcgcctgtgaggactgcagcaagagctttgtgatccagcagatccccagcagcaacctcttcatggtggtggtggacagcagctgcctgtgtgagagcgtggcccccatcaccatggcccccatcgagatccgctacaatgaaagcctgaagtgtgagcggctgaaggcccagaagatcagaagaagacctgagagctgccacggcttccaccctgaggagaatgcccgggagtgtggcggggcccccagcctgcaggcccagacagtgctgctgctgctgcccctgctgctgatgctgttcagcaggtag

SEQ ID NO: 145774 - DNA, 381 bp, Artificial Sequence
  Description of Artificial Sequence: Synthetic coding sequence
atggaggagatgttccacaagaagtctgaggccgtgcggcggctggtggaggccgctgaggaggcccacctgaagcatgaatttgatgctgacctgcagtatgagtacttcaatgctgtgctgatcaatgaaagagacaaggatggcaacttcctggagctgggcaaggagttcatcctggccccaaatgaccacttcaacaacctgcctgtgaacatcagcctgagtgatgtgcaggtgcccaccaacatgtacaacaaggaccctgccatcgtgaatggagtgtactggagcgagagcctgaacaaggtgtttgtggacaactttgaccgggaccccagcctcatctggcagtacttcggcagcgccaagggcttctag

SEQ ID NO: 145775 - DNA, 2925 bp, Artificial Sequence
  Description of Artificial Sequence: Synthetic coding sequence
atggtgtgtggctgcagcgccctgctgcccctgcccaacccccggcccaccatgcctgccacccccaacttcctggccaaccccagcagcagcagccgctggatccccctgcagcccatgcctgtggcctgggcctttgtgcagaagaccagcgccctgctgtggctgctgctgctgggcaccagcctgagccctgcctggggccaggccaagatccccctggagaccgtgaagctgtgggccgacaccttcggcggggacctgtacaacacagtgaccaagtacagcggcagcctgctgctgcagaagaagtacaaggatgtggagagcagcctgaagattgaggaggtggatggcctggagctggtgaggaagttcagcgaggacatggagaacatgctgcggaggaaggtggaggccgtgcagaacctggtggaggccgctgaggaggccgacctgaaccacgagttcaatgaaagcctggtgtttgactactacaacagcgtgctgatcaatgaaagagatgagaagggcaactttgtggagctgggcgctgagttcctgctggagagcaatgcccacttcagcaacctgcctgtgaacaccagcatcagctctgtgcagctgcccaccaacgtgtacaacaaggaccctgacatcctgaatggagtgtacatgtctgaggccctgaatgctgtgtttgtggagaacttccagagggaccccaccctgacctggcagtactttggaagtgccaccggcttcttccgcatctacccaggcatcaagtggaccccagatgaaaatggagtcatcacctttgactgcaggaacagaggctggtacatccaggccgccaccagccccaaggacatcgtcatcctggtggatgtgtctggctccatgaagggcctgaggatgaccatcgccaagcacaccatcaccaccatcctggacaccctgggagaaaatgacttcatcaacatcatcgcctacaatgactatgtgcactacatcgagccctgcttcaagggcatcctggtgcaggccgaccgggacaaccgggagcacttcaagctgctggtggaggagctgatggtgaagggcgtgggcgtggtggaccaggccctgcgggaggccttccagatcctgaagcagttccaggaggccaagcagggcagcctgtgcaaccaggccatcatgctgatcagtgatggagctgtggaggactatgagcctgtgtttgagaagtacaactggccagactgcaaggtgcgggtcttcacctacctgattggccgggaggtgtcctttgctgacaggatgaagtggatcgcctgcaacaacaagggctactacacccagatcagcaccctggccgacacccaggagaatgtgatggagtacctgcacgtgctgagccggcccatggtgatcaaccacgaccatgacatcatctggacagaggcctacatggacagcaagctgctgagcagccaggcccagagcctgaccctgctgaccaccgtggccatgcctgtgttcagcaagaagaatgagaccaggagccacggcatcctgctgggcgtggtgggcagtgatgtggccctgcgggagctgatgaagctggccccccgctacaagctgggcgtgcacggctacgccttcctgaacaccaacaacggctacatcctgagccacccagacctgcggcccctgtaccgggagggcaagaagctgaagcccaagcccaactacaacagcgtggacctgtctgaggtggagtgggaggaccaggccgagagcctgaggacagccatgatcaaccgggagaccggcaccctgtccatggatgtgaaggtgcccatggacaagggcaagagggtgctcttcctgaccaatgactacttcttcacagacatcagtgacacccccttcagcctgggcgtggtgctgagccggggccacggggagtacatcctgctgggcaacacctctgtggaggagggcctgcatgacctgctgcacccagacctggccctggccggggactggatctactgcatcacagacatcgaccctgaccacaggaagctgagccagctggaggccatgatccgcttcctgaccaggaaggaccctgacctggagtgtgatgaggagctggtgcgggaggtgctgtttgatgctgtggtgacagcccccatggaggcctactggacagccctggccctgaacatgtctgaggagagcgagcacgtggtggacatggccttcctgggcacccgggccggcctgctgcggagcagcctgtttgtgggcagcgagaaggtgtctgacaggaagttcctgaccccagaagatgaggcctctgtgttcaccctggaccgcttccccctgtggtaccggcaggccagcgagcaccctgctggcagctttgtgttcaacctgcgctgggccgagggccctgagagcgctggggagcccatggtggtgacagccagcacagctgtggccgtgacagtggacaagaggacagccatcgctgctgctgctggggtgcagatgaagctggagttcctgcagaggaagttctgggccgccacccggcagtgcagcacagtggatggcccctgcacccagagctgtgaggacagcgacctggactgctttgtgattgacaacaacggcttcatcctgatcagcaagaggagccgggagaccggccgcttcctgggggaggtggatggagctgtgctgacccagctgctgtccatgggcgtcttcagccaggtgaccatgtatgactaccaggccatgtgcaagcccagcagccaccaccacagcgctgcccagcccctggtgagccccatcagcgccttcctgacagccacccgctggctgctgcaggagctggtgctgtag

SEQ ID NO: 145776 - DNA, 3414 bp, Artificial Sequence
  Description of Artificial Sequence: Synthetic coding sequence
atggtgtgtggctgcagcgccctgctgcccctgcccaacccccggcccaccatgcctgccacccccaacttcctggccaaccccagcagcagcagccgctggatccccctgcagcccatgcctgtggcctgggcctttgtgcagaagaccagcgccctgctgtggctgctgctgctgggcaccagcctgagccctgcctggggccaggccaagatccccctggagaccgtgaagctgtgggccgacaccttcggcggggacctgtacaacacagtgaccaagtacagcggcagcctgctgctgcagaagaagtacaaggatgtggagagcagcctgaagattgaggaggtggatggcctggagctggtgaggaagttcagcgaggacatggagaacatgctgcggaggaaggtggaggccgtgcagaacctggtggaggccgctgaggaggccgacctgaaccacgagttcaatgaaagcctggtgtttgactactacaacagcgtgctgatcaatgaaagagatgagaagggcaactttgtggagctgggcgctgagttcctgctggagagcaatgcccacttcagcaacctgcctgtgaacaccagcatcagctctgtgcagctgcccaccaacgtgtacaacaaggaccctgacatcctgaatggagtgtacatgtctgaggccctgaatgctgtgtttgtggagaacttccagagggaccccaccctgacctggcagtactttggaagtgccaccggcttcttccgcatctacccaggcatcaagtggaccccagatgaaaatggagtcatcacctttgactgcaggaacagaggctggtacatccaggccgccaccagccccaaggacatcgtcatcctggtggatgtgtctggctccatgaagggcctgaggatgaccatcgccaagcacaccatcaccaccatcctggacaccctgggagaaaatgacttcatcaacatcatcgcctacaatgactatgtgcactacatcgagccctgcttcaagggcatcctggtgcaggccgaccgggacaaccgggagcacttcaagctgctggtggaggagctgatggtgaagggcgtgggcgtggtggaccaggccctgcgggaggccttccagatcctgaagcagttccaggaggccaagcagggcagcctgtgcaaccaggccatcatgctgatcagtgatggagctgtggaggactatgagcctgtgtttgagaagtacaactggccagactgcaaggtgcgggtcttcacctacctgattggccgggaggtgtcctttgctgacaggatgaagtggatcgcctgcaacaacaagggctactacacccagatcagcaccctggccgacacccaggagaatgtgatggagtacctgcacgtgctgagccggcccatggtgatcaaccacgaccatgacatcatctggacagaggcctacatggacagcaagctgctgagcagccaggcccagagcctgaccctgctgaccaccgtggccatgcctgtgttcagcaagaagaatgagaccaggagccacggcatcctgctgggcgtggtgggcagtgatgtggccctgcgggagctgatgaagctggccccccgctacaagctgggcgtgcacggctacgccttcctgaacaccaacaacggctacatcctgagccacccagacctgcggcccctgtaccgggagggcaagaagctgaagcccaagcccaactacaacagcgtggacctgtctgaggtggagtgggaggaccaggccgagagcctgaggacagccatgatcaaccgggagaccggcaccctgtccatggatgtgaaggtgcccatggacaagggcaagagggtgctcttcctgaccaatgactacttcttcacagacatcagtgacacccccttcagcctgggcgtggtgctgagccggggccacggggagtacatcctgctgggcaacacctctgtggaggagggcctgcatgacctgctgcacccagacctggccctggccggggactggatctactgcatcacagacatcgaccctgaccacaggaagctgagccagctggaggccatgatccgcttcctgaccaggaaggaccctgacctggagtgtgatgaggagctggtgcgggaggtgctgtttgatgctgtggtgacagcccccatggaggcctactggacagccctggccctgaacatgtctgaggagagcgagcacgtggtggacatggccttcctgggcacccgggccggcctgctgcggagcagcctgtttgtgggcagcgagaaggtgtctgacaggaagttcctgaccccagaagatgaggcctctgtgttcaccctggaccgcttccccctgtggtaccggcaggccagcgagcaccctgctggcagctttgtgttcaacctgcgctgggccgagggccctgagagcgctggggagcccatggtggtgacagccagcacagctgtggccgtgacagtggacaagaggacagccatcgctgctgctgctggggtgcagatgaagctggagttcctgcagaggaagttctgggccgccacccggcagtgcagcacagtggatggcccctgcacccagagctgtgaggacagcgacctggactgctttgtgattgacaacaacggcttcatcctgatcagcaagaggagccgggagaccggccgcttcctgggggaggtggatggagctgtgctgacccagctgctgtccatgggcgtcttcagccaggtgaccatgtatgactaccaggccatgtgcaagcccagcagccaccaccacagcgctgcccagcccctggtgagccccatcagcgccttcctgacagccacccgctggctgctgcaggagctggtgctcttcctgctggagtggagcgtgtggggctcctggtatgacagaggagctgaggccaagagcgtcttccaccacagccacaagcacaagaagcaggaccccctgcagccctgtgacacagagtaccctgtgtttgtgtaccagcctgccatccgggaggccaacggcatcgtggagtgtggcccctgccagaaggtgtttgtggtgcagcagatccccaacagcaacctgctgctgctggtgacagaccccacctgtgactgcagcatcttcccccctgtgctgcaggaggccacagaggtgaagtacaatgcctctgtgaagtgtgacaggatgaggagccagaagctgcggcggcggccagacagctgccacgccttccaccctgaggagaatgcccaggactgtggcggggccagtgacaccagcgccagcccccccctgctgctgctgcctgtgtgtgcctggggcctgctgccccagctgctgaggtag

SEQ ID NO: 145777 - DNA, 3222 bp, Artificial Sequence
  Description of Artificial Sequence: Synthetic coding sequence
atggctgtggccctgggcaccaggagaagagacagagtgaagctgtgggccgacaccttcggcggggacctgtacaacacagtgaccaagtacagcggcagcctgctgctgcagaagaagtacaaggatgtggagagcagcctgaagattgaggaggtggatggcctggagctggtgaggaagttcagcgaggacatggagaacatgctgcggaggaaggtggaggccgtgcagaacctggtggaggccgctgaggaggccgacctgaaccacgagttcaatgaaagcctggtgtttgactactacaacagcgtgctgatcaatgaaagagatgagaagggcaactttgtggagctgggcgctgagttcctgctggagagcaatgcccacttcagcaacctgcctgtgaacaccagcatcagctctgtgcagctgcccaccaacgtgtacaacaaggaccctgacatcctgaatggagtgtacatgtctgaggccctgaatgctgtgtttgtggagaacttccagagggaccccaccctgacctggcagtactttggaagtgccaccggcttcttccgcatctacccaggcatcaagtggaccccagatgaaaatggagtcatcacctttgactgcaggaacagaggctggtacatccaggccgccaccagccccaaggacatcgtcatcctggtggatgtgtctggctccatgaagggcctgaggatgaccatcgccaagcacaccatcaccaccatcctggacaccctgggagaaaatgacttcatcaacatcatcgcctacaatgactatgtgcactacatcgagccctgcttcaagggcatcctggtgcaggccgaccgggacaaccgggagcacttcaagctgctggtggaggagctgatggtgaagggcgtgggcgtggtggaccaggccctgcgggaggccttccagatcctgaagcagttccaggaggccaagcagggcagcctgtgcaaccaggccatcatgctgatcagtgatggagctgtggaggactatgagcctgtgtttgagaagtacaactggccagactgcaaggtgcgggtcttcacctacctgattggccgggaggtgtcctttgctgacaggatgaagtggatcgcctgcaacaacaagggctactacacccagatcagcaccctggccgacacccaggagaatgtgatggagtacctgcacgtgctgagccggcccatggtgatcaaccacgaccatgacatcatctggacagaggcctacatggacagcaagctgctgagcagccaggcccagagcctgaccctgctgaccaccgtggccatgcctgtgttcagcaagaagaatgagaccaggagccacggcatcctgctgggcgtggtgggcagtgatgtggccctgcgggagctgatgaagctggccccccgctacaagctgggcgtgcacggctacgccttcctgaacaccaacaacggctacatcctgagccacccagacctgcggcccctgtaccgggagggcaagaagctgaagcccaagcccaactacaacagcgtggacctgtctgaggtggagtgggaggaccaggccgagagcctgaggacagccatgatcaaccgggagaccggcaccctgtccatggatgtgaaggtgcccatggacaagggcaagagggtgctcttcctgaccaatgactacttcttcacagacatcagtgacacccccttcagcctgggcgtggtgctgagccggggccacggggagtacatcctgctgggcaacacctctgtggaggagggcctgcatgacctgctgcacccagacctggccctggccggggactggatctactgcatcacagacatcgaccctgaccacaggaagctgagccagctggaggccatgatccgcttcctgaccaggaaggaccctgacctggagtgtgatgaggagctggtgcgggaggtgctgtttgatgctgtggtgacagcccccatggaggcctactggacagccctggccctgaacatgtctgaggagagcgagcacgtggtggacatggccttcctgggcacccgggccggcctgctgcggagcagcctgtttgtgggcagcgagaaggtgtctgacaggaagttcctgaccccagaagatgaggcctctgtgttcaccctggaccgcttccccctgtggtaccggcaggccagcgagcaccctgctggcagctttgtgttcaacctgcgctgggccgagggccctgagagcgctggggagcccatggtggtgacagccagcacagctgtggccgtgacagtggacaagaggacagccatcgctgctgctgctggggtgcagatgaagctggagttcctgcagaggaagttctgggccgccacccggcagtgcagcacagtggatggcccctgcacccagagctgtgaggacagcgacctggactgctttgtgattgacaacaacggcttcatcctgatcagcaagaggagccgggagaccggccgcttcctgggggaggtggatggagctgtgctgacccagctgctgtccatgggcgtcttcagccaggtgaccatgtatgactaccaggccatgtgcaagcccagcagccaccaccacagcgctgcccagcccctggtgagccccatcagcgccttcctgacagccacccgctggctgctgcaggagctggtgctcttcctgctggagtggagcgtgtggggctcctggtatgacagaggagctgaggccaagagcgtcttccaccacagccacaagcacaagaagcaggaccccctgcagccctgtgacacagagtaccctgtgtttgtgtaccagcctgccatccgggaggccaacggcatcgtggagtgtggcccctgccagaaggtgtttgtggtgcagcagatccccaacagcaacctgctgctgctggtgacagaccccacctgtgactgcagcatcttcccccctgtgctgcaggaggccacagaggtgaagtacaatgcctctgtgaagtgtgacaggatgaggagccagaagctgcggcggcggccagacagctgccacgccttccaccctgaggagaatgcccaggactgtggcggggccagtgacaccagcgccagcccccccctgctgctgctgcctgtgtgtgcctggggcctgctgccccagctgctgaggtag

SEQ ID NO: 145778 - DNA, 615 bp, Artificial Sequence
  Description of Artificial Sequence: Synthetic coding sequence
atgtatgactaccaggccatgtgcaagcccagcagccaccaccacagcgctgcccagcccctggtgagccccatcagcgccttcctgacagccacccgctggctgctgcaggagctggtgctcttcctgctggagtggagcgtgtggggctcctggtatgacagaggagctgaggccaagtctgtgttccaccacagccacaagcacaagaagcaggaccccctgcagccctgtgacacagagtaccctgtgtttgtgtaccagcctgccatccgggaggccaatggaattgtggagtgtggcccctgccagaaggtgtttgtggtgcagcagatccccaacagcaacctgctgctgctggtgacagaccccacctgtgactgcagcatcttcccccctgtgctgcaggaggccacagaggtgaagtacaatgcctctgtgaagtgtgacaggatgaggagccagaagctgcggcggcggccagacagctgccacgccttccacccagaagaaaatgcccaggactgtggcggggccagtgacaccagcgccagcccccccctgctgctgctgcctgtgtgtgcctggggcctgctgccccagctgctgaggtag

SEQ ID NO: 145779 - DNA, 615 bp, Artificial Sequence; identical to SEQ ID NO: 145778
  Description of Artificial Sequence: Synthetic coding sequence

SEQ ID NO: 145780 - DNA, 804 bp, Artificial Sequence
  Description of Artificial Sequence: Synthetic coding sequence
atgaagctggagttcctgcagaggaagttctgggccgccacccggcaggacctggactgctttgtgattgacaacaacggcttcatcctgatcagcaagaggagccgggagaccggccgcttcctgggggaggtggatggagctgtgctgacccagctgctgtccatgggcgtcttcagccaggtgaccatgtatgactaccaggccatgtgcaagcccagcagccaccaccacagcgctgcccagcccctggtgagccccatcagcgccttcctgacagccacccgctggctgctgcaggagctggtgctcttcctgctggagtggagcgtgtggggctcctggtatgacagaggagctgaggccaagagcgtcttccaccacagccacaagcacaagaagcaggaccccctgcagccctgtgacacagagtaccctgtgtttgtgtaccagcctgccatccgggaggccaacggcatcgtggagtgtggcccctgccagaaggtgtttgtggtgcagcagatccccaacagcaacctgctgctgctggtgacagaccccacctgtgactgcagcatcttcccccctgtgctgcaggaggccacagaggtgaagtacaatgcctctgtgaagtgtgacaggatgaggagccagaagctgcggcggcggccagacagctgccacgccttccaccctgaggagaatgcccaggactgtggcggggccagtgacaccagcgccagcccccccctgctgctgctgcctgtgtgtgcctggggcctgctgccccagctgctgaggtag

SEQ ID NO: 145781 - DNA, 615 bp, Artificial Sequence; identical to SEQ ID NO: 145778
  Description of Artificial Sequence: Synthetic coding sequence

SEQ ID NO: 145782 - DNA, 1572 bp, Artificial Sequence
  Description of Artificial Sequence: Synthetic coding sequence
atggtgcagaagacctccatgagccggggcccctacccacccagccaggagatccccatggaggtgtttgaccccagcccccagggcaagtacagcaagaggaagggccgcttcaagagaagtgatggcagcaccagcagtgacaccaccagcaacagctttgtgcggcagggcagcgctgagagctacaccagccggcccagcgacagtgatgtgtccctggaggaggaccgggaggccctgaggaaggaggccgagcggcaggccctggcccagctggagaaggccaagaccaagcctgtggcctttgctgtgaggaccaacgtgggctacaaccccagccctggagatgaggtgcctgtgcagggcgtggccatcacctttgagcccaaggacttcctgcacatcaaggagaagtacaacaatgactggtggattggccgcctggtgaaggagggctgtgaggtgggcttcatccccagccctgtgaagctggacagcctgcggctgctgcaggagcagaagctgcggcagaaccggctgggcagcagcaagagcggggacaacagcagcagcagcctgggagatgtggtgacaggcacccggcggcccaccccaccagccagcggaaatgagatgaccaacctggcctttgagctggaccccctggagctggaggaggaggaggccgagctgggggagcagagcggcagcgccaagacctctgtgtcctctgtgaccaccccaccaccccacggcaagaggatccccttcttcaagaagacagagcacgtgcccccctatgatgtggtgcccagcatgaggcccatcatcctggtgggccccagcctgaagggctatgaggtgacagacatgatgcagaaggccctgtttgacttcctgaagcacagatttgatggccgcatcagcatcaccagggtgacagctgacatcagcctggccaagaggtctgtgctgaacaaccccagcaagcacatcatcatcgagaggagcaacaccaggagcagcctggccgaggtgcagagcgagattgagcgcatctttgagctggcccggaccctgcagctggtggccctggatgctgacaccatcaaccacccagcccagctgagcaagaccagcctggcccccatcatcgtgtacatcaagatcaccagccccaaggtgctgcagaggctcatcaagagccggggcaagagccagagcaagcacctgaatgtgcagattgctgccagcgagaagctggcccagtgccccccagagatgtttgacatcatcctggatgagaaccagctggaggatgcctgtgagcacctggccgagtacctggaggcctactggaaggccacccacccccccagcagcaccccacccaaccccctgctgaacagaaccatggccacagctgccctggccgccagccctgcccctgtgagcaacctgcaggtgcaggtgctgaccagcctgcggaggaacctgggcttctggggcggcctggagagcagccagaggggctctgtggtgccccaggagcaggagcacgccatgtag

SEQ ID NO: 145783 - DNA, 1797 bp, Artificial Sequence
  Description of Artificial Sequence: Synthetic coding sequence
atggtgcagaagacctccatgagccggggcccctacccacccagccaggagatccccatggaggtgtttgaccccagcccccagggcaagtacagcaagaggaagggccgcttcaagagaagtgatggcagcaccagcagtgacaccaccagcaacagctttgtgcggcagggcagcgctgagagctacaccagccggcccagcgacagtgatgtgtccctggaggaggaccgggaggccctgaggaaggaggccgagcggcaggccctggcccagctggagaaggccaagaccaagcctgtggcctttgctgtgaggaccaacgtgggctacaaccccagccctggagatgaggtgcctgtgcagggcgtggccatcacctttgagcccaaggacttcctgcacatcaaggagaagtacaacaatgactggtggattggccgcctggtgaaggagggctgtgaggtgggcttcatccccagccctgtgaagctggacagcctgcggctgctgcaggagcagaagctgcggcagaaccggctgggcagcagcaagagcggggacaacagcagcagcagcctgggagatgtggtgacaggcacccggcggcccaccccaccagccagcgccaagcagaagcagaagagcacagaacatgtgcccccctatgatgtggtgcccagcatgaggcccatcatcctggtgggccccagcctgaagggctatgaggtgacagacatgatgcagaaggccctgtttgacttcctgaagcacagatttgatggccgcatcagcatcaccagggtgacagctgacatcagcctggccaagaggtctgtgctgaacaaccccagcaagcacatcatcatcgagaggagcaacaccaggagcagcctggccgaggtgcagagcgagattgaaagaatttttgagctggcccggaccctgcagctggtggccctggatgctgacaccatcaaccacccagcccagctgagcaagaccagcctggcccccatcatcgtgtacatcaagatcaccagccccaaggtgctgcagaggctcatcaagagccggggcaagagccagagcaagcacctgaatgtgcagattgctgccagcgagaagctggcccagtgccccccagagatgtttgacatcatcctggatgagaaccagctggaggatgcctgtgagcacctggccgagtacctggaggcctactggaaggccacccacccccccagcagcaccccacccaaccccctgctgaacagaaccatggccacagctgccctggccgccagccctgcccctgtgagcaacctgcagggcccctacctggccagcggggaccagcccctggagcgggccactggagagcacgcctccatgcatgagtacccaggagagctgggccagcccccaggcctgtaccccagcagccaccccccaggccgggccggcaccctgcgggccctgagccggcaggacacctttgatgctgacaccccaggcagcaggaacagcgcctacacagagctgggggacagctgtgtggacatggagacagaccccagcgagggccctggcctgggggaccctgctgggggcggcaccccaccagcccggcagggctcctgggaggatgaggaggaggactatgaggaggagctgacagacaacagaaacagaggaagaaacaaggcccgctactgtgccgagggcggcggccctgtgctgggcaggaacaagaatgagctggagggctggggccggggcgtgtacatcagatag

SEQ ID NO: 145784 - DNA, 1437 bp, Artificial Sequence
  Description of Artificial Sequence: Synthetic coding sequence
atggtgcagaagacctccatgagccggggcccctacccacccagccaggagatccccatggaggtgtttgaccccagcccccagggcaagtacagcaagaggaagggccgcttcaagagaagtgatggcagcaccagcagtgacaccaccagcaacagctttgtgcggcagggcagcgctgagagctacaccagccggcccagcgacagtgatgtgtccctggaggaggaccgggaggccctgaggaaggaggccgagcggcaggccctggcccagctggagaaggccaagaccaagcctgtggcctttgctgtgaggaccaacgtgggctacaaccccagccctggagatgaggtgcctgtgcagggcgtggccatcacctttgagcccaaggacttcctgcacatcaaggagaagtacaacaatgactggtggattggccgcctggtgaaggagggctgtgaggtgggcttcatccccagccctgtgaagctggacagcctgcggctgctgcaggagcagaagctgcggcagaaccggctgggcagcagcaagagcggggacaacagcagcagcagcctgggagatgtggtgacaggcacccggcggcccaccccaccagccagcgccaagcagaagcagaagagcacagaacatgtgcccccctatgatgtggtgcccagcatgaggcccatcatcctggtgggccccagcctgaagggctatgaggtgacagacatgatgcagaaggccctgtttgacttcctgaagcacagatttgatggccgcatcagcatcaccagggtgacagctgacatcagcctggccaagaggtctgtgctgaacaaccccagcaagcacatcatcatcgagaggagcaacaccaggagcagcctggccgaggtgcagagcgagattgaaagaatttttgagctggcccggaccctgcagctggtggccctggatgctgacaccatcaaccacccagcccagctgagcaagaccagcctggcccccatcatcgtgtacatcaagatcaccagccccaaggtgctgcagaggctcatcaagagccggggcaagagccagagcaagcacctgaatgtgcagattgctgccagcgagaagctggcccagtgccccccagagatgtttgacatcatcctggatgagaaccagctggaggatgcctgtgagcacctggccgagtacctggaggcctactggaaggccacccacccccccagcagcaccccacccaaccccctgctgaacagaaccatggccacagctgccctggccgccagccctgcccctgtgagcaacctgcaggtgcaggtgctgaccagcctgcggaggaacctgggcttctggggcggcctggagagcagccagaggggctctgtggtgccccaggagcaggagcacgccatgtag

SEQ ID NO: 145785 - DNA, 1290 bp, Artificial Sequence
  Description of Artificial Sequence: Synthetic coding sequence
atggaggcccccagcaggacagtggtggtgggcagcgctgagagctacaccagccggcccagcgacagtgatgtgtccctggaggaggaccgggaggccctgaggaaggaggccgagcggcaggccctggcccagctggagaaggccaagaccaagcctgtggcctttgctgtgaggaccaacgtgggctacaaccccagccctggagatgaggtgcctgtgcagggcgtggccatcacctttgagcccaaggacttcctgcacatcaaggagaagtacaacaatgactggtggattggccgcctggtgaaggagggctgtgaggtgggcttcatccccagccctgtgaagctggacagcctgcggctgctgcaggagcagaagctgcggcagaaccggctgggcagcagcaagagcggggacaacagcagcagcagcctgggagatgtggtgacaggcacccggcggcccaccccaccagccagtgacagccctgtgcagacagagcacgtgcccccctatgatgtggtgcccagcatgaggcccatcatcctggtgggccccagcctgaagggctatgaggtgacagacatgatgcagaaggccctgtttgacttcctgaagcacagatttgatggccgcatcagcatcaccagggtgacagctgacatcagcctggccaagaggtctgtgctgaacaaccccagcaagcacatcatcatcgagaggagcaacaccaggagcagcctggccgaggtgcagagcgagattgagcgcatctttgagctggcccggaccctgcagctggtggccctggatgctgacaccatcaaccacccagcccagctgagcaagaccagcctggcccccatcatcgtgtacatcaagatcaccagccccaaggtgctgcagaggctcatcaagagccggggcaagagccagagcaagcacctgaatgtgcagattgctgccagcgagaagctggcccagtgccccccagagatgtttgacatcatcctggatgagaaccagctggaggatgcctgtgagcacctggccgagtacctggaggcctactggaaggccacccacccccccagcagcaccccacccaaccccctgctgaacagaaccatggccacagctgccctggccgccagccctgcccctgtgagcaacctgcaggtgcaggtgctgaccagcctgcggaggaacctgggcttctggggcggcctggagagcagccagaggggctctgtggtgccccaggagcaggagcacgccatgtag

SEQ ID NO: 145786 - DNA, 1647 bp, Artificial Sequence
  Description of Artificial Sequence: Synthetic coding sequence
tctggcagcctgtacttccagggcagcgctgagagctacaccagccggcccagcgacagtgatgtgtccctggaggaggaccgggaggccctgaggaaggaggccgagcggcaggccctggcccagctggagaaggccaagaccaagcctgtggcctttgctgtgaggaccaacgtgggctacaaccccagccctggagatgaggtgcctgtgcagggcgtggccatcacctttgagcccaaggacttcctgcacatcaaggagaagtacaacaatgactggtggattggccgcctggtgaaggagggctgtgaggtgggcttcatccccagccctgtgaagctggacagcctgcggctgctgcaggagcagaagctgcggcagaaccggctgggcagcagcaagagcggggacaacagcagcagcagcctgggagatgtggtgacaggcacccggcggcccaccccaccagccagcggcaagagccacagacatgccacagaacatgtgcccccctatgatgtggtgcccagcatgaggcccatcatcctggtgggccccagcctgaagggctatgaggtgacagacatgatgcagaaggccctgtttgacttcctgaagcacagatttgatggccgcatcagcatcaccagggtgacagctgacatcagcctggccaagaggtctgtgctgaacaaccccagcaagcacatcatcatcgagaggagcaacaccaggagcagcctggccgaggtgcagagcgagattgaaagaatttttgagctggcccggaccctgcagctggtggccctggatgctgacaccatcaaccacccagcccagctgagcaagaccagcctggcccccatcatcgtgtacatcaagatcaccagccccaaggtgctgcagaggctcatcaagagccggggcaagagccagagcaagcacctgaatgtgcagattgctgccagcgagaagctggcccagtgccccccagagatgtttgacatcatcctggatgagaaccagctggaggatgcctgtgagcacctggccgagtacctggaggcctactggaaggccacccacccccccagcagcaccccacccaaccccctgctgaacagaaccatggccacagctgccctggccgccagccctgcccctgtgagcaacctgcagggcccctacctggccagcggggaccagcccctggagcgggccactggagagcacgcctccatgcatgagtacccaggagagctgggccagcccccaggcctgtaccccagcagccaccccccaggccgggccggcaccctgcgggccctgagccggcaggacacctttgatgctgacaccccaggcagcaggaacagcgcctacacagagctgggggacagctgtgtggacatggagacagaccccagcgagggccctggcctgggggaccctgctgggggcggcaccccaccagcccggcagggctcctgggaggatgaggaggaggactatgaggaggagctgacagacaacagaaacagaggaagaaacaaggcccgctactgtgccgagggcggcggccctgtgctgggcaggaacaagaatgagctggagggctggggccggggcgtgtacatcagatag

SEQ ID NO: 145787 - DNA, 1899 bp, Artificial Sequence
  Description of Artificial Sequence: Synthetic coding sequence
atgaaccagggcagcggcctggacctgctgaagatctcctatggcaagggggcccggaggaagaaccgcttcaagggcagtgatggcagcaccagcagtgacaccaccagcaacagctttgtgcggcagggcagcgctgacagctacaccagccggcccagcgacagtgatgtgtccctggaggaggaccgggaggccgtgcggcgggaggccgagcggcaggcccaggcccagctggagaaggccaagaccaagcctgtggcctttgctgtgaggaccaacgtgtcctacagcgctgcccatgaagatgatgtgcctgtgcccggcatggccatcagctttgaggccaaggacttcctgcacgtgaaggagaagttcaacaatgactggtggattggccgcctggtgaaggagggctgtgagatcggcttcatccccagccctgtgaagctggagaacatgaggctgcagcacgagcagagggccaagcagggcaagttctacagcagcaagagcggcggcaacagcagcagcagcctgggggacatcgtgcccagcagcaggaagagcaccccacccagcagcgccattgatattgatgccaccggcctggatgctgaggagaatgacatcccagccaaccacaggagccccaagcccagcgccaacagcgtgaccagcccccacagcaaggagaagaggatgcccttcttcaagaagacagagcacaccccaccctatgatgtggtgcccagcatgaggcctgtggtgctggtgggccccagcctgaagggctatgaggtgacagacatgatgcagaaggccctgtttgacttcctgaagcacagatttgagggccgcatcagcatcaccagggtgacagctgacatcagcctggccaagaggtctgtgctgaacaaccccagcaagcacgccatcatcgagaggagcaacaccaggagcagcctggccgaggtgcagagcgagattgaaagaatttttgagctggcccggaccctgcagctggtggtgctggatgctgacaccatcaaccacccagcccagctgagcaagaccagcctggcccccatcatcgtgtatgtgaagatcagcagccccaaggtgctgcagaggctcatcaagagccggggcaagagccaggccaagcacctgaatgtgcagatggtggccgctgacaagctggcccagtgccccccagagctgtttgatgtgatcctggatgagaaccagctggaggatgcctgtgagcacctggccgactacctggaggcctactggaaggccacccacccccccagcagcagcctgcccaaccccctgctgagcaggaccctggccaccagcagcctgcccctgagccccaccctggccagcaacagccagggcagccagggcgaccagaggacagacagaagtgcccccatccgcagcgccagccaggccgaggaggagcccagcgtggagcctgtgaagaagagccagcacaggagcagcagcagcgccccccaccacaaccacaggagcggcaccagccggggcctgagccggcaggagacctttgattctgagacccaggagagccgggacagcgcctacgtggagcccaaggaggactacagccatgaccacgtggaccactacgccagccaccgggaccacaaccacagagatgagacccacggcagcagtgaccaccgccaccgggagagccgccacaggagcagagatgtggaccgggagcaggaccacaatgaatgcaacaagcagaggagccgccacaagagcaaggaccgctactgtgagaaggatggagaggtgatcagcaagaagagaaatgaagctggggagtggaacagagatgtgtacatccggcagtag

SEQ ID NO: 145788 - DNA, 1983 bp, Artificial Sequence
  Description of Artificial Sequence: Synthetic coding sequence
atggtgcagagggacatgagcaagagccccccaacagctgctgctgctgtggcccaggagatccagatggagctgctggagaatgtggccccagctggggccctgggcgccgccgcccagagctatggcaagggggcccggaggaagaaccgcttcaagggcagtgatggcagcaccagcagtgacaccaccagcaacagctttgtgcggcagggcagcgctgacagctacaccagccggcccagcgacagtgatgtgtccctggaggaggaccgggaggccgtgcggcgggaggccgagcggcaggcccaggcccagctggagaaggccaagaccaagcctgtggcctttgctgtgaggaccaacgtgtcctacagcgctgcccatgaagatgatgtgcctgtgcccggcatggccatcagctttgaggccaaggacttcctgcacgtgaaggagaagttcaacaatgactggtggattggccgcctggtgaaggagggctgtgagatcggcttcatccccagccctgtgaagctggagaacatgaggctgcagcacgagcagagggccaagcagggcaagttctacagcagcaagagcggcggcaacagcagcagcagcctgggggacatcgtgcccagcagcaggaagagcaccccacccagcagcgccattgatattgatgccaccggcctggatgctgaggagaatgacatcccagccaaccacaggagccccaagcccagcgccaacagcgtgaccagcccccacagcaaggagaagaggatgcccttcttcaagaagacagagcacaccccaccctatgatgtggtgcccagcatgaggcctgtggtgctggtgggccccagcctgaagggctatgaggtgacagacatgatgcagaaggccctgtttgacttcctgaagcacagatttgagggccgcatcagcatcaccagggtgacagctgacatcagcctggccaagaggtctgtgctgaacaaccccagcaagcacgccatcatcgagaggagcaacaccaggagcagcctggccgaggtgcagagcgagattgaaagaatttttgagctggcccggaccctgcagctggtggtgctggatgctgacaccatcaaccacccagcccagctgagcaagaccagcctggcccccatcatcgtgtatgtgaagatcagcagccccaaggtgctgcagaggctcatcaagagccggggcaagagccaggccaagcacctgaatgtgcagatggtggccgctgacaagctggcccagtgccccccagagctgtttgatgtgatcctggatgagaaccagctggaggatgcctgtgagcacctggccgactacctggaggcctactggaaggccacccacccccccagcagcagcctgcccaaccccctgctgagcaggaccctggccaccagcagcctgcccctgagccccaccctggccagcaacagccagggcagccagggcgaccagaggacagacagaagtgcccccatccgcagcgccagccaggccgaggaggagcccagcgtggagcctgtgaagaagagccagcacaggagcagcagcagcgccccccaccacaaccacaggagcggcaccagccggggcctgagccggcaggagacctttgattctgagacccaggagagccgggacagcgcctacgtggagcccaaggaggactacagccatgaccacgtggaccactacgccagccaccgggaccacaaccacagagatgagacccacggcagcagtgaccaccgccaccgggagagccgccacaggagcagagatgtggaccgggagcaggaccacaatgaatgcaacaagcagaggagccgccacaagagcaaggaccgctactgtgagaaggatggagaggtgatcagcaagaagagaaatgaagctggggagtggaacagagatgtgtacatccggcagtag

SEQ ID NO: 145789 - DNA, 1911 bp, Artificial Sequence
  Description of Artificial Sequence: Synthetic coding sequence
atggtgcagagggacatgagcaagagccccccaacagctgctgctgctgtggcccaggagatccagatggagctgctggagaatgtggccccagctggggccctgggcgccgccgcccagagctatggcaagggggcccggaggaagaaccgcttcaagggcagtgatggcagcaccagcagtgacaccaccagcaacagctttgtgcggcagggcagcgctgacagctacaccagccggcccagcgacagtgatgtgtccctggaggaggaccgggaggccgtgcggcgggaggccgagcggcaggcccaggcccagctggagaaggccaagaccaagcctgtggcctttgctgtgaggaccaacgtgtcctacagcgctgcccatgaagatgatgtgcctgtgcccggcatggccatcagctttgaggccaaggacttcctgcacgtgaaggagaagttcaacaatgactggtggattggccgcctggtgaaggagggctgtgagatcggcttcatccccagccctgtgaagctggagaacatgaggctgcagcacgagcagagggccaagcagggcaagttctacagcagcaagagcggcggcaacagcagcagcagcctgggggacatcgtgcccagcagcaggaagagcaccccacccagcagcggggccaagtctgcagatgagcaggaccagtggaagacagctggcctcttctggaggttcaccacagagcacaccccaccctatgatgtggtgcccagcatgaggcctgtggtgctggtgggccccagcctgaagggctatgaggtgacagacatgatgcagaaggccctgtttgacttcctgaagcacagatttgagggccgcatcagcatcaccagggtgacagctgacatcagcctggccaagaggtctgtgctgaacaaccccagcaagcacgccatcatcgagaggagcaacaccaggagcagcctggccgaggtgcagagcgagattgaaagaatttttgagctggcccggaccctgcagctggtggtgctggatgctgacaccatcaaccacccagcccagctgagcaagaccagcctggcccccatcatcgtgtatgtgaagatcagcagccccaaggtgctgcagaggctcatcaagagccggggcaagagccaggccaagcacctgaatgtgcagatggtggccgctgacaagctggcccagtgccccccagagctgtttgatgtgatcctggatgagaaccagctggaggatgcctgtgagcacctggccgactacctggaggcctactggaaggccacccacccccccagcagcagcctgcccaaccccctgctgagcaggaccctggccaccagcagcctgcccctgagccccaccctggccagcaacagccagggcagccagggcgaccagaggacagacagaagtgcccccatccgcagcgccagccaggccgaggaggagcccagcgtggagcctgtgaagaagagccagcacaggagcagcagcagcgccccccaccacaaccacaggagcggcaccagccggggcctgagccggcaggagacctttgattctgagacccaggagagccgggacagcgcctacgtggagcccaaggaggactacagccatgaccacgtggaccactacgccagccaccgggaccacaaccacagagatgagacccacggcagcagtgaccaccgccaccgggagagccgccacaggagcagagatgtggaccgggagcaggaccacaatgaatgcaacaagcagaggagccgccacaagagcaaggaccgctactgtgagaaggatggagaggtgatcagcaagaagagaaatgaagctggggagtggaacagagatgtgtacatccggcagtag

SEQ ID NO: 145790 - DNA, 1839 bp, Artificial Sequence
  Description of Artificial Sequence: Synthetic coding sequence
atgaaggccacctggatccggctgctgaagagggccaagggcggccgcctgaagaacagcgacatctgtggcagcgctgacagctacaccagccggcccagcgacagtgatgtgtccctggaggaggaccgggaggccgtgcggcgggaggccgagcggcaggcccaggcccagctggagaaggccaagaccaagcctgtggcctttgctgtgaggaccaacgtgtcctacagcgctgcccatgaagatgatgtgcctgtgcccggcatggccatcagctttgaggccaaggacttcctgcacgtgaaggagaagttcaacaatgactggtggattggccgcctggtgaaggagggctgtgagatcggcttcatccccagccctgtgaagctggagaacatgaggctgcagcacgagcagagggccaagcagggcaagttctacagcagcaagagcggcggcaacagcagcagcagcctgggggacatcgtgcccagcagcaggaagagcaccccacccagcagcgccattgatattgatgccaccggcctggatgctgaggagaatgacatcccagccaaccacaggagccccaagcccagcgccaacagcgtgaccagcccccacagcaaggagaagaggatgcccttcttcaagaagacagagcacaccccaccctatgatgtggtgcccagcatgaggcctgtggtgctggtgggccccagcctgaagggctatgaggtgacagacatgatgcagaaggccctgtttgacttcctgaagcacagatttgagggccgcatcagcatcaccagggtgacagctgacatcagcctggccaagaggtctgtgctgaacaaccccagcaagcacgccatcatcgagaggagcaacaccaggagcagcctggccgaggtgcagagcgagattgaaagaatttttgagctggcccggaccctgcagctggtggtgctggatgctgacaccatcaaccacccagcccagctgagcaagaccagcctggcccccatcatcgtgtatgtgaagatcagcagccccaaggtgctgcagaggctcatcaagagccggggcaagagccaggccaagcacctgaatgtgcagatggtggccgctgacaagctggcccagtgccccccagagctgtttgatgtgatcctggatgagaaccagctggaggatgcctgtgagcacctggccgactacctggaggcctactggaaggccacccacccccccagcagcagcctgcccaaccccctgctgagcaggaccctggccaccagcagcctgcccctgagccccaccctggccagcaacagccagggcagccagggcgaccagaggacagacagaagtgcccccatccgcagcgccagccaggccgaggaggagcccagcgtggagcctgtgaagaagagccagcacaggagcagcagcagcgccccccaccacaaccacaggagcggcaccagccggggcctgagccggcaggagacctttgattctgagacccaggagagccgggacagcgcctacgtggagcccaaggaggactacagccatgaccacgtggaccactacgccagccaccgggaccacaaccacagagatgagacccacggcagcagtgaccaccgccaccgggagagccgccacaggagcagagatgtggaccgggagcaggaccacaatgaatgcaacaagcagaggagccgccacaagagcaaggaccgctactgtgagaaggatggagaggtgatcagcaagaagagaaatgaagctggggagtggaacagagatgtgtacatccggcagtag

SEQ ID NO: 145791 - DNA, 1704 bp, Artificial Sequence
  Description of Artificial Sequence: Synthetic coding sequence
atgcagtgctgcggcctggtgcacagaagaagagtgcgggtgtcctatggcagcgctgacagctacaccagccggcccagcgacagtgatgtgtccctggaggaggaccgggaggccgtgagaagagaggccgagcggcaggcccaggcccagctggagaaggccaagaccaagcctgtggcctttgctgtgaggaccaacgtgtcctacagcgctgcccatgaagatgatgtgcctgtgcccggcatggccatcagctttgaggccaaggacttcctgcacgtgaaggagaagttcaacaatgactggtggattggccgcctggtgaaggagggctgtgaaattggcttcatccccagccctgtgaagctggagaacatgaggctgcagcacgagcagagggccaagcagggcaagttctacagcagcaagagcggcggcaacagcagcagcagcctgggggacatcgtgcccagcagcaggaagagcaccccacccagcagcgccaagcagaagcagaagagcacagagcacaccccaccctatgatgtggtgcccagcatgaggcctgtggtgctggtgggccccagcctgaagggctatgaggtgacagacatgatgcagaaggccctgtttgacttcctgaagcacagatttgagggccgcatcagcatcaccagggtgacagctgacatcagcctggccaagaggtctgtgctgaacaaccccagcaagcacgccatcatcgagaggagcaacaccaggagcagcctggccgaggtgcagagcgagattgagcgcatctttgagctggcccggaccctgcagctggtggtgctggatgctgacaccatcaaccacccagcccagctgagcaagaccagcctggcccccatcatcgtgtatgtgaagatcagcagccccaaggtgctgcagaggctcatcaagagccggggcaagagccaggccaagcacctgaatgtgcagatggtggccgctgacaagctggcccagtgccccccagagctgtttgatgtgatcctggatgagaaccagctggaggatgcctgtgagcacctggccgactacctggaggcctactggaaggccacccacccccccagcagcagcctgcccaaccccctgctgagcaggaccctggccaccagcagcctgcccctgagccccaccctggccagcaacagccagggcagccagggcgaccagaggacagacagaagtgcccccatccgcagcgccagccaggccgaggaggagcccagcgtggagcctgtgaagaagagccagcacaggagcagcagcagcgccccccaccacaaccacaggagcggcaccagccggggcctgagccggcaggagacctttgacagcgagacccaggagagccgggacagcgcctacgtggagcccaaggaggactacagccatgaccacgtggaccactacgccagccaccgggaccacaaccacagagatgagacccacggcagcagtgaccaccgccaccgggagagccgccacaggagcagagatgtggaccgggagcaggaccacaatgaatgcaacaagcagaggagccgccacaagagcaaggaccgctactgtgagaaggatggagaggtgatcagcaagaagagaaatgaggccggggagtggaacagagatgtgtacatccggcagtag

SEQ ID NO: 145792 - DNA, 1821 bp, Artificial Sequence
  Description of Artificial Sequence: Synthetic coding sequence
atgctggaccggcggctgattgccccccagaccaagtacatcatccctgggggcagcgctgacagctacaccagccggcccagcgacagtgatgtgtccctggaggaggaccgggaggccgtgcggcgggaggccgagcggcaggcccaggcccagctggagaaggccaagaccaagcctgtggcctttgctgtgaggaccaacgtgtcctacagcgctgcccatgaagatgatgtgcctgtgcccggcatggccatcagctttgaggccaaggacttcctgcacgtgaaggagaagttcaacaatgactggtggattggccgcctggtgaaggagggctgtgagatcggcttcatccccagccctgtgaagctggagaacatgaggctgcagcacgagcagagggccaagcagggcaagttctacagcagcaagagcggcggcaacagcagcagcagcctgggggacatcgtgcccagcagcaggaagagcaccccacccagcagcgccattgatattgatgccaccggcctggatgctgaggagaatgacatcccagccaaccacaggagccccaagcccagcgccaacagcgtgaccagcccccacagcaaggagaagaggatgcccttcttcaagaagacagagcacaccccaccctatgatgtggtgcccagcatgaggcctgtggtgctggtgggccccagcctgaagggctatgaggtgacagacatgatgcagaaggccctgtttgacttcctgaagcacagatttgagggccgcatcagcatcaccagggtgacagctgacatcagcctggccaagaggtctgtgctgaacaaccccagcaagcacgccatcatcgagaggagcaacaccaggagcagcctggccgaggtgcagagcgagattgaaagaatttttgagctggcccggaccctgcagctggtggtgctggatgctgacaccatcaaccacccagcccagctgagcaagaccagcctggcccccatcatcgtgtatgtgaagatcagcagccccaaggtgctgcagaggctcatcaagagccggggcaagagccaggccaagcacctgaatgtgcagatggtggccgctgacaagctggcccagtgccccccagagctgtttgatgtgatcctggatgagaaccagctggaggatgcctgtgagcacctggccgactacctggaggcctactggaaggccacccacccccccagcagcagcctgcccaaccccctgctgagcaggaccctggccaccagcagcctgcccctgagccccaccctggccagcaacagccagggcagccagggcgaccagaggacagacagaagtgcccccatccgcagcgccagccaggccgaggaggagcccagcgtggagcctgtgaagaagagccagcacaggagcagcagcagcgccccccaccacaaccacaggagcggcaccagccggggcctgagccggcaggagacctttgattctgagacccaggagagccgggacagcgcctacgtggagcccaaggaggactacagccatgaccacgtggaccactacgccagccaccgggaccacaaccacagagatgagacccacggcagcagtgaccaccgccaccgggagagccgccacaggagcagagatgtggaccgggagcaggaccacaatgaatgcaacaagcagaggagccgccacaagagcaaggaccgctactgtgagaaggatggagaggtgatcagcaagaagagaaatgaagctggggagtggaacagagatgtgtacatccggcagtag

SEQ ID NO: 145793 - DNA, 1827 bp, Artificial Sequence
  Description of Artificial Sequence: Synthetic coding sequence
atgaaccagggcagcggcctggacctgctgaagatctcctatggcaagggggcccggaggaagaaccgcttcaagggcagtgatggcagcaccagcagtgacaccaccagcaacagctttgtgcggcagggcagcgctgacagctacaccagccggcccagcgacagtgatgtgtccctggaggaggaccgggaggccgtgcggcgggaggccgagcggcaggcccaggcccagctggagaaggccaagaccaagcctgtggcctttgctgtgaggaccaacgtgtcctacagcgctgcccatgaagatgatgtgcctgtgcccggcatggccatcagctttgaggccaaggacttcctgcacgtgaaggagaagttcaacaatgactggtggattggccgcctggtgaaggagggctgtgagatcggcttcatccccagccctgtgaagctggagaacatgaggctgcagcacgagcagagggccaagcagggcaagttctacagcagcaagagcggcggcaacagcagcagcagcctgggggacatcgtgcccagcagcaggaagagcaccccacccagcagcggggccaagtctgcagatgagcaggaccagtggaagacagctggcctcttctggaggttcaccacagagcacaccccaccctatgatgtggtgcccagcatgaggcctgtggtgctggtgggccccagcctgaagggctatgaggtgacagacatgatgcagaaggccctgtttgacttcctgaagcacagatttgagggccgcatcagcatcaccagggtgacagctgacatcagcctggccaagaggtctgtgctgaacaaccccagcaagcacgccatcatcgagaggagcaacaccaggagcagcctggccgaggtgcagagcgagattgaaagaatttttgagctggcccggaccctgcagctggtggtgctggatgctgacaccatcaaccacccagcccagctgagcaagaccagcctggcccccatcatcgtgtatgtgaagatcagcagccccaaggtgctgcagaggctcatcaagagccggggcaagagccaggccaagcacctgaatgtgcagatggtggccgctgacaagctggcccagtgccccccagagctgtttgatgtgatcctggatgagaaccagctggaggatgcctgtgagcacctggccgactacctggaggcctactggaaggccacccacccccccagcagcagcctgcccaaccccctgctgagcaggaccctggccaccagcagcctgcccctgagccccaccctggccagcaacagccagggcagccagggcgaccagaggacagacagaagtgcccccatccgcagcgccagccaggccgaggaggagcccagcgtggagcctgtgaagaagagccagcacaggagcagcagcagcgccccccaccacaaccacaggagcggcaccagccggggcctgagccggcaggagacctttgattctgagacccaggagagccgggacagcgcctacgtggagcccaaggaggactacagccatgaccacgtggaccactacgccagccaccgggaccacaaccacagagatgagacccacggcagcagtgaccaccgccaccgggagagccgccacaggagcagagatgtggaccgggagcaggaccacaatgaatgcaacaagcagaggagccgccacaagagcaaggaccgctactgtgagaaggatggagaggtgatcagcaagaagagaaatgaagctggggagtggaacagagatgtgtacatccggcagtag

SEQ ID NO: 145794 - DNA, 1818 bp, Artificial Sequence
  Description of Artificial Sequence: Synthetic coding sequence
atgcagtgctgcggcctggtgcacagaagaagagtgcgggtgtcctatggcagcgctgacagctacaccagccggcccagcgacagtgatgtgtccctggaggaggaccgggaggccgtgagaagagaggccgagcggcaggcccaggcccagctggagaaggccaagaccaagcctgtggcctttgctgtgaggaccaacgtgtcctacagcgctgcccatgaagatgatgtgcctgtgcccggcatggccatcagctttgaggccaaggacttcctgcacgtgaaggagaagttcaacaatgactggtggattggccgcctggtgaaggagggctgtgaaattggcttcatccccagccctgtgaagctggagaacatgaggctgcagcacgagcagagggccaagcagggcaagttctacagcagcaagagcggcggcaacagcagcagcagcctgggggacatcgtgcccagcagcaggaagagcaccccacccagcagcgccatcgacattgatgccaccggcctggatgctgaagaaaatgacatcccagccaaccacaggagccccaagcccagcgccaacagcgtgaccagcccccacagcaaggagaagaggatgcccttcttcaagaagacagagcacaccccaccctatgatgtggtgcccagcatgaggcctgtggtgctggtgggccccagcctgaagggctatgaggtgacagacatgatgcagaaggccctgtttgacttcctgaagcacagatttgagggccgcatcagcatcaccagggtgacagctgacatcagcctggccaagaggtctgtgctgaacaaccccagcaagcacgccatcatcgagaggagcaacaccaggagcagcctggccgaggtgcagagcgagattgagcgcatctttgagctggcccggaccctgcagctggtggtgctggatgctgacaccatcaaccacccagcccagctgagcaagaccagcctggcccccatcatcgtgtatgtgaagatcagcagccccaaggtgctgcagaggctcatcaagagccggggcaagagccaggccaagcacctgaatgtgcagatggtggccgctgacaagctggcccagtgccccccagagctgtttgatgtgatcctggatgagaaccagctggaggatgcctgtgagcacctggccgactacctggaggcctactggaaggccacccacccccccagcagcagcctgcccaaccccctgctgagcaggaccctggccaccagcagcctgcccctgagccccaccctggccagcaacagccagggcagccagggcgaccagaggacagacagaagtgcccccatccgcagcgccagccaggccgaggaggagcccagcgtggagcctgtgaagaagagccagcacaggagcagcagcagcgccccccaccacaaccacaggagcggcaccagccggggcctgagccggcaggagacctttgacagcgagacccaggagagccgggacagcgcctacgtggagcccaaggaggactacagccatgaccacgtggaccactacgccagccaccgggaccacaaccacagagatgagacccacggcagcagtgaccaccgccaccgggagagccgccacaggagcagagatgtggaccgggagcaggaccacaatgaatgcaacaagcagaggagccgccacaagagcaaggaccgctactgtgagaaggatggagaggtgatcagcaagaagagaaatgaggccggggagtggaacagagatgtgtacatccggcagtag

SEQ ID NO: 145795 - DNA, 1455 bp, Artificial Sequence
  Description of Artificial Sequence: Synthetic coding sequence
atgtatgatgacagctatgtgcccggctttgaagattctgaggccggcagcgctgacagctacaccagccggcccagcctggacagtgatgtgtccctggaggaggaccgggagagcgcccggcgggaggtggagagccaggcccagcagcagctggagcgggccaagcacaagcctgtggcctttgctgtgaggaccaacgtgtcctactgcggcgtgctggatgaagaatgtcctgtgcagggcagcggcgtgaactttgaggccaaggacttcctgcacatcaaggagaagtacagcaatgactggtggattggccgcctggtgaaggagggcggggacatcgccttcatccccagcccccagaggctggagagcatccggctgaagcaggagcagaaggcccggcgcagcggcaaccccagcagcctgagtgacatcggcaacagaagaagccccccacccagcctggccaagcagaagcagaagcaggccgagcacgtgcccccctatgatgtggtgcccagcatgaggcctgtggtgctggtgggccccagcctgaagggctatgaggtgacagacatgatgcagaaggccctgtttgacttcctgaagcacagatttgatggccgcatcagcatcaccagggtgacagctgacctgagcctggccaagaggtctgtgctgaacaaccctgggaagaggaccatcatcgagaggagcagcgcccggagcagcattgctgaggtgcagagcgagattgaaagaatttttgagctggccaagagcctgcagctggtggtgctggatgctgacaccatcaaccacccagcccagctggccaagaccagcctggcccccatcatcgtgtttgtgaaggtgagcagccccaaggtgctgcagaggctcatccgcagccggggcaagagccagatgaagcacctgactgtgcagatgatggcctatgacaagctggtgcagtgccccccagagagctttgatgtgatcctggatgagaaccagctggaggatgcctgtgagcacctggccgagtacctggaggtgtactggagggccacccaccacccagcccctggccctggcctgctgggcccccccagcgccatccctggcctgcagaaccagcagctgctgggggagcggggggaggagcacagccccctggagcgggacagcctgatgcccagtgatgaggccagcgagagcagccggcaggcctggacaggcagcagccagaggagcagccgccacctggaggaggactatgcagatgcctaccaggacctgtaccagccccaccggcagcacaccagcggcctgcccagcgccaatggacatgacccccaggaccggctgctggcccaggacagcgagcacaaccacagcgacaggaactggcagaggaaccggccctggcccaaggacagctactag

SEQ ID NO: 145796 - DNA, 1566 bp, Artificial Sequence
  Description of Artificial Sequence: Synthetic coding sequence
atgagcagcagcagctatgccaagaatggaacagcagatggcccccacagccccaccagccaggtggcccggggcaccaccaccaggaggagccggctgaagagaagtgatggcagcaccaccagcaccagcttcatcctgcggcagggcagcgctgacagctacaccagccggcccagcgacagtgatgtgtccctggaggaggaccgggaggccatccggcaggagcgggagcagcaggccgccatccagctggagcgggccaagagcaagcctgtggcctttgctgtgaagaccaacgtgtcctactgtggggccctggatgaagatgtgcctgtgcccagcacagccatcagctttgatgccaaggacttcctgcacatcaaggagaagtacaacaatgactggtggattggccgcctggtgaaggagggctgtgagatcggcttcatccccagccccctgcggctggagaacatccgcatccagcaggagcagaagaggggccgcttccacggcggcaagagcagcggcaacagcagcagcagcctgggggagatggtgtctggcaccttccgggccacccccaccagcacagtgaagatggtgctgaagatccacacagagcacatccccccctatgatgtggtgcccagcatgaggcctgtggtgctggtgggccccagcctgaagggctatgaggtgacagacatgatgcagaaggccctgtttgacttcctgaagcacagatttgatggccgcatcagcatcaccagggtgacagctgacatcagcctggccaagaggtctgtgctgaacaaccccagcaagagggccatcatcgagaggagcaacaccaggagcagcctggccgaggtgcagagcgagattgagcgcatctttgagctggcccggagcctgcagctggtggtgctggatgctgacaccatcaaccacccagcccagctgatcaagaccagcctggcccccatcatcgtgcacgtgaaggtgagcagccccaaggtgctgcagaggctcatcaagagccggggcaagagccagagcaagcacctgaatgtgcagctggtggccgctgacaagctggcccagtgccccccagagatgtttgatgtgatcctggatgagaaccagctggaggatgcctgtgagcacctgggggagtacctggaggcctactggagggccacccacaccaccagcagcacccccatgacccccctgctgggcaggaacctgggcagcacagccctgagcccctaccccacagccatcagcggcctgcagagccagaggatgaggcacagcaaccacagcacagagaacagccccattgaaagaagaagcctgatgaccagtgatgagaactaccacaatgaaagagccaggaagagcaggaaccggctgagcagcagcagccagcacagccgggaccactaccccctggtggaggaggactacccagacagctaccaggacacctacaagccccacaggaacagaggcagccctgggggctacagccatgacagccgccaccggctgtag

SEQ ID NO: 145797 - DNA, 1464 bp, Artificial Sequence
  Description of Artificial Sequence: Synthetic coding sequence
atgtatgacaacctgtacctgcacggcattgaagattctgaggccggcagcgctgacagctacaccagccggcccagcgacagtgatgtgtccctggaggaggaccgggaggccatccggcaggagcgggagcagcaggccgccatccagctggagcgggccaagagcaagcctgtggcctttgctgtgaagaccaacgtgtcctactgtggggccctggatgaagatgtgcctgtgcccagcacagccatcagctttgatgccaaggacttcctgcacatcaaggagaagtacaacaatgactggtggattggccgcctggtgaaggagggctgtgagatcggcttcatccccagccccctgcggctggagaacatccgcatccagcaggagcagaagaggggccgcttccacggcggcaagagcagcggcaacagcagcagcagcctgggggagatggtgtctggcaccttccgggccacccccaccagcacagtgaagatggtgctgaagatccacacagagcacatccccccctatgatgtggtgcccagcatgaggcctgtggtgctggtgggccccagcctgaagggctatgaggtgacagacatgatgcagaaggccctgtttgacttcctgaagcacagatttgatggccgcatcagcatcaccagggtgacagctgacatcagcctggccaagaggtctgtgctgaacaaccccagcaagagggccatcatcgagaggagcaacaccaggagcagcctggccgaggtgcagagcgagattgagcgcatctttgagctggcccggagcctgcagctggtggtgctggatgctgacaccatcaaccacccagcccagctgatcaagaccagcctggcccccatcatcgtgcacgtgaaggtgagcagccccaaggtgctgcagaggctcatcaagagccggggcaagagccagagcaagcacctgaatgtgcagctggtggccgctgacaagctggcccagtgccccccagagatgtttgatgtgatcctggatgagaaccagctggaggatgcctgtgagcacctgggggagtacctggaggcctactggagggccacccacaccaccagcagcacccccatgacccccctgctgggcaggaacctgggcagcacagccctgagcccctaccccacagccatcagcggcctgcagagccagaggatgaggcacagcaaccacagcacagagaacagccccattgaaagaagaagcctgatgaccagtgatgagaactaccacaatgaaagagccaggaagagcaggaaccggctgagcagcagcagccagcacagccgggaccactaccccctggtggaggaggactacccagacagctaccaggacacctacaagccccacaggaacagaggcagccctgggggctacagccatgacagccgccaccggctgtag

SEQ ID NO: 145798 - DNA, 1461 bp, Artificial Sequence
  Description of Artificial Sequence: Synthetic coding sequence
atgtatgacaacctgtacctgcacggcattgaagattctgaggccggcagcgctgacagctacaccagccggcccagcgacagtgatgtgtccctggaggaggaccgggaggccatccggcaggagcgggagcagcaggccgccatccagctggagcgggccaagagcaagcctgtggcctttgctgtgaagaccaacgtgtcctactgtggggccctggatgaagatgtgcctgtgcccagcacagccatcagctttgatgccaaggacttcctgcacatcaaggagaagtacaacaatgactggtggattggccgcctggtgaaggagggctgtgagatcggcttcatccccagccccctgcggctggagaacatccgcatccagcaggagcagaagaggggccgcttccacggcggcaagagcagcggcaacagcagcagcagcctgggggagatggtgtctggcaccttccgggccacccccaccagcacagccaagcagaagcagaaggtgacagagcacatccccccctatgatgtggtgcccagcatgaggcctgtggtgctggtgggccccagcctgaagggctatgaggtgacagacatgatgcagaaggccctgtttgacttcctgaagcacagatttgatggccgcatcagcatcaccagggtgacagctgacatcagcctggccaagaggtctgtgctgaacaaccccagcaagagggccatcatcgagaggagcaacaccaggagcagcctggccgaggtgcagagcgagattgaaagaatttttgagctggcccggagcctgcagctggtggtgctggatgctgacaccatcaaccacccagcccagctgatcaagaccagcctggcccccatcatcgtgcacgtgaaggtgagcagccccaaggtgctgcagaggctcatcaagagccggggcaagagccagagcaagcacctgaatgtgcagctggtggccgctgacaagctggcccagtgccccccagagatgtttgatgtgatcctggatgagaaccagctggaggatgcctgtgagcacctgggggagtacctggaggcctactggagggccacccacaccaccagcagcacccccatgacccccctgctgggcaggaacctgggcagcacagccctgagcccctaccccacagccatcagcggcctgcagagccagaggatgaggcacagcaaccacagcacagagaacagccccatcgagcggcgcagcctgatgaccagtgatgagaactaccacaatgaaagagccaggaagagcaggaaccggctgagcagcagcagccagcacagccgggaccactaccccctggtggaggaggactacccagacagctaccaggacacctacaagccccacaggaacagaggcagccctgggggctacagccatgacagccgccaccggctgtag

SEQ ID NO: 145799 - DNA, 1563 bp, Artificial Sequence
  Description of Artificial Sequence: Synthetic coding sequence
atgagcagcagcagctatgccaagaatggaacagcagatggcccccacagccccaccagccaggtggcccggggcaccaccaccaggaggagccggctgaagagaagtgatggcagcaccaccagcaccagcttcatcctgcggcagggcagcgctgacagctacaccagccggcccagcgacagtgatgtgtccctggaggaggaccgggaggccatccggcaggagcgggagcagcaggccgccatccagctggagcgggccaagagcaagcctgtggcctttgctgtgaagaccaacgtgtcctactgtggggccctggatgaagatgtgcctgtgcccagcacagccatcagctttgatgccaaggacttcctgcacatcaaggagaagtacaacaatgactggtggattggccgcctggtgaaggagggctgtgagatcggcttcatccccagccccctgcggctggagaacatccgcatccagcaggagcagaagaggggccgcttccacggcggcaagagcagcggcaacagcagcagcagcctgggggagatggtgtctggcaccttccgggccacccccaccagcacagccaagcagaagcagaaggtgacagagcacatccccccctatgatgtggtgcccagcatgaggcctgtggtgctggtgggccccagcctgaagggctatgaggtgacagacatgatgcagaaggccctgtttgacttcctgaagcacagatttgatggccgcatcagcatcaccagggtgacagctgacatcagcctggccaagaggtctgtgctgaacaaccccagcaagagggccatcatcgagaggagcaacaccaggagcagcctggccgaggtgcagagcgagattgaaagaatttttgagctggcccggagcctgcagctggtggtgctggatgctgacaccatcaaccacccagcccagctgatcaagaccagcctggcccccatcatcgtgcacgtgaaggtgagcagccccaaggtgctgcagaggctcatcaagagccggggcaagagccagagcaagcacctgaatgtgcagctggtggccgctgacaagctggcccagtgccccccagagatgtttgatgtgatcctggatgagaaccagctggaggatgcctgtgagcacctgggggagtacctggaggcctactggagggccacccacaccaccagcagcacccccatgacccccctgctgggcaggaacctgggcagcacagccctgagcccctaccccacagccatcagcggcctgcagagccagaggatgaggcacagcaaccacagcacagagaacagccccatcgagcggcgcagcctgatgaccagtgatgagaactaccacaatgaaagagccaggaagagcaggaaccggctgagcagcagcagccagcacagccgggaccactaccccctggtggaggaggactacccagacagctaccaggacacctacaagccccacaggaacagaggcagccctgggggctacagccatgacagccgccaccggctgtag

SEQ ID NO: 145800 - DNA, 1248 bp, Artificial Sequence
  Description of Artificial Sequence: Synthetic coding sequence
ttctacttcctgtgccagggcagcgctgacagctacaccagccggcccagcgacagtgatgtgtccctggaggaggaccgggaggccatccggcaggagcgggagcagcaggccgccatccagctggagcgggccaagagcaagcctgtggcctttgctgtgaagaccaacgtgtcctactgtggggccctggatgaagatgtgcctgtgcccagcacagccatcagctttgatgccaaggacttcctgcacatcaaggagaagtacaacaatgactggtggattggccgcctggtgaaggagggctgtgaaattggcttcatccccagccccctgcggctggagaacatccgcatccagcaggagcagaagaggggccgcttccatggaggcaagagcagcggcaacagcagcagcagcctgggggagatggtgtctggcaccttccgggccacccccaccagcacagccaagcagaagcagaaggtgacagagcacatccccccctatgatgtggtgcccagcatgaggcctgtggtgctggtgggccccagcctgaagggctatgaggtgacagacatgatgcagaaggccctgtttgacttcctgaagcacagatttgatggccgcatcagcatcaccagggtgacagctgacatcagcctggccaagaggtctgtgctgaacaaccccagcaagagggccatcatcgagaggagcaacaccaggagcagcctggccgaggtgcagagcgagattgagcgcatctttgagctggcccggagcctgcagctggtggtgctggatgctgacaccatcaaccacccagcccagctgatcaagaccagcctggcccccatcatcgtgcacgtgaaggtgagcagccccaaggtgctgcagaggctcatcaagagccggggcaagagccagagcaagcacctgaatgtgcagctggtggccgctgacaagctggcccagtgcccccccagccagaggatgaggcacagcaaccacagcacagagaacagccccattgaaagaagaagcctgatgaccagtgatgagaactaccacaatgaaagagccaggaagagcaggaaccggctgagcagcagcagccagcacagccgggaccactaccccctggtggaggaggactacccagacagctaccaggacacctacaagccccacaggaacagaggcagccctgggggctacagccatgacagccgccaccggctgtag

SEQ ID NO: 145801 - DNA, 558 bp, Artificial Sequence
  Description of Artificial Sequence: Synthetic coding sequence
atgagcggcagctttgagctgtctgtgcaggacctgaatgacctgctgagtgatggcagcggctgctacagcctgcccagccagccctgcaatgaggtgaccccccgcatctacgtgggcaatgcctctgtggcccaggacatccccaagctgcagaagctgggcatcacccacgtgctgaatgctgctgagggccgctccttcatgcacgtgaacaccaatgccaacttctacaaggacagcggcatcacctacctgggcatcaaggccaatgacacccaggagttcaacctgagcgcctactttgaaagagctgctgacttcatcgaccaggccctggcccagaagaatggccgggtgctggtgcactgccgggagggctacagccgcagccccaccctggtgattgcctacctgatgatgaggcagaagatggatgtgaagagcgccctgagcatcgtgcggcagaaccgggagatcggccccaatgatggcttcctggcccagctgtgccagctgaatgaccggctggccaaggagggcaagctgaagccctag

SEQ ID NO: 145802 - DNA, 972 bp, Artificial Sequence
  Description of Artificial Sequence: Synthetic coding sequence
atgggcctgtttgacagaggagtgcagatgctgctgaccaccgtgggcgcctttgctgccttcagcctgatgaccatcgctgtgggcacagactactggctgtacagccggggcgtgtgcaagaccaagtctgtgtctgaaaatgagaccagcaagaagaatgaggaggtgatgacccacagcggcctgtggaggacctgctgcctggagggcaacttcaagggcctgtgcaagcagattgaccacttcccagaagatgctgactatgaagctgacacagctgagtacttcctgcgggctgtgcgggccagcagcatcttccccatcctgagcgtcatcctgctcttcatgggcggcctgtgcatcgccgccagcgagttctacaagaccaggcacaacatcatcctgtctgctggcatcttctttgtgtctgctggcctgagcaacatcatcggcatcatcgtgtacatcagcgccaatgctggggaccccagcaagagtgacagcaagaagaacagctacagctatggctggagcttctactttggagccctgtccttcatcatcgccgagatggtgggcgtgctggccgtgcacatgttcatcgacagacacaagcagctgcgggccacagcccgggccacagactacctgcaggccagcgccatcacccgcatccccagctaccgctaccgctaccagaggaggagccgcagcagcagccgcagcacagagcccagccacagcagagatgccagccctgtgggcatcaagggcttcaacaccctgcccagcacagagatctccatgtacaccctgagccgggaccccctgaaggccgccaccacccccacagccacctacaacagcgaccgggacaacagcttcctgcaggtgcacaactgcatccagaaggagaacaaggacagcctgcacagcaacacagccaacagaaggaccacccctgtgtag

SEQ ID NO: 145803 - DNA, 948 bp, Artificial Sequence
  Description of Artificial Sequence: Synthetic coding sequence
atgaggatgtgtgaccggggcatccagatgctgatcaccaccgtgggcgcctttgctgccttcagcctgatgaccatcgctgtgggcacagactactggctgtacagccggggcgtgtgcaggaccaagagcaccagtgacaatgagaccagcaggaagaatgaggaggtgatgacccacagcggcctgtggaggacctgctgcctggagggcgccttccggggcgtgtgcaagaagattgaccacttcccagaagatgctgactatgagcaggacacagctgagtacctgctgcgggctgtgcgggccagctctgtgttccccatcctgtctgtgaccctgctcttctttggaggcctgtgtgtggccgccagcgagttccacaggagccgccacaacgtcatcctgtctgctggcatcttctttgtgtctgctggcctgagcaacatcatcggcatcatcgtgtacatcagcgccaatgctggggaccccggccagagggacagcaagaagagctacagctatggctggagcttctactttggagccttctccttcatcatcgccgagatcgtgggcgtggtggccgtgcacatctacatcgagaagcaccagcagctgcgggccaagagccacagcgagttcctgaagaagagcacctttgcccggctgcccccctaccgctaccgcttcagaagaagaagcagcagccgcagcacagagcccaggagccgggacctgagccccatcagcaagggcttccacaccatccccagcacagacatctccatgttcaccctgagccgggaccccagcaagatcaccatgggcaccctgctgaacagcgaccgggaccacgccttcctgcagttccacaacagcacccccaaggagttcaaggagagcctgcacaacaacccagccaacagaaggaccacccctgtgtag

SEQ ID NO: 145804 - DNA, 891 bp, Artificial Sequence
  Description of Artificial Sequence: Synthetic coding sequence
atgtctgcctgtggcaggaaggccctgaccctgctgagctctgtgtttgctgtgtgtggcctgggcctgctgggcattgctgtgtccacagactactggctgtacctggaggagggcgtgattgtgccccagaaccagagcacagagatcaagatgagcctgcacagcggcctgtggagggtgtgcttcctggccggggaggagcggggccgctgcttcaccattgaatatgtgatgcccatgaacacccagctgaccagcgagagcacagtgaatgtgctgaagatgatccgcagcgccacccccttccccctggtgtccctcttcttcatgtttattggcttcatcctgaacaacatcggccacatccggccccacaggaccatcctggcctttgtgtctggcatcttcttcatcctgagcggcctgagcctggtggtgggcctggtgctgtacatcagcagcatcaatgatgagatgctgaacagaaccaaggatgctgagacctacttcaactacaagtatggctggagctttgcctttgctgccatctccttcctgctgacagaggtgaagcctgtgaccctgtccatggaccggctgggcctgggcacagcccccctgagcagaggagagtggggctggggcagaagagacatcccccagcccttctggaccccagaccaccccctgtacttccccagcagcagccagaatgtgtccctgagctacctgagcggcagccccccagccaggatgagccctggcccctgcagctgcccccacgtgcacttccccccccacagcagctgtgtgctgtgccggccccagccccgggagatgaggcaggccccagctgccagccccagcagcgctgtgttcagcctgtag

SEQ ID NO: 145805 - DNA, 828 bp, Artificial Sequence
  Description of Artificial Sequence: Synthetic coding sequence
atgtctgcctgtggcaggaaggccctgaccctgctgagctctgtgtttgctgtgtgtggcctgggcctgctgggcattgctgtgtccacagactactggctgtacctggaggagggcgtgattgtgccccagaaccagagcacagagatcaagatgagcctgcacagcggcctgtggagggtgtgcttcctggccggggaggagcggggccgctgcttcaccattgaatatgtgatgcccatgaacacccagctgaccagcgagagcacagtgaatgtgctgaagatgatccgcagcgccacccccttccccctggtgtccctcttcttcatgtttattggcttcatcctgaacaacatcggccacatccggccccacaggaccatcctggcctttgtgtctggcatcttcttcatcctgagcggcctgagcctggtggtgggcctggtgctgtacatcagcagcatcaatgatgagatgctgaacagaaccaaggatgctgagacctacttcaactacaagtatggctggagctttgcctttgctgccatctccttcctgctgacagaatctgctggggtgatgtctgtgtacctgttcatgaagcgctacacagctgaggacatgtaccggccccaccctggcttctaccggccccggctgagcaactgcagcgactacagcggccagttcctgcacccagatgcctgggtgcggggccgcagccccagcgacatcagcagcgaggccagcctgcagatgaacagcaactacccagccctgctgaagtgcccagactatgaccagatgagcagcagcccctgctag

SEQ ID NO: 145806 - DNA, 828 bp, Artificial Sequence; identical to SEQ ID NO: 145805
  Description of Artificial Sequence: Synthetic coding sequence

SEQ ID NO: 145807 - DNA, 783 bp, Artificial Sequence
  Description of Artificial Sequence: Synthetic coding sequence
atgatgtggagcaacttcttcctgcaggaggagaacagaagaagaggagctgctggaagaagaagagcccacggccagggccgcagcggcctgaccccagagcgggagggcaaggtgaagctggccctgctgctggccgctgtgggcgccaccctggccgtgctgtctgtgggcacagagttctgggtggagctgaacacctacaaggccaatggatctgctgtgtgtgaggccgcccacctgggcctgtggaaggcctgcaccaagaggctgtggcaggctgatgtgcctgtggaccgggacacctgtggccctgctgagctgcctggagaggccaactgcacctacttcaagttcttcaccaccggggagaatgcccgcatcttccagaggaccaccaagaaggaggtgaacctggccgctgctgtgattgctgtgctgggcctggccgtgatggccctgggctgcctgtgcatcatcatggtgctgagcaaaggagctgagttcctgctgcgggtgggcgctgtgtgcttcggcctgagcggcctgctgctgctggtgtccctggaggtgttccgccacagcgtgcgggccctgctgcagagggtgtccccagagcccccaccagccccccggctgacctatgagtacagctggagcctgggctgcggcgtgggcgccggcctcatcctgctgctgggcgccggctgcttcctgctgctgaccctgcccagctggccctggggcagcctgtgccccaagaggggccaccgggccacctag

SEQ ID NO: 145808 - DNA, 645 bp, Artificial Sequence
  Description of Artificial Sequence: Synthetic coding sequence
atgatgtggagcaacttcttcctgcaggaggagaacagaagaagaggagctgctggaagaagaagagcccacggccagggccgcagcggcctgaccccagagcgggagggcaaggtgaagctggccctgctgctggccgctgtgggcgccaccctggccgtgctgtctgtgggcacagagttctgggtggagctgaacacctacaaggccaatggatctgctgtgtgtgaggccgcccacctgggcctgtggaaggcctgcaccaagaggctgtggcaggctgatgtgcctgtggaccgggacacctgtggccctgctgagctgcctggagaggccaactgcacctacttcaagttcttcaccaccggggagaatgcccgcatcttccagaggaccaccaagaagggcctgctgctgctggtgtccctggaggtgttccgccacagcgtgcgggccctgctgcagagggtgtccccagagcccccaccagccccccggctgacctatgagtacagctggagcctgggctgcggcgtgggcgccggcctcatcctgctgctgggcgccggctgcttcctgctgctgaccctgcccagctggccctggggcagcctgtgccccaagaggggccaccgggccacctag

SEQ ID NO: 145809 - DNA, 570 bp, Artificial Sequence
  Description of Artificial Sequence: Synthetic coding sequence
atgatgtggagcaacttcttcctgcaggaggagaacagaagaagaggagctgctggaagaagaagagcccacggccagggccgcagcggcctgaccccagagcgggagggcaaggtgaagctggccctgctgctggccgctgtgggcgccaccctggccgtgctgtctgtgggcacagagttctgggtggagctgaacacctacaaggccaatggatctgctgtgtgtgaggccgcccacctgggcctgtggaaggcctgcaccaagaggctgtggcaggctgatgtgcctgtggaccgggacacctgtggccctgctgagctgcccggcggcctgctgctgctggtgtccctggaggtgttccgccacagcgtgcgggccctgctgcagagggtgtccccagagcccccaccagccccccggctgacctatgagtacagctggagcctgggctgcggcgtgggcgccggcctcatcctgctgctgggcgccggctgcttcctgctgctgaccctgcccagctggccctggggcagcctgtgccccaagaggggccaccgggccacctag

SEQ ID NO: 145810 - DNA, 321 bp, Artificial Sequence
  Description of Artificial Sequence: Synthetic coding sequence
atgagcaccaacaacatgtctgacccccggcggcccaacaaggtgctgcgctacaagcccccaccttctgagtgcaacccagccctggatgaccccaccccagactacatgaacctgctgggcatgatcttctccatgtgtggcctgatgctgaagctgaagtggtgtgcctgggtggccgtgtactgcagcttcatcagctttgccaacagccgcagcagcgaggacaccaagcagatgatgagcagcttcatgctgagcatctctgctgtggtgatgagctacctgcagaacccccagcccatgaccccaccctggtag

SEQ ID NO: 145811 - DNA, 828 bp, Artificial Sequence
  Description of Artificial Sequence: Synthetic coding sequence
atgagccactgcagcagccgggccctgaccctgctgagctctgtgtttggagcctgtggcctgctgctggtgggcattgctgtgtccacagactactggctgtacatggaggagggcaccgtgctgccccagaaccagaccacagaggtgaagatggccctgcacgccggcctgtggagggtgtgcttctttgctggccgggagaagggccgctgtgtggccagcgagtacttcctggagcctgagatcaacctggtgacagagaacacagagaacatcctgaagacagtgaggacagccacccccttccccatggtgtccctcttcctggtgttcaccgcctttgtgatcagcaacatcggccacatccggccccagaggaccatcctggcctttgtgtctggcatcttcttcatcctgagcggcctgagcctggtggtgggcctggtgctgtacatcagcagcatcaatgatgaggtgatgaaccggcccagcagcagcgagcagtacttccactaccgctatggctggagctttgcctttgctgccagcagcttcctgctgaaggagggcgctggggtgatgtctgtgtacctgttcaccaagagatatgcagaggaggagatgtaccggccccacccagccttctaccggccccggctgagtgactgcagcgactacagcggccagttcctgcagcctgaggcctggaggcggggccgcagccccagcgacatcagcagtgatgtgtccatccagatgacccagaactaccccccagccatcaagtacccagaccacctgcacatcagcaccagcccctgctag

SEQ ID NO: 145812 - DNA, 1278 bp, Artificial Sequence
  Description of Artificial Sequence: Synthetic coding sequence
ctggagagcctgaagcgctggaatgaggagcggggcctgtggtgtgagaagggcgtgcaggtgctgctgaccaccgtgggcgcctttgctgccttcggcctgatgaccatcgccatcagcacagactactggctgtacacccgggccctgatctgcaacaccaccaacctgacagctggaggagatgatggcaccccccacagaggaggcggcggggccagcgagaagaaggaccccggcggcctgacccacagcggcctgtggaggatctgctgcctggagggcctgaagaggggcgtgtgtgtgaagatcaaccacttccctgaggacacagattatgaccatgattctgctgagtacctgctgcgggtggtgcgggccagcagcatcttccccatcctgagcgccatcctgctgctgctgggcggcgtgtgtgtggccgccagccgggtgtacaagagcaagaggaacatcatcctgggcgccggcatcctgtttgtggccgccggcctgagcaacatcattggagtcatcgtgtacatcagcgccaatgctggggagcccggccccaagagagatgaggagaagaagaaccactacagctatggctggagcttctactttggaggcctgtccttcatcctggccgaggtgattggagtgctggccgtgaacatctacatcgagaggagccgggaggcccactgccagagcagaagtgacctgctgaaggccggcggcggggccggcggcagcggcggcagcggccccagcgccatcctgcggctgcccagctaccgcttccgctacagaagaagaagccgcagcagcagccgcagcagcgagcccagccccagcagagatgccagccctgggggccctgggggccctggctttgccagcacagacatctccatgtacaccctgagccgggaccccagcaaaggatctgtggccgccggcctggccggggccggcggcggcggcggcggcgctgtgggcgccttcggcggggccgccggcggggccggcggcggcggcggcggcggcggcggggccggggctgagcgggaccggggcggggccagcggcttcctgaccctgcacaatgccttccccaaggaggccggcggcggcgtgacagtgacagtgactggacctccagcccccccagccccagcccccccagcccccagcgccccagcccctggcaccctggccaaggaggccgccgccagcaacaccaacaccctgaacaggaagaccacccctgtgtag

SEQ ID NO: 145813 - DNA, 6540 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaggtgaacccagctgagcacacccagtgcagccccagcatgggccccagctgcagccacccccccctggccgtgctgacagcccctcctgtggctgatggcttccagaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagaggagggccccagccccagcgaggcccaccagggcgctgaggaccccttccggcctgctggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatcagaagagccatcagcggggacctgacagctgaggaggagctggacaaggccatgaaggaggccgtgtctgctgcctctgaagatgacatcttccggcgggccggcggcctgtttggaaatcatgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgagaaccggcagctgaccctgcctgaggaggacaagagggacatccggcagagccccaagaggggcttcctgcggagcgccagcctgggccggcgggccagcttccacctggagtgcctgaagaggcagaaggaccggggcggggacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccaccccaggcggcggcggcagcagcgctgcccggcgggtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgagcggcggggccccccagagccccaacggggccctgctgccctttgtgaactgcagagatgctggccaggacagagctggaggagaagaagatgctggctgtgtgcgggcccggggccggcccagcgaggaggagctgcaggacagccgggtgtatgtgagcagcctgtag

SEQ ID NO: 145814 - DNA, 6561 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatcctgggcaatgctgactatgtgttcaccagcatcttcaccctggagatcatcctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagggctacttcagtgacccctggaatgtgtttgacttcctgattgtcatcggcagcatcattgatgtgatcctgtctgagaccaaccactacttctgtgatgcctggaacacctttgatgccctgattgtggtgggcagcatcgtggacatcgccatcacagaggtgaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgaaaatcggcagctgaccctgcctgaggaggacaagagggacatccggcagagccccaagaggggcttcctgcggagcgccagcctgggcagaagagccagcttccacctggagtgcctgaagaggcagaaggacagaggaggagacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccacccctgggggcggcggcagcagcgctgccaggagagtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgtctggaggagccccccagagccccaatggagccctgctgccctttgtgaactgcagagatgctggccaggaccgggccggcggggaggaggatgctggctgtgtgcgggcccggggccggcccagcgaggaggagctgcaggacagccgggtgtatgtgagcagcctgtag

SEQ ID NO: 145815 - DNA, 6441 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctgggcaatgctgactatgtgttcaccagcatcttcaccctggagatcatcctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaggtgaacaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccactggagaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagaggagggccccagccccagcgaggcccaccagggcgctgaggaccccttccggcctgctggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgaaaatcggcagctgaccctgcctgaggaggacaagagggacatccggcagagccccaagaggggcttcctgcggagcgccagcctgggcagaagagccagcttccacctggagtgcctgaagaggcagaaggacagaggaggagacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccacccctgggggcggcggcagcagcgctgccaggagagtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgtctggaggagccccccagagccccaatggagccctgctgccctttgtgaactgcagagatgctggccaggaccgggccggcggggaggaggatgctggctgtgtgcgggcccggggccggcccagcgaggaggagctgcaggacagccgggtgtatgtgagcagcctgtag

SEQ ID NO: 145816 - DNA, 6441 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaggtgaacaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccactggagaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagaggagggccccagccccagcgaggcccaccagggcgctgaggaccccttccggcctgctggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgaaaatcggcagctgaccctgcctgaggaggacaagagggacatccggcagagccccaagaggggcttcctgcggagcgccagcctgggcagaagagccagcttccacctggagtgcctgaagaggcagaaggacagaggaggagacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccacccctgggggcggcggcagcagcgctgccaggagagtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgtctggaggagccccccagagccccaatggagccctgctgccctttgtgaactgcagagatgctggccaggaccgggccggcggggaggaggatgctggctgtgtgcgggcccggggccggcccagcgaggaggagctgcaggacagccgggtgtatgtgagcagcctgtag

SEQ ID NO: 145817 - DNA, 6417 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagggctacttcagtgacccctggaatgtgtttgacttcctgattgtcatcggcagcatcattgatgtgatcctgtctgagaccaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgaaaatcggcagctgaccctgcctgaggaggacaagagggacatccggcagagccccaagaggggcttcctgcggagcgccagcctgggcagaagagccagcttccacctggagtgcctgaagaggcagaaggacagaggaggagacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccacccctgggggcggcggcagcagcgctgccaggagagtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgtctggaggagccccccagagccccaatggagccctgctgccctttgtgaactgcagagatgctggccaggaccgggccggcggggaggaggatgctggctgtgtgcgggcccggggccggcccagcgaggaggagctgcaggacagccgggtgtatgtgagcagcctgtag

SEQ ID NO: 145818 - DNA, 6417 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctgggcaatgctgactatgtgttcaccagcatcttcaccctggagatcatcctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaggtgaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgaaaatcggcagctgaccctgcctgaggaggacaagagggacatccggcagagccccaagaggggcttcctgcggagcgccagcctgggcagaagagccagcttccacctggagtgcctgaagaggcagaaggacagaggaggagacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccacccctgggggcggcggcagcagcgctgccaggagagtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgtctggaggagccccccagagccccaatggagccctgctgccctttgtgaactgcagagatgctggccaggaccgggccggcggggaggaggatgctggctgtgtgcgggcccggggccggcccagcgaggaggagctgcaggacagccgggtgtatgtgagcagcctgtag

SEQ ID NO: 145819 - DNA, 6417 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactggatgcaggatgccatgggctatgagctgccctgggtgtactttgtgtccctggtgatcttcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagggctacttcagtgacccctggaatgtgtttgacttcctgattgtcatcggcagcatcattgatgtgatcctgtctgagaccaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgaaaatcggcagctgaccctgcctgaggaggacaagagggacatccggcagagccccaagaggggcttcctgcggagcgccagcctgggcagaagagccagcttccacctggagtgcctgaagaggcagaaggacagaggaggagacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccacccctgggggcggcggcagcagcgctgccaggagagtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgtctggaggagccccccagagccccaatggagccctgctgccctttgtgaactgcagagatgctggccaggaccgggccggcggggaggaggatgctggctgtgtgcgggcccggggccggcccagcgaggaggagctgcaggacagccgggtgtatgtgagcagcctgtag

SEQ ID NO: 145820 - DNA, 6477 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatcctgggcaatgctgactatgtgttcaccagcatcttcaccctggagatcatcctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaggtgaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgaaaatcggcagctgaccctgcctgaggaggacaagagggacatccggcagagccccaagaggggcttcctgcggagcgccagcctgggcagaagagccagcttccacctggagtgcctgaagaggcagaaggacagaggaggagacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccacccctgggggcggcggcagcagcgctgccaggagagtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgtctggaggagccccccagagccccaatggagccctgctgccctttgtgaactgcagagatgctggccaggaccgggccggcggggaggaggatgctggctgtgtgcgggcccggggccggcccagcgaggaggagctgcaggacagccgggtgtatgtgagcagcctgtag

SEQ ID NO: 145821 - DNA, 6522 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactggatgcaggatgccatgggctatgagctgccctgggtgtactttgtgtccctggtgatcttcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagggctacttcagtgacccctggaatgtgtttgacttcctgattgtcatcggcagcatcattgatgtgatcctgtctgagaccaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgggagcggcacgtgcccatgtgtgaggacctggagctgcggcgggacagcggcagcgctggcacccaggcccactgcctgctgctgaggaaggccaaccccagccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgagaaccggcagctgaccctgcctgaggaggacaagagggacatccggcagagccccaagaggggcttcctgcggagcgccagcctgggccggcgggccagcttccacctggagtgcctgaagaggcagaaggaccggggcggggacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccaccccaggcggcggcggcagcagcgctgcccggcgggtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgagcggcggggccccccagagccccaacggggccctgctgccctttgtgaactgcagagatgctggccaggacagagctggaggagaagaagatgctggctgtgtgcgggcccggggccggcccagcgaggaggagctgcaggacagccgggtgtatgtgagcagcctgtag

SEQ ID NO: 145822 - DNA, 6474 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaggtgaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagaggagggccccagccccagcgaggcccaccagggcgctgaggaccccttccggcctgctggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatcagaagagccatcagcggggacctgacagctgaggaggagctggacaaggccatgaaggaggccgtgtctgctgcctctgaagatgacatcttccggcgggccggcggcctgtttggaaatcatgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgagaaccggcagctgaccctgcctgaggaggacaagagggacatccggcagagccccaagaggggcttcctgcggagcgccagcctgggccggcgggccagcttccacctggagtgcctgaagaggcagaaggaccggggcggggacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccaccccaggcggcggcggcagcagcgctgcccggcgggtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgagcggcggggccccccagagccccaacggggccctgctgccctttgtgaactgcagagatgctggccaggacagagctggaggagaagaagatgctggctgtgtgcgggcccggggccggcccagcgaggaggagctgcaggacagccgggtgtatgtgagcagcctgtag

SEQ ID NO: 145823 - DNA, 6468 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctgggcaatgctgactatgtgttcaccagcatcttcaccctggagatcatcctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagggctacttcagtgacccctggaatgtgtttgacttcctgattgtcatcggcagcatcattgatgtgatcctgtctgagaccaaccactacttctgtgatgcctggaacacctttgatgccctgattgtggtgggcagcatcgtggacatcgccatcacagaggtgaacaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccactggagaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatcagaagagccatcagcggggacctgacagctgaggaggagctggacaaggccatgaaggaggccgtgtctgctgcctctgaagatgacatcttccggcgggccggcggcctgtttggaaatcatgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgagaaccggcagctgaccctgcctgaggaggacaagagggacatccggcagagccccaagaggggcttcctgcggagcgccagcctgggccggcgggccagcttccacctggagtgcctgaagaggcagaaggaccggggcggggacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccaccccaggcggcggcggcagcagcgctgcccggcgggtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgagcggcggggccccccagagccccaacggggccctgctgccctttgtgaactgcagagatgctggccaggacagagctggaggagaagaagatgctggctgtgtgcgggcccggggccggcccagcgaggaggagctgcaggacagccgggtgtatgtgagcagcctgtag

SEQ ID NO: 145824 - DNA, 6630 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactggatgcaggatgccatgggctatgagctgccctgggtgtactttgtgtccctggtgatcttcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaggtgaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaacaggatgcactgctgtgacatgctggatggcggcaccttccccccagccctgggcccccggcgggccccaccctgcctgcaccagcagctgcagggcagcctggccggcctgcgggaggacaccccctgcatcgtgcccggccacgccagcctgtgctgcagcagccgggtgggggagtggctgcctgctggctgcacagccccccagcacgcccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgagaaccggcagctgaccctgcctgaggaggacaagagggacatccggcagagccccaagaggggcttcctgcggagcgccagcctgggccggcgggccagcttccacctggagtgcctgaagaggcagaaggaccggggcggggacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccaccccaggcggcggcggcagcagcgctgcccggcgggtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgagcggcggggccccccagagccccaacggggccctgctgccctttgtgaactgcagagatgctggccaggacagagctggaggagaagaagatgctggctgtgtgcgggcccggggccggcccagcgaggaggagctgcaggacagccgggtgtatgtgagcagcctgtag

SEQ ID NO: 145825 - DNA, 6474 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctgggcaatgctgactatgtgttcaccagcatcttcaccctggagatcatcctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaggtgaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagaggagggccccagccccagcgaggcccaccagggcgctgaggaccccttccggcctgctggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatcagaagagccatcagcggggacctgacagctgaggaggagctggacaaggccatgaaggaggccgtgtctgctgcctctgaagatgacatcttccggcgggccggcggcctgtttggaaatcatgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgagaaccggcagctgaccctgcctgaggaggacaagagggacatccggcagagccccaagaggggcttcctgcggagcgccagcctgggccggcgggccagcttccacctggagtgcctgaagaggcagaaggaccggggcggggacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccaccccaggcggcggcggcagcagcgctgcccggcgggtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgagcggcggggccccccagagccccaacggggccctgctgccctttgtgaactgcagagatgctggccaggacagagctggaggagaagaagatgctggctgtgtgcgggcccggggccggcccagcgaggaggagctgcaggacagccgggtgtatgtgagcagcctgtag

SEQ ID NO: 145826 - DNA, 6501 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagggctacttcagtgacccctggaatgtgtttgacttcctgattgtcatcggcagcatcattgatgtgatcctgtctgagaccaaccactacttctgtgatgcctggaacacctttgatgccctgattgtggtgggcagcatcgtggacatcgccatcacagaggtgaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgaaaatcggcagctgaccctgcctgaggaggacaagagggacatccggcagagccccaagaggggcttcctgcggagcgccagcctgggcagaagagccagcttccacctggagtgcctgaagaggcagaaggacagaggaggagacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccacccctgggggcggcggcagcagcgctgccaggagagtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgtctggaggagccccccagagccccaatggagccctgctgccctttgtgaactgcagagatgctggccaggaccgggccggcggggaggaggatgctggctgtgtgcgggcccggggccggcccagcgaggaggagctgcaggacagccgggtgtatgtgagcagcctgtag

SEQ ID NO: 145827 - DNA, 6417 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactggatgcaggatgccatgggctatgagctgccctgggtgtactttgtgtccctggtgatcttcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctgggcaatgctgactatgtgttcaccagcatcttcaccctggagatcatcctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaggtgaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgaaaatcggcagctgaccctgcctgaggaggacaagagggacatccggcagagccccaagaggggcttcctgcggagcgccagcctgggcagaagagccagcttccacctggagtgcctgaagaggcagaaggacagaggaggagacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccacccctgggggcggcggcagcagcgctgccaggagagtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgtctggaggagccccccagagccccaatggagccctgctgccctttgtgaactgcagagatgctggccaggaccgggccggcggggaggaggatgctggctgtgtgcgggcccggggccggcccagcgaggaggagctgcaggacagccgggtgtatgtgagcagcctgtag

SEQ ID NO: 145828 - DNA, 6417 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctgggcaatgctgactatgtgttcaccagcatcttcaccctggagatcatcctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagggctacttcagtgacccctggaatgtgtttgacttcctgattgtcatcggcagcatcattgatgtgatcctgtctgagaccaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgaaaatcggcagctgaccctgcctgaggaggacaagagggacatccggcagagccccaagaggggcttcctgcggagcgccagcctgggcagaagagccagcttccacctggagtgcctgaagaggcagaaggacagaggaggagacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccacccctgggggcggcggcagcagcgctgccaggagagtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgtctggaggagccccccagagccccaatggagccctgctgccctttgtgaactgcagagatgctggccaggaccgggccggcggggaggaggatgctggctgtgtgcgggcccggggccggcccagcgaggaggagctgcaggacagccgggtgtatgtgagcagcctgtag

SEQ ID NO: 145829 - DNA, 6435 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaaaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccactggagaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagaggagggccccagccccagcgaggcccaccagggcgctgaggaccccttccggcctgctggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgaaaatcggcagctgaccctgcctgaggaggacaagagggacatccggcagagccccaagaggggcttcctgcggagcgccagcctgggcagaagagccagcttccacctggagtgcctgaagaggcagaaggacagaggaggagacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccacccctgggggcggcggcagcagcgctgccaggagagtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgtctggaggagccccccagagccccaatggagccctgctgccctttgtgaactgcagagatgctggccaggaccgggccggcggggaggaggatgctggctgtgtgcgggcccggggccggcccagcgaggaggagctgcaggacagccgggtgtatgtgagcagcctgtag

SEQ ID NO: 145830 - DNA, 6417 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaggtgaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgaaaatcggcagctgaccctgcctgaggaggacaagagggacatccggcagagccccaagaggggcttcctgcggagcgccagcctgggcagaagagccagcttccacctggagtgcctgaagaggcagaaggacagaggaggagacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccacccctgggggcggcggcagcagcgctgccaggagagtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgtctggaggagccccccagagccccaatggagccctgctgccctttgtgaactgcagagatgctggccaggaccgggccggcggggaggaggatgctggctgtgtgcgggcccggggccggcccagcgaggaggagctgcaggacagccgggtgtatgtgagcagcctgtag

SEQ ID NO: 145831 - DNA, 6474 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagggctacttcagtgacccctggaatgtgtttgacttcctgattgtcatcggcagcatcattgatgtgatcctgtctgagaccaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagaggagggccccagccccagcgaggcccaccagggcgctgaggaccccttccggcctgctggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatcagaagagccatcagcggggacctgacagctgaggaggagctggacaaggccatgaaggaggccgtgtctgctgcctctgaagatgacatcttccggcgggccggcggcctgtttggaaatcatgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgagaaccggcagctgaccctgcctgaggaggacaagagggacatccggcagagccccaagaggggcttcctgcggagcgccagcctgggccggcgggccagcttccacctggagtgcctgaagaggcagaaggaccggggcggggacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccaccccaggcggcggcggcagcagcgctgcccggcgggtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgagcggcggggccccccagagccccaacggggccctgctgccctttgtgaactgcagagatgctggccaggacagagctggaggagaagaagatgctggctgtgtgcgggcccggggccggcccagcgaggaggagctgcaggacagccgggtgtatgtgagcagcctgtag

SEQ ID NO: 145832 - DNA, 6630 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactggatgcaggatgccatgggctatgagctgccctgggtgtactttgtgtccctggtgatcttcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctcttctactttgacatcgtgttcaccaccatcttcaccatcgagatcgccctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagggctacttcagtgacccctggaatgtgtttgacttcctgattgtcatcggcagcatcattgatgtgatcctgtctgagaccaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaacaggatgcactgctgtgacatgctggatggcggcaccttccccccagccctgggcccccggcgggccccaccctgcctgcaccagcagctgcagggcagcctggccggcctgcgggaggacaccccctgcatcgtgcccggccacgccagcctgtgctgcagcagccgggtgggggagtggctgcctgctggctgcacagccccccagcacgcccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgagaaccggcagctgaccctgcctgaggaggacaagagggacatccggcagagccccaagaggggcttcctgcggagcgccagcctgggccggcgggccagcttccacctggagtgcctgaagaggcagaaggaccggggcggggacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccaccccaggcggcggcggcagcagcgctgcccggcgggtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgagcggcggggccccccagagccccaacggggccctgctgccctttgtgaactgcagagatgctggccaggacagagctggaggagaagaagatgctggctgtgtgcgggcccggggccggcccagcgaggaggagctgcaggacagccgggtgtatgtgagcagcctgtag

SEQ ID NO: 145833 - DNA, 3840 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctgggcaatgctgactatgtgttcaccagcatcttcaccctggagatcatcctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaaggtgggcctgtag

SEQ ID NO: 145834 - DNA, 6546 bp, Artificial Sequence
  Description of Artificial Sequence: Synthetic coding sequence
atgatgatgatgatgatgatgaagaagatgcagcaccagaggcagcagcaggccgaccacgccaatgaggccaactatgcccggggcacccggctgcccctgtctggagagggccccaccagccagcccaacagcagcaagcagacagtgctgtcctggcaggccgccattgatgctgcccggcaggccaaggccgcccagaccatgagcaccagcgcccctcctcctgtgggcagcctgagccagaggaagaggcagcagtatgccaagagcaagaagcagggcaacagcagcaacagcaggcctgcccgggccctcttctgcctgagcctgaacaaccccatccggcgggcctgcatcagcatcgtggagtggaagccctttgacatcttcatcctgctggccatctttgccaactgtgtggccctggccatctacatccccttcccagaagatgacagcaacagcaccaaccacaacctggagaaggtggagtatgccttcctgatcatcttcaccgtggagaccttcctgaagatcatcgcctacggcctgctgctgcaccccaatgcctacgtgagaaatggctggaacctgctggactttgtgattgtcatcgtgggcctcttcagcgtcatcctggagcagctgaccaaggagacagaaggaggcaaccacagcagcggcaagagcggcggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctcttcgtcatcatcatctatgccatcatcggcctggagctgttcatcggcaagatgcacaagacctgcttctttgctgacagcgacatcgtggccgaggaggaccctgccccctgtgccttctctggaaatggccggcagtgcacagccaatggaacagagtgccgcagcggctgggtgggccccaatggaggcatcaccaactttgacaactttgcctttgccatgctgaccgtcttccagtgcatcaccatggagggctggacagatgtgctgtactgggtgaatgatgccatcggctgggagtggccctgggtgtactttgtgtccctcatcatcctgggcagcttctttgtgctgaacctggtgctgggcgtgctgagcggggagttcagcaaggagcgggagaaggccaaggcccggggggacttccagaagctgcgggagaagcagcagctggaggaggacctgaagggctacctggactggatcacccaggccgaggacatcgaccctgaaaatgaggaggagggcggggaggagggcaagaggaacacctccatgcccaccagcgagacagaatctgtgaacacagaaaatgtgtctggagagggggagaacagaggctgctgcggcagcctgtggtgctggtggaggagaagaggagctgccaaggccggccccagcggctgccgccgctggggccaggccatcagcaagagcaagctgagccgccgctggaggcgctggaaccgcttcaacagaagacgctgcagagctgctgtgaagtctgtgaccttctactggctggtgattgtgctggtgttcctgaacaccctgaccatcagcagcgagcactacaaccagcctgactggctgacccagatccaggacatcgccaacaaggtgctgctggccctcttcacctgtgagatgctggtgaagatgtacagcctgggcctgcaggcctactttgtgtccctcttcaacagatttgactgctttgtggtgtgtggcggcatcacagagaccatcctggtggagctggagatcatgagccccctgggcatcagcgtcttccgctgtgtgcggctgctgcgcatcttcaaggtgaccaggcactggaccagcctgagcaacctggtggccagcctgctgaacagcatgaagagcatcgccagcctgctgctgctgctcttcctgttcatcatcatcttcagcctgctgggcatgcagctgtttggaggcaagttcaactttgatgagacccagaccaagaggagcacctttgacaacttcccccaggccctgctgactgtgttccagatcctgactggagaggactggaatgctgtgatgtatgatggcatcatggcctacggcggccccagcagcagcggcatgattgtgtgcatctacttcatcatcctcttcatctgtggcaactacatcctgctgaatgtgttcctggccatcgctgtggacaacctggctgatgctgagagcctgaacacagcccagaaggaggaggccgaggagaaggagaggaagaagatcgccaggaaggagagcctggagaacaagaagaacaacaagccagaggtgaaccagatcgccaacagcgacaacaaggtgaccattgatgactaccgggaggaggatgaggacaaggacccctacccaccctgtgatgtgcctgtgggggaggaggaggaggaggaggaggaggatgagcctgaggtgcctgctggcccccggccccggcgcatcagcgagctgaacatgaaggagaagatcgcccccatccctgagggcagcgccttcttcatcctgagcaagaccaaccccatccgggtgggctgccacaagctgatcaaccaccacatcttcaccaacctgatcctggtgttcatcatgctgagcagcgctgccctggccgctgaggaccccatccgcagccacagcttcaggaacaccatcctgggctactttgattatgccttcaccgccatcttcaccgtggagatcctgctgaagatgaccacctttggagccttcctgcacaagggggccttctgcaggaactacttcaacctgctggacatgctggtggtgggcgtgtccctggtgtcctttggcatccagagcagcgccatctctgtggtgaagatcctgcgggtgctgcgggtgctgcggcccctgcgggccatcaacagagccaagggcctgaagcacgtggtgcagtgtgtgtttgtggccatccgcaccatcggcaacatcatgattgtgaccaccctgctgcagttcatgtttgcctgcatcggcgtgcagctgttcaagggcaagttctaccgctgcacagatgaggccaagagcaaccctgaggagtgccggggcctcttcatcctgtacaaggatggagatgtggacagccctgtggtgcgggagcgcatctggcagaacagcgacttcaactttgacaacgtgctgagcgccatgatggccctcttcaccgtgtccacctttgagggctggccagccctgctgtacaaggccatcgacagcaatggagagaacatcggccccatctacaaccaccgggtggagatcagcatcttcttcatcatctacatcatcatcgtggccttcttcatgatgaacatctttgtgggcttcgtcatcgtgaccttccaggagcagggcgagaaggagtacaagaactgtgagctggacaagaaccagaggcagtgtgtggagtatgccctgaaggcccggcccctgcggcgctacatccccaagaacccctaccagtacaagttctggtacgtggtgaacagcagcccctttgagtacatgatgtttgtgctgatcatgctgaacaccctgtgcctggccatgcagcactatgagcagagcaagatgtttaatgatgccatggacatcctgaacatggtgttcaccggggtcttcaccgtggagatggtgctgaaggtgattgccttcaagcccaagggctacttcagtgatgcctggaacacctttgacagcctcatcgtcatcggcagcatcattgatgtggccctgtctgaggccgaccccacagaaagtgaaaatgtgcctgtgcccacagccaccccaggcaacagcgaggagagcaaccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgccatgctgttcttcatctatgctgtgattggcatgcagatgtttgggaaggtggccatgagggacaacaaccagatcaacagaaacaacaacttccagaccttcccccaggccgtgctgctgctcttccgctgtgccaccggggaggcctggcaggagatcatgctggcctgcctgcccgggaagctgtgtgaccctgagagtgactacaaccctggagaggagtacacctgtggcagcaactttgccatcgtgtacttcatctccttctacatgctgtgtgccttcctgatcatcaacctgtttgtggccgtcatcatggacaactttgactacctgacccgggactggagcatcctgggcccccaccacctggatgagttcaagaggatctggagcgaatatgaccctgaggccaagggccgcatcaagcacctggatgtggtgaccctgctgcggcgcatccagccccccctgggctttgggaagctgtgcccccaccgggtggcctgcaagaggctggtggccatgaacatgcccctgaacagtgatggcaccgtgatgtttaatgccaccctgtttgccctggtgaggacagccctgaagatcaagacagagggcaacctggagcaggccaatgaggagctgcgggctgtgatcaagaagatctggaagaagacctccatgaagctgctggaccaggtggtgcccccagctggagatgatgaggtgacagtgggcaagttctacgccaccttcctgatccaggactacttcaggaagttcaagaagaggaaggagcagggcctggtgggcaagtacccagccaagaacaccaccatcgccctgcaggccggcctgcggaccctgcatgacatcggccctgagatcagaagagccatcagctgtgacctgcaggatgatgagcctgaggagaccaagcgggaggaggaggatgatgtgttcaagagaaatggagccctgctgggcaaccacgtgaaccacgtgaacagcgacagaagagacagcctgcagcagaccaacaccacccaccggcccctgcacgtgcagaggcccagcatccccccagccagtgacacagagaagcccctcttccccccagctggcaacagcgtgtgccacaaccaccacaaccacaacagcatcggcaagcaggtgcccaccagcaccaatgccaacctgaacaatgccaacatgagcaaggccgcccacggcaagaggcccagcatcggcaacctggagcacgtgtctgaaaatggccaccacagcagccacaagcatgaccgggagccccagaggaggagctctgtgaagaggacccgctactatgagacctacatccgcagtgacagcggagatgagcagctgcccaccatctgccgggaggaccctgagatccacggctacttccgggacccccactgcctgggggagcaggagtacttcagcagcgaggagtgctatgaagatgacagcagccccacctggagccggcagaactacggctactacagccgctacccaggcaggaacatcgacagcgagcggccccggggctaccaccacccccagggcttcctggaggatgatgacagccctgtgtgctatgacagcagaagaagcccccggcggcggctgctgccccccaccccagccagccacagaagaagcagcttcaactttgagtgcctgcggcggcagagcagccaggaggaggtgcccagcagccccatcttcccccacaggacagccctgcccctgcacctgatgcagcagcagatcatggctgtggccggcctggacagcagcaaggcccagaagtacagccccagccacagcaccaggtcctgggccaccccaccagccaccccaccctacagagactggaccccctgctacacccccctcatccaggtggagcagagcgaggccctggaccaggtgaatggcagcctgcccagcctgcacaggagctcctggtacacagatgagccagacatctcctaccgcaccttcaccccagccagcctgactgtgcccagcagcttcaggaacaagaacagcgacaagcagaggtctgctgacagcctggtggaggccgtgctgatcagcgagggcctgggccgctatgcccgggaccccaagtttgtgtctgccaccaagcatgaaattgctgatgcctgtgacctgaccattgatgagatggagagcgctgccagcaccctgctgaatggaaatgtgcggccccgggccaatggagatgtgggccccctgagccaccggcaggactatgagctgcaggactttggacctggctacagtgatgaggagccagaccccggcagagatgaggaggacctggctgatgagatgatctgcatcaccaccctgtag

SEQ ID NO: 145835 - DNA, 6486 bp, Artificial Sequence
  Description of Artificial Sequence: Synthetic coding sequence
atgatgatgatgatgatgatgaagaagatgcagcaccagaggcagcagcaggccgaccacgccaatgaggccaactatgcccggggcacccggctgcccctgtctggagagggccccaccagccagcccaacagcagcaagcagacagtgctgtcctggcaggccgccattgatgctgcccggcaggccaaggccgcccagaccatgagcaccagcgcccctcctcctgtgggcagcctgagccagaggaagaggcagcagtatgccaagagcaagaagcagggcaacagcagcaacagcaggcctgcccgggccctcttctgcctgagcctgaacaaccccatccggcgggcctgcatcagcatcgtggagtggaagccctttgacatcttcatcctgctggccatctttgccaactgtgtggccctggccatctacatccccttcccagaagatgacagcaacagcaccaaccacaacctggagaaggtggagtatgccttcctgatcatcttcaccgtggagaccttcctgaagatcatcgcctacggcctgctgctgcaccccaatgcctacgtgagaaatggctggaacctgctggactttgtgattgtcatcgtgggcctcttcagcgtcatcctggagcagctgaccaaggagacagaaggaggcaaccacagcagcggcaagagcggcggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctcttcgtcatcatcatctatgccatcatcggcctggagctgttcatcggcaagatgcacaagacctgcttctttgctgacagcgacatcgtggccgaggaggaccctgccccctgtgccttctctggaaatggccggcagtgcacagccaatggaacagagtgccgcagcggctgggtgggccccaatggaggcatcaccaactttgacaactttgcctttgccatgctgaccgtcttccagtgcatcaccatggagggctggacagatgtgctgtactggatgaatgatgccatgggctttgagctgccctgggtgtactttgtgtccctggtgatcttcggcagcttctttgtgctgaacctggtgctgggcgtgctgagcggggagttcagcaaggagcgggagaaggccaaggcccggggggacttccagaagctgcgggagaagcagcagctggaggaggacctgaagggctacctggactggatcacccaggccgaggacatcgaccctgaaaatgaggaggagggcggggaggagggcaagaggaacacctccatgcccaccagcgagacagaatctgtgaacacagaaaatgtgtctggagagggggagaacagaggctgctgcggcagcctgtgccaggccatcagcaagagcaagctgagccgccgctggaggcgctggaaccgcttcaacagaagacgctgcagagctgctgtgaagtctgtgaccttctactggctggtgattgtgctggtgttcctgaacaccctgaccatcagcagcgagcactacaaccagcctgactggctgacccagatccaggacatcgccaacaaggtgctgctggccctcttcacctgtgagatgctggtgaagatgtacagcctgggcctgcaggcctactttgtgtccctcttcaacagatttgactgctttgtggtgtgtggcggcatcacagagaccatcctggtggagctggagatcatgagccccctgggcatcagcgtcttccgctgtgtgcggctgctgcgcatcttcaaggtgaccaggcactggaccagcctgagcaacctggtggccagcctgctgaacagcatgaagagcatcgccagcctgctgctgctgctcttcctgttcatcatcatcttcagcctgctgggcatgcagctgtttggaggcaagttcaactttgatgagacccagaccaagaggagcacctttgacaacttcccccaggccctgctgactgtgttccagatcctgactggagaggactggaatgctgtgatgtatgatggcatcatggcctacggcggccccagcagcagcggcatgattgtgtgcatctacttcatcatcctcttcatctgtggcaactacatcctgctgaatgtgttcctggccatcgctgtggacaacctggctgatgctgagagcctgaacacagcccagaaggaggaggccgaggagaaggagaggaagaagatcgccaggaaggagagcctggagaacaagaagaacaacaagccagaggtgaaccagatcgccaacagcgacaacaaggtgaccattgatgactaccgggaggaggatgaggacaaggacccctacccaccctgtgatgtgcctgtgggggaggaggaggaggaggaggaggaggatgagcctgaggtgcctgctggcccccggccccggcgcatcagcgagctgaacatgaaggagaagatcgcccccatccctgagggcagcgccttcttcatcctgagcaagaccaaccccatccgggtgggctgccacaagctgatcaaccaccacatcttcaccaacctgatcctggtgttcatcatgctgagcagcgctgccctggccgctgaggaccccatccgcagccacagcttcaggaacaccatcctgggctactttgattatgccttcaccgccatcttcaccgtggagatcctgctgaagatgaccacctttggagccttcctgcacaagggggccttctgcaggaactacttcaacctgctggacatgctggtggtgggcgtgtccctggtgtcctttggcatccagagcagcgccatctctgtggtgaagatcctgcgggtgctgcgggtgctgcggcccctgcgggccatcaacagagccaagggcctgaagcacgtggtgcagtgtgtgtttgtggccatccgcaccatcggcaacatcatgattgtgaccaccctgctgcagttcatgtttgcctgcatcggcgtgcagctgttcaagggcaagttctaccgctgcacagatgaggccaagagcaaccctgaggagtgccggggcctcttcatcctgtacaaggatggagatgtggacagccctgtggtgcgggagcgcatctggcagaacagcgacttcaactttgacaacgtgctgagcgccatgatggccctcttcaccgtgtccacctttgagggctggccagccctgctgtacaaggccatcgacagcaatggagagaacatcggccccatctacaaccaccgggtggagatcagcatcttcttcatcatctacatcatcatcgtggccttcttcatgatgaacatctttgtgggcttcgtcatcgtgaccttccaggagcagggcgagaaggagtacaagaactgtgagctggacaagaaccagaggcagtgtgtggagtatgccctgaaggcccggcccctgcggcgctacatccccaagaacccctaccagtacaagttctggtacgtggtgaacagcagcccctttgagtacatgatgtttgtgctgatcatgctgaacaccctgtgcctggccatgcagcactatgagcagagcaagatgtttaatgatgccatggacatcctgaacatggtgttcaccggggtcttcaccgtggagatggtgctgaaggtgattgccttcaagcccaagggctacttcagtgatgcctggaacacctttgacagcctcatcgtcatcggcagcatcattgatgtggccctgtctgaggccgaccccacagaaagtgaaaatgtgcctgtgcccacagccaccccaggcaacagcgaggagagcaaccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgccatgctgttcttcatctatgctgtgattggcatgcagatgtttgggaaggtggccatgagggacaacaaccagatcaacagaaacaacaacttccagaccttcccccaggccgtgctgctgctcttccgctgtgccaccggggaggcctggcaggagatcatgctggcctgcctgcccgggaagctgtgtgaccctgagagtgactacaaccctggagaggagtacacctgtggcagcaactttgccatcgtgtacttcatctccttctacatgctgtgtgccttcctgatcatcaacctgtttgtggccgtcatcatggacaactttgactacctgacccgggactggagcatcctgggcccccaccacctggatgagttcaagaggatctggagcgaatatgaccctgaggccaagggccgcatcaagcacctggatgtggtgaccctgctgcggcgcatccagccccccctgggctttgggaagctgtgcccccaccgggtggcctgcaagaggctggtggccatgaacatgcccctgaacagtgatggcaccgtgatgtttaatgccaccctgtttgccctggtgaggacagccctgaagatcaagacagagggcaacctggagcaggccaatgaggagctgcgggctgtgatcaagaagatctggaagaagacctccatgaagctgctggaccaggtggtgcccccagctggagatgatgaggtgacagtgggcaagttctacgccaccttcctgatccaggactacttcaggaagttcaagaagaggaaggagcagggcctggtgggcaagtacccagccaagaacaccaccatcgccctgcaggccggcctgcggaccctgcatgacatcggccctgagatcagaagagccatcagctgtgacctgcaggatgatgagcctgaggagaccaagcgggaggaggaggatgatgtgttcaagagaaatggagccctgctgggcaaccacgtgaaccacgtgaacagcgacagaagagacagcctgcagcagaccaacaccacccaccggcccctgcacgtgcagaggcccagcatccccccagccagtgacacagagaagcccctcttccccccagctggcaacagcgtgtgccacaaccaccacaaccacaacagcatcggcaagcaggtgcccaccagcaccaatgccaacctgaacaatgccaacatgagcaaggccgcccacggcaagaggcccagcatcggcaacctggagcacgtgtctgaaaatggccaccacagcagccacaagcatgaccgggagccccagaggaggagctctgtgaagaggacccgctactatgagacctacatccgcagtgacagcggagatgagcagctgcccaccatctgccgggaggaccctgagatccacggctacttccgggacccccactgcctgggggagcaggagtacttcagcagcgaggagtgctatgaagatgacagcagccccacctggagccggcagaactacggctactacagccgctacccaggcaggaacatcgacagcgagcggccccggggctaccaccacccccagggcttcctggaggatgatgacagccctgtgtgctatgacagcagaagaagcccccggcggcggctgctgccccccaccccagccagccacagaagaagcagcttcaactttgagtgcctgcggcggcagagcagccaggaggaggtgcccagcagccccatcttcccccacaggacagccctgcccctgcacctgatgcagcagcagatcatggctgtggccggcctggacagcagcaaggcccagaagtacagccccagccacagcaccaggtcctgggccaccccaccagccaccccaccctacagagactggaccccctgctacacccccctcatccaggtggagcagagcgaggccctggaccaggtgaatggcagcctgcccagcctgcacaggagctcctggtacacagatgagccagacatctcctaccgcaccttcaccccagccagcctgactgtgcccagcagcttcaggaacaagaacagcgacaagcagaggtctgctgacagcctggtggaggccgtgctgatcagcgagggcctgggccgctatgcccgggaccccaagtttgtgtctgccaccaagcatgaaattgctgatgcctgtgacctgaccattgatgagatggagagcgctgccagcaccctgctgaatggaaatgtgcggccccgggccaatggagatgtgggccccctgagccaccggcaggactatgagctgcaggactttggacctggctacagtgatgaggagccagaccccggcagagatgaggaggacctggctgatgagatgatctgcatcaccaccctgtag

SEQ ID NO: 145836 - DNA, 6414 bp, Artificial Sequence
  Description of Artificial Sequence: Synthetic coding sequence
atgatgatgatgatgatgatgaagaagatgcagcaccagaggcagcagcaggccgaccacgccaatgaggccaactatgcccggggcacccggctgcccctgtctggagagggccccaccagccagcccaacagcagcaagcagacagtgctgtcctggcaggccgccattgatgctgcccggcaggccaaggccgcccagaccatgagcaccagcgcccctcctcctgtgggcagcctgagccagaggaagaggcagcagtatgccaagagcaagaagcagggcaacagcagcaacagcaggcctgcccgggccctcttctgcctgagcctgaacaaccccatccggcgggcctgcatcagcatcgtggagtggaagccctttgacatcttcatcctgctggccatctttgccaactgtgtggccctggccatctacatccccttcccagaagatgacagcaacagcaccaaccacaacctggagaaggtggagtatgccttcctgatcatcttcaccgtggagaccttcctgaagatcatcgcctacggcctgctgctgcaccccaatgcctacgtgagaaatggctggaacctgctggactttgtgattgtcatcgtgggcctcttcagcgtcatcctggagcagctgaccaaggagacagaaggaggcaaccacagcagcggcaagagcggcggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctcttcgtcatcatcatctatgccatcatcggcctggagctgttcatcggcaagatgcacaagacctgcttctttgctgacagcgacatcgtggccgaggaggaccctgccccctgtgccttctctggaaatggccggcagtgcacagccaatggaacagagtgccgcagcggctgggtgggccccaatggaggcatcaccaactttgacaactttgcctttgccatgctgaccgtcttccagtgcatcaccatggagggctggacagatgtgctgtactggatgaatgatgccatgggctttgagctgccctgggtgtactttgtgtccctggtgatcttcggcagcttctttgtgctgaacctggtgctgggcgtgctgagcggggagttcagcaaggagcgggagaaggccaaggcccggggggacttccagaagctgcgggagaagcagcagctggaggaggacctgaagggctacctggactggatcacccaggccgaggacatcgaccctgaaaatgaggaggagggcggggaggagggcaagaggaacacctccatgcccaccagcgagacagaatctgtgaacacagaaaatgtgtctggagagggggagaacagaggctgctgcggcagcctgtgccaggccatcagcaagagcaagctgagccgccgctggaggcgctggaaccgcttcaacagaagacgctgcagagctgctgtgaagtctgtgaccttctactggctggtgattgtgctggtgttcctgaacaccctgaccatcagcagcgagcactacaaccagcctgactggctgacccagatccaggacatcgccaacaaggtgctgctggccctcttcacctgtgagatgctggtgaagatgtacagcctgggcctgcaggcctactttgtgtccctcttcaacagatttgactgctttgtggtgtgtggcggcatcacagagaccatcctggtggagctggagatcatgagccccctgggcatcagcgtcttccgctgtgtgcggctgctgcgcatcttcaaggtgaccaggcactggaccagcctgagcaacctggtggccagcctgctgaacagcatgaagagcatcgccagcctgctgctgctgctcttcctgttcatcatcatcttcagcctgctgggcatgcagctgtttggaggcaagttcaactttgatgagacccagaccaagaggagcacctttgacaacttcccccaggccctgctgactgtgttccagatcctgactggagaggactggaatgctgtgatgtatgatggcatcatggcctacggcggccccagcagcagcggcatgattgtgtgcatctacttcatcatcctcttcatctgtggcaactacatcctgctgaatgtgttcctggccatcgctgtggacaacctggctgatgctgagagcctgaacacagcccagaaggaggaggccgaggagaaggagaggaagaagatcgccaggaaggagagcctggagaacaagaagaacaacaagccagaggtgaaccagatcgccaacagcgacaacaaggtgaccattgatgactaccgggaggaggatgaggacaaggacccctacccaccctgtgatgtgcctgtgggggaggaggaggaggaggaggaggaggatgagcctgaggtgcctgctggcccccggccccggcgcatcagcgagctgaacatgaaggagaagatcgcccccatccctgagggcagcgccttcttcatcctgagcaagaccaaccccatccgggtgggctgccacaagctgatcaaccaccacatcttcaccaacctgatcctggtgttcatcatgctgagcagcgctgccctggccgctgaggaccccatccgcagccacagcttcaggaacaccatcctgggctactttgattatgccttcaccgccatcttcaccgtggagatcctgctgaagatgaccacctttggagccttcctgcacaagggggccttctgcaggaactacttcaacctgctggacatgctggtggtgggcgtgtccctggtgtcctttggcatccagagcagcgccatctctgtggtgaagatcctgcgggtgctgcgggtgctgcggcccctgcgggccatcaacagagccaagggcctgaagcacgtggtgcagtgtgtgtttgtggccatccgcaccatcggcaacatcatgattgtgaccaccctgctgcagttcatgtttgcctgcatcggcgtgcagctgttcaagggcaagttctaccgctgcacagatgaggccaagagcaaccctgaggagtgccggggcctcttcatcctgtacaaggatggagatgtggacagccctgtggtgcgggagcgcatctggcagaacagcgacttcaactttgacaacgtgctgagcgccatgatggccctcttcaccgtgtccacctttgagggctggccagccctgctgtacaaggccatcgacagcaatggagagaacatcggccccatctacaaccaccgggtggagatcagcatcttcttcatcatctacatcatcatcgtggccttcttcatgatgaacatctttgtgggcttcgtcatcgtgaccttccaggagcagggcgagaaggagtacaagaactgtgagctggacaagaaccagaggcagtgtgtggagtatgccctgaaggcccggcccctgcggcgctacatccccaagaacccctaccagtacaagttctggtacgtggtgaacagcagcccctttgagtacatgatgtttgtgctgatcatgctgaacaccctgtgcctggccatgcagcactatgagcagagcaagatgtttaatgatgccatggacatcctgaacatggtgttcaccggggtcttcaccgtggagatggtgctgaaggtgattgccttcaagcccaagggctacttcagtgatgcctggaacacctttgacagcctcatcgtcatcggcagcatcattgatgtggccctgtctgaggccgacaacagcgaggagagcaaccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgccatgctgttcttcatctatgctgtgattggcatgcagatgtttgggaaggtggccatgagggacaacaaccagatcaacagaaacaacaacttccagaccttcccccaggccgtgctgctgctcttccgctgtgccactggagaggcctggcaggagatcatgctggcctgcctgcccgggaagctgtgtgaccctgagagtgactacaaccctggagaggagtacacctgtggcagcaactttgccatcgtgtacttcatctccttctacatgctgtgtgccttcctgatcatcaacctgtttgtggccgtcatcatggacaactttgactacctgacccgggactggagcatcctgggcccccaccacctggatgagttcaagaggatctggagcgaatatgaccctgaggccaagggccgcatcaagcacctggatgtggtgaccctgctgcggcgcatccagccccccctgggctttgggaagctgtgcccccaccgggtggcctgcaagaggctggtggccatgaacatgcccctgaacagtgatggcaccgtgatgtttaatgccaccctgtttgccctggtgaggacagccctgaagatcaagacagagggcaacctggagcaggccaatgaggagctgcgggccgtcatcaagaagatctggaagaagacctccatgaagctgctggaccaggtggtgcccccagctggagatgatgaggtgacagtgggcaagttctacgccaccttcctgatccaggactacttcaggaagttcaagaagaggaaggagcagggcctggtgggcaagtacccagccaagaacaccaccatcgccctgcaggccggcctgcggaccctgcatgacatcggccctgagatccggcgggccatcagctgtgacctgcaggatgatgagcctgaggagaccaagcgggaggaggaggatgatgtgttcaagagaaatggagccctgctgggcaaccacgtgaaccacgtgaacagcgaccggcgggacagcctgcagcagaccaacaccacccaccggcccctgcacgtgcagaggcccagcatccccccagccagtgacacagagaagcccctcttccccccagctggcaacagcgtgtgccacaaccaccacaaccacaacagcatcggcaagcaggtgcccaccagcaccaatgccaacctgaacaatgccaacatgagcaaggccgcccacggcaagaggcccagcatcggcaacctggagcacgtgtctgaaaatggccaccacagcagccacaagcatgaccgggagccccagaggaggagctctgtgaagagaagtgacagcggagatgagcagctgcccaccatctgccgggaggaccctgagatccacggctacttccgggacccccactgcctgggggagcaggagtacttcagcagcgaggagtgctatgaagatgacagcagccccacctggagccggcagaactacggctactacagccgctacccaggcaggaacatcgacagcgagcggccccggggctaccaccacccccagggcttcctggaggatgatgacagccctgtgtgctatgacagcagaagaagcccccggcggcggctgctgccccccaccccagccagccacagaagaagcagcttcaactttgagtgcctgcggcggcagagcagccaggaggaggtgcccagcagccccatcttcccccacaggacagccctgcccctgcacctgatgcagcagcagatcatggctgtggccggcctggacagcagcaaggcccagaagtacagccccagccacagcaccaggtcctgggccaccccaccagccaccccaccctacagagactggaccccctgctacacccccctcatccaggtggagcagagcgaggccctggaccaggtgaatggcagcctgcccagcctgcacaggagctcctggtacacagatgagccagacatctcctaccgcaccttcaccccagccagcctgactgtgcccagcagcttcaggaacaagaacagcgacaagcagaggtctgctgacagcctggtggaggccgtgctgatcagcgagggcctgggccgctatgcccgggaccccaagtttgtgtctgccaccaagcatgaaattgctgatgcctgtgacctgaccattgatgagatggagagcgctgccagcaccctgctgaatggaaatgtgcggccccgggccaatggagatgtgggccccctgagccaccggcaggactatgagctgcaggactttggacctggctacagtgatgaggagccagaccccggcagagatgaggaggacctggctgatgagatgatctgcatcaccaccctgtag

SEQ ID NO: 145837 - DNA, 5565 bp, Artificial Sequence
  Description of Artificial Sequence: Synthetic coding sequence
gccaacggcacagaatgtcgcagcggctgggtgggccccaacggcggcatcaccaactttgacaactttgcctttgccatgctgactgtgttccagtgcatcaccatggagggctggacagatgtgctgtactggatgaatgatgccatgggctttgagctgccctgggtgtactttgtgtccctggtgatcttcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaggaggagggcggggaggagggcaagaggaacacctccatgcccaccagcgagacagagagcgtgaacacagaaaatgtgtctggagaaggagaaaatagaggctgctgcggcagcctgtggtgctggtggaggagaagaggagctgccaaggccggccccagcggctgccgccgctggggccaggccatcagcaagagcaagctgagccgccgctggaggcgctggaaccgcttcaacagaagacgctgcagagctgctgtgaagtctgtgaccttctactggctggtgattgtgctggtgttcctgaacaccctgaccatcagcagcgagcactacaaccagcctgactggctgacccagatccaggacatcgccaacaaggtgctgctggccctcttcacctgtgagatgctggtgaagatgtacagcctgggcctgcaggcctactttgtgtccctcttcaacagatttgactgctttgtggtgtgtggcggcatcacagagaccatcctggtggagctggagatcatgagccccctgggcatctctgtgttccgctgtgtgcggctgctgcgcatcttcaaggtgaccaggcactggaccagcctgagcaacctggtggccagcctgctgaacagcatgaagagcatcgccagcctgctgctgctgctcttcctgttcatcatcatcttcagcctgctgggcatgcagctgtttggaggcaagttcaactttgatgagacccagaccaagaggagcacctttgacaacttcccccaggccctgctgaccgtcttccagatcctgaccggggaggactggaatgctgtgatgtatgatggcatcatggcctatggaggccccagcagcagcggcatgattgtgtgcatctacttcatcatcctcttcatctgtggcaactacatcctgctgaatgtgttcctggccatcgctgtggacaacctggctgatgctgagagcctgaacacagcccagaaggaggaggccgaggagaaggagaggaagaagatcgccaggaaggagagcctggagaacaagaagaacaacaagccagaggtgaaccagatcgccaacagcgacaacaaggtgaccattgatgactaccgggaggaggatgaggacaaggacccctacccaccctgtgatgtgcctgtgggggaggaggaggaggaggaggaggaggatgagcctgaggtgcctgctggcccccggccccggcgcatcagcgagctgaacatgaaggagaagatcgcccccatccctgagggcagcgccttcttcatcctgagcaagaccaaccccatccgggtgggctgccacaagctgatcaaccaccacatcttcaccaacctgatcctggtgttcatcatgctgagcagcgctgccctggccgctgaggaccccatccgcagccacagcttcaggaacaccatcctgggctactttgattatgccttcaccgccatcttcaccgtggagatcctgctgaagatgaccaccttcggggccttcctgcacaagggggccttctgcaggaactacttcaacctgctggacatgctggtggtgggcgtgtccctggtgtcctttggcatccagagcagcgccatctctgtggtgaagatcctgcgggtgctgcgggtgctgcggcccctgcgggccatcaacagagccaagggcctgaagcacgtggtgcagtgtgtgtttgtggccatccgcaccatcggcaacatcatgattgtgaccaccctgctgcagttcatgtttgcctgcattggagtgcagctgttcaagggcaagttctaccgctgcacagatgaggccaagagcaacccagaagaatgtcggggcctcttcatcctgtacaaggatggagatgtggacagccctgtggtgcgggagcgcatctggcagaacagcgacttcaactttgacaacgtgctgagcgccatgatggccctcttcaccgtgtccacctttgagggctggccagccctgctgtacaaggccatcgacagcaatggagaaaatattggccccatctacaaccaccgggtggagatcagcatcttcttcatcatctacatcatcatcgtggccttcttcatgatgaacatctttgtgggctttgtgattgtgaccttccaggagcagggcgagaaggagtacaagaactgtgagctggacaagaaccagaggcagtgtgtggagtatgccctgaaggcccggcccctgcggcgctacatccccaagaacccctaccagtacaagttctggtacgtggtgaacagcagcccctttgagtacatgatgtttgtgctgatcatgctgaacaccctgtgcctggccatgcagcactatgagcagagcaagatgtttaatgatgccatggacatcctgaacatggtgttcaccggggtcttcaccgtggagatggtgctgaaggtgattgccttcaagcccaagcactacttcacagatgcctggaacacctttgatgccctgattgtggtgggctctgtggtggacatcgccatcacagaggtgaaccccacagaaagtgaaaatgtgcctgtgcccacagccaccccaggcaacagcgaggagagcaaccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgccatgctgttcttcatctatgctgtgattggcatgcagatgtttgggaaggtggccatgagggacaacaaccagatcaacagaaacaacaacttccagaccttcccccaggccgtgctgctgctcttccgctgtgccactggagaggcctggcaggagatcatgctggcctgcctgcccgggaagctgtgtgaccctgagagtgactacaaccctggagaggagtacacctgtggcagcaactttgccatcgtgtacttcatctccttctacatgctgtgtgccttcctgatcatcaacctgtttgtggccgtcatcatggacaactttgactacctgacccgggactggagcatcctgggcccccaccacctggatgagttcaagaggatctggagcgaatatgaccctgaggccaagggccgcatcaagcacctggatgtggtgaccctgctgcggcgcatccagccccccctgggctttgggaagctgtgcccccaccgggtggcctgcaagaggctggtggccatgaacatgcccctgaacagtgatggcaccgtgatgtttaatgccaccctgtttgccctggtgaggacagccctgaagatcaagacagagggcaacctggagcaggccaatgaggagctgcgggccgtcatcaagaagatctggaagaagacctccatgaagctgctggaccaggtggtgcccccagctggagatgatgaggtgacagtgggcaagttctacgccaccttcctgatccaggactacttcaggaagttcaagaagaggaaggagcagggcctggtgggcaagtacccagccaagaacaccaccatcgccctgcaggccggcctgcggaccctgcatgacatcggccctgagatccggcgggccatcagctgtgacctgcaggatgatgagcctgaggagaccaagcgggaggaggaggatgatgtgttcaagagaaatggagccctgctgggcaaccacgtgaaccacgtgaacagcgaccggcgggacagcctgcagcagaccaacaccacccaccggcccctgcacgtgcagaggcccagcatccccccagccagtgacacagagaagcccctcttccccccagctggcaacagcgtgtgccacaaccaccacaaccacaacagcatcggcaagcaggtgcccaccagcaccaatgccaacctgaacaatgccaacatgagcaaggccgcccacggcaagaggcccagcatcggcaacctggagcacgtgtctgaaaatggccaccacagcagccacaagcatgaccgggagccccagaggaggagctctgtgaagaggacccgctactatgagacctacatccgcagtgacagcggagatgagcagctgcccaccatctgcagagaagatcctgagatccacggctacttccgggacccccactgcctgggggagcaggagtacttcagcagtgaagaatgttatgaagatgacagcagccccacctggagccggcagaactacggctactacagccgctacccaggaagaaatattgattctgagcggccccggggctaccaccacccccagggcttcctggaggatgatgacagccctgtgtgctatgacagccgccgcagcccccggcggcggctgctgccccccaccccagccagccaccggcgcagcagcttcaactttgaatgtctgcggcggcagagcagccaggaggaggtgcccagcagccccatcttcccccacaggacagccctgcccctgcacctgatgcagcagcagatcatggctgtggccggcctggacagcagcaaggcccagaagtacagccccagccacagcaccaggtcctgggccaccccaccagccaccccaccctacagagactggaccccctgctacacccccctcatccaggtggagcagagcgaggccctggaccaggtgaatggcagcctgcccagcctgcacaggagctcctggtacacagatgagccagacatctcctaccgcaccttcaccccagccagcctgactgtgcccagcagcttcaggaacaagaacagcgacaagcagaggtctgctgacagcctggtggaggccgtgctgatcagcgagggcctgggccgctatgcccgggaccccaagtttgtgtctgccaccaagcatgaaattgctgatgcctgtgacctgaccattgatgagatggagagcgctgccagcaccctgctgaatggaaatgtgcggccccgggccaatggagatgtgggccccctgagccaccggcaggactatgagctgcaggactttggacctggctacagtgatgaggagccagaccccggcagagatgaggaggacctggctgatgagatgatctgcatcaccaccctgtag

SEQ ID NO: 145838 - DNA, 1620 bp, Artificial Sequence
  Description of Artificial Sequence: Synthetic coding sequence
atgggagagacctggctgtgcccagctgccctgggcctgctgtacaaggccatcgacagcaatggagaaaatattggccccatctacaaccaccgggtggagatcagcatcttcttcatcatctacatcatcatcgtggccttcttcatgatgaacatctttgtgggctttgtgattgtgaccttccaggagcagggcgagaaggagtacaagaactgtgagctggacaagaaccagaggcagtgtgtggagtatgccctgaaggcccggcccctgcggcgctacatccccaagaacccctaccagtacaagttctggtacgtggtgaacagcagcccctttgagtacatgatgtttgtgctgatcatgctgaacaccctgtgcctggccatgcagcactatgagcagagcaagatgtttaatgatgccatggacatcctgaacatggtgttcaccggggtcttcaccgtggagatggtgctgaaggtgattgccttcaagcccaagggctacttcagtgatgcctggaacacctttgacagcctgattgtgattggcagcatcattgatgtggccctgtctgaggccgacaacagcgaggagagcaaccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgccatgctgttcttcatctatgctgtgattggcatgcagatgtttgggaaggtggccatgagggacaacaaccagatcaacagaaacaacaacttccagaccttcccccaggccgtgctgctgctcttccgctgtgccaccggggaggcctggcaggagatcatgctggcctgcctgcccgggaagctgtgtgaccctgagagtgactacaaccctggagaggagtacacctgtggcagcaactttgccatcgtgtacttcatctccttctacatgctgtgtgccttcctgatcatcaacctgtttgtggccgtcatcatggacaactttgactacctgacccgggactggagcatcctgggcccccaccacctggatgagttcaagaggatctggagcgaatatgaccctgaggccaagggccgcatcaagcacctggatgtggtgaccctgctgcggcgcatccagccccccctgggctttgggaagctgtgcccccaccgggtggcctgcaagaggctggtggccatgaacatgcccctgaacagtgatggcaccgtgatgtttaatgccaccctgtttgccctggtgaggacagccctgaagatcaagacagagggcaacctggagcaggccaatgaggagctgcgggctgtgatcaagaagatctggaagaagacctccatgaagctgctggaccaggtggtgcccccagctggagatgatgaggtgacagtgggcaagttctacgccaccttcctgatccaggactacttcaggaagttcaagaagaggaaggagcagggcctggtgggcaagtacccagccaagaacaccaccatcgccctgcagatgctggagaggatgctgtag

SEQ ID NO: 145839 - DNA, 1056 bp, Artificial Sequence
  Description of Artificial Sequence: Synthetic coding sequence
atgaatggcctggcccagagccggctggagacctgcatctcctacctgcactgctacagcgctggcctgcggaccctgcatgacatcggccctgagatccggcgggccatcagctgtgacctgcaggatgatgagcctgaggagaccaagcgggaggaggaggatgatgtgttcaagagaaatggagccctgctgggcaaccacgtgaaccacgtgaacagcgaccggcgggacagcctgcagcagaccaacaccacccaccggcccctgcacgtgcagaggcccagcatccccccagccagtgacacagagaagcccctcttccccccagctggcaacagcgtgtgccacaaccaccacaaccacaacagcatcggcaagcaggtgcccaccagcaccaatgccaacctgaacaatgccaacatgagcaaggccgcccacggcaagaggcccagcatcggcaacctggagcacgtgtctgaaaatggccaccacagcagccacaagcatgaccgggagccccagaggaggagctctgtgaagaggacccgctactatgagacctacatccgcagtgacagcggagatgagcagctgcccaccatctgcagagaagatcctgagatccacggctacttccgggacccccactgcctgggggagcaggagtacttcagcagtgaagaatgttatgaagatgacagcagccccacctggagccggcagaactacggctactacagccgctacccaggaagaaatattgattctgagcggccccggggctaccaccacccccagggcttcctggaggatgatgacagccctgtgtgctatgacagccgccgcagcccccggcggcggctgctgccccccaccccagccagccaccggcgcagcagcttcaactttgaatgtctgcggcggcagagcagccaggaggaggtgcccagcagccccatcttcccccacaggacagccctgcccctgcacctgatgcagcagcagagccccctgagcagtgaccacggcagctgccggccccgcttcaagtag

SEQ ID NO: 145840 - DNA, 5901 bp, Artificial Sequence
  Description of Artificial Sequence: Synthetic coding sequence
atgtctgagagcgagggcggcaaggacaccaccccagagcccagccctgccaacggggccggccctggccctgagtggggcctgtgccccggccccccagctgtggagggggagagcagcggggccagcggcctgggcacccccaagagaagaaaccagcacagcaagcacaagacagtggccgtggccagcgcccagaggagcccccgggccctcttctgcctgaccctggccaaccccctgcggcgcagctgcatcagcatcgtggagtggaagccctttgacatcctgatcctgctgaccatctttgccaactgtgtggccctgggcgtgtacatccccttcccagaagatgacagcaacacagccaaccacaacctggagcaggtggagtatgtgttcctggtgatcttcaccgtggagaccgtgctgaagatcgtggcctacggcctggtgctgcaccccagcgcctacatcagaaatggctggaacctgctggacttcatcatcgtggtggtgggcctcttctctgtgctgctggagcagggccctggccggcctggagatgccccccacactggaggcaagccaggcggctttgatgtgaaggccctgcgggccttccgggtgctgcggcccctgcggctggtgtctggagtgcccagcctgcacatcgtgctgaacagcatcatgaaggccctggtgcccctgctgcacatcgccctgctggtgctcttcgtcatcatcatctatgccatcatcggcctggagctgttcctgggccgcatgcacaagacctgctacttcctgggcagtgacatggaggccgaggaggaccccagcccctgtgccagcagcggcagcggccgggcctgcaccctgaaccagacagagtgccggggccgctggccaggccccaatggaggcatcaccaactttgacaacttcttctttgccatgctgaccgtcttccagtgtgtgaccatggagggctggacagatgtgctgtactggatgcaggatgccatgggctatgagctgccctgggtgtactttgtgtccctggtgatcttcggcagcttctttgtgctgaacctggtgctgggcgtgctgagcggggagttcagcaaggagcgggagaaggccaaggcccggggggacttccagaagcagcgggagaagcagcagatggaggaggacctgcggggctacctggactggatcacccaggccgaggagctggacatggaggaccccagcgcagatgacaacctgggcccccagctggccgagctgaccaacagaagaagaggccgcctgcgctggttcagccacagcaccaggagcacccacagcaccagcagccacgccagcctgcctgccagtgacaccggctccatgacagagacccagggagatgaagatgaggaggagggcgccctggccagctgcacccgctgcctgaacaagatcatgaagaccagggtgtgccggcggctgcggcgggccaacagagtgctgcgggcccgctgccggcgggctgtgaagagcaatgcctgctactgggccgtgctgctgctggtgttcctgaacaccctgaccatcgccagcgagcaccacggccagcctgtgtggctgacccagatccaggagtatgccaacaaggtgctgctgtgcctcttcaccgtggagatgctgctgaagctgtatggcctgggccccagcgcctacgtgagcagcttcttcaacagatttgactgctttgtggtgtgtggcggcatcctggagaccaccctggtggaggtgggcgccatgcagcccctgggcatctctgtgctgcgctgtgtgcggctgctgcgcatcttcaaggtgaccaggcactgggccagcctgagcaacctggtggccagcctgctgaacagcatgaagagcatcgccagcctgctgctgctgctcttcctgttcatcatcatcttcagcctgctgggcatgcagctgtttggaggcaagttcaactttgaccagacccacaccaagaggagcacctttgacaccttcccccaggccctgctgaccgtcttccagatcctgaccggggaggactggaatgtggtgatgtatgatggcatcatggcctatggaggccccttcttccctggcatgctggtgtgcatctacttcatcatcctcttcatctgtggcaactacatcctgctgaatgtgttcctggccatcgctgtggacaacctggccagcggagatgctggaacagccaaggacaagggcggggagaagagcaatgagaaggacctgccccaggagaatgaaggcctggtgcctggggtggagaaggaggaggaggagggcgcccggcgggagggcgctgacatggaggaggaggaggaggaggaggaggaggaggaggaggaggaggaggaggagggcgctgggggcgtggagctgctgcaggaggtggtgcccaaggagaaggtggtgcccatccctgagggcagcgccttcttctgcctgagccagaccaaccccctgaggaagggctgccacaccctcatccaccaccacgtgttcaccaacctgatcctggtgttcatcatcctgagctctgtgtccctggccgctgaggaccccatccgggcccacagcttcaggaaccacatcctgggctactttgattatgccttcaccagcatcttcaccgtggagatcctgctgaagatgacagtgtttggagccttcctgcaccggggcagcttctgccgctcctggttcaacatgctggacctgctggtggtgtctgtgtccctcatcagctttggcatccacagcagcgccatctctgtggtgaagatcctgcgggtgctgcgggtgctgcggcccctgcgggccatcaacagagccaagggcctgaagcacgtggtgcagtgtgtgtttgtggccatccgcaccatcggcaacatcatgattgtgaccaccctgctgcagttcatgtttgcctgcatcggcgtgcagctgttcaagggcaagttctacacctgcacagatgaggccaagcacaccccccaggagtgcaagggcagcttcctggtgtacccagatggagatgtgtcccggcccctggtgcgggagcggctgtgggtgaacagcgacttcaactttgacaacgtgctgagcgccatgatggccctcttcaccgtgtccacctttgagggctggccagccctgctgtacaaggccattgatgcctatgcagaggaccacggccccatctacaactacagagtggagatctctgtgttcttcatcgtgtacatcatcatcatcgccttcttcatgatgaacatctttgtgggcttcgtcatcatcaccttccgggcccagggcgagcaggagtaccagaactgtgagctggacaagaaccagaggcagtgtgtggagtatgccctgaaggcccagcccctgcggcgctacatccccaagaacccccaccagtacagagtgtgggccaccgtgaacagcgctgcctttgagtacctgatgttcctgctgatcctgctgaacacagtggccctggccatgcagcactatgagcagacagcccccttcaactatgccatggacatcctgaacatggtgttcaccggcctcttcaccatcgagatggtgctgaagatcatcgccttcaagcccaagcactacttcacagatgcctggaacacctttgatgccctgattgtggtgggcagcatcgtggacattgctgtgacagaggtgaacaatggaggccacctgggggagagcagcgaggacagcagccgcatcagcatcaccttcttccgcctcttccgggtgatgaggctggtgaagctgctgagcaagggggagggcatccgcaccctgctgtggaccttcatcaagagcttccaggccctgccctacgtggccctgctgattgccatgatcttcttcatctatgctgtgattggcatgcagatgtttgggaaggtggccctgcaggacggcacccagatcaacagaaacaacaacttccagaccttcccccaggccgtgctgctgctcttccgctgtgccaccggggaggcctggcaggagatcatgctggccagcctgcccggcaacagatgtgaccctgagagtgactttggacctggagaggagttcacctgtggcagcaactttgccatcgcctacttcatctccttcttcatgctgtgtgccttcctgatcatcaacctgtttgtggccgtcatcatggacaactttgactacctgacccgggactggagcatcctgggcccccaccacctggatgagttcaagaggatctggagcgaatatgaccccggggccaagggccgcatcaagcacctggatgtggtggccctgctgcggcgcatccagccccccctgggctttgggaagctgtgcccccaccgggtggcctgcaagaggctggtggccatgaacatgcccctgaacagtgatggcaccgtgaccttcaatgccaccctgtttgccctggtgaggaccagcctgaagatcaagacagagggcaacctggagcaggccaaccaggagctgagaattgtcatcaagaagatctggaagaggatgaagcagaagctgctggatgaggtgatccccccaccagatgaggaggaggtgacagtgggcaagttctacgccaccttcctgatccaggactacttcaggaagttcagaagaaggaaggagaagggcctgctgggcaatgatgctgcccccagcaccagcagcgccctgcaggccggcctgcggagcctgcaggacctgggccctgagatgaggcaggccctgacctgtgacacagaggaggaggaggaggagggccaggagggcgtggaggaggaggatgagaaggacctggagaccaacaaggccaccatggtgtcccagcccagcgcccggcggggcagcggcatctctgtgtccctgcctgtgggggaccggctgcctgacagcctgagctttggccccagtgatgatgaccggggcacccccaccagcagccagcccagcgtgccccaggccggcagcaacacccaccggcggggcagcggggccctgatcttcaccatccctgaggagggcaacagccagcccaagggcaccaagggccagaacaagcaggatgaagatgaggaggtgcctgaccggctgagctacctggatgagcaggccggcaccccaccctgcagcgtgctgctgcccccccaccgggcccagcgctacatggatggccacctggtgccccggcggcggctgctgccccccaccccagctggcaggaagcccagcttcaccatccagtgcctgcagaggcagggcagctgtgaggacctgcccatccctggcacctaccaccggggcaggaacagcggccccaacagagcccagggctcctgggccaccccaccccagaggggccgcctgctgtatgcccccctgctgctggtggaggagggcgctgctggggagggctacctgggccgcagcagcggccccctgcggaccttcacctgcctgcacgtgcccggcacccacagcgaccccagccacggcaagaggggcagcgctgacagcctggtggaggccgtgctgatcagcgagggcctgggcctgtttgcccgggaccccaggtttgtggccctggccaagcaggagattgctgatgcctgccgcctgaccctggatgagatggacaatgctgccagtgacctgctggcccagggcaccagcagcctgtacagtgatgaggagagcatcctgagcagatttgatgaggaggacctgggagatgagatggcctgtgtgcacgccctgtag

SEQ ID NO: 145841 - DNA, 5739 bp, Artificial Sequence
  Description of Artificial Sequence: Synthetic coding sequence
atgtctgagagcgagggcggcaagggggagcgcatcctgcccagcctgcagaccctgggcgccagcatcgtggagtggaagccctttgacatcctgatcctgctgaccatctttgccaactgtgtggccctgggcgtgtacatccccttcccagaagatgacagcaacacagccaaccacaacctggagcaggtggagtatgtgttcctggtgatcttcaccgtggagaccgtgctgaagatcgtggcctacggcctggtgctgcaccccagcgcctacatcagaaatggctggaacctgctggacttcatcatcgtggtggtgggcctcttctctgtgctgctggagcagggccctggccggcctggagatgccccccacactggaggcaagccaggcggctttgatgtgaaggccctgcgggccttccgggtgctgcggcccctgcggctggtgtctggagtgcccagcctgcacatcgtgctgaacagcatcatgaaggccctggtgcccctgctgcacatcgccctgctggtgctgtttgtgatcatcatctatgccatcatcggcctggagctgttcctgggccgcatgcacaagacctgctacttcctgggcagtgacatggaggccgaggaggaccccagcccctgtgccagcagcggcagcggccgggcctgcaccctgaaccagacagaatgtcggggccgctggccaggccccaacggcggcatcaccaactttgacaacttcttctttgccatgctgactgtgttccagtgtgtgaccatggagggctggacagatgtgctgtactggatgcaggatgccatgggctatgagctgccctgggtgtactttgtgtccctggtgatcttcggcagcttctttgtgctgaacctggtgctgggcgtgctgtctggagagttcagcaaggagcgggagaaggccaaggcccggggggacttccagaagcagcgggagaagcagcagatggaggaggacctgcggggctacctggactggatcacccaggccgaggagctggacatggaggaccccagcgcagatgacaacctgggctccatggccgaggagggccgggccggccaccggccccagctggccgagctgaccaacagaagaagaggccgcctgcgctggttcagccacagcaccaggagcacccacagcaccagcagccacgccagcctgcctgccagtgacaccggctccatgacagagacccagggagatgaagatgaggaggagggcgccctggccagctgcacccgctgcctgaacaagatcatgaagaccagggtgtgccggcggctgcggcgggccaacagagtgctgcgggcccgctgccggcgggctgtgaagagcaatgcctgctactgggccgtgctgctgctggtgttcctgaacaccctgaccatcgccagcgagcaccacggccagcctgtgtggctgacccagatccaggagtatgccaacaaggtgctgctgtgcctcttcaccgtggagatgctgctgaagctgtatggcctgggccccagcgcctacgtgagcagcttcttcaacagatttgactgctttgtggtgtgtggcggcatcctggagaccaccctggtggaggtgggcgccatgcagcccctgggcatctctgtgctgcgctgtgtgcggctgctgcgcatcttcaaggtgaccaggcactgggccagcctgagcaacctggtggccagcctgctgaacagcatgaagagcatcgccagcctgctgctgctgctcttcctgttcatcatcatcttcagcctgctgggcatgcagctgtttggaggcaagttcaactttgaccagacccacaccaagaggagcacctttgacaccttcccccaggccctgctgaccgtcttccagatcctgaccggggaggactggaatgtggtgatgtatgatggcatcatggcctatggaggccccttcttccctggcatgctggtgtgcatctacttcatcatcctcttcatctgtggcaactacatcctgctgaatgtgttcctggccatcgctgtggacaacctggccagcggagatgctggaacagccaaggacaagggcggggagaagagcaatgagaaggacctgccccaggagaatgaaggcctggtgcctggggtggagaaggaggaggaggagggcgcccggcgggagggcgctgacatggaggaggaggaggaggaggaggaggaggaggaggaggaggaggaggaggagggcgctgggggcgtggagctgctgcaggaggtggtgcccaaggagaaggtggtgcccatccctgagggcagcgccttcttctgcctgagccagaccaaccccctgaggaagggctgccacaccctcatccaccaccacgtgttcaccaacctgatcctggtgttcatcatcctgagctctgtgtccctggccgctgaggaccccatccgggcccacagcttcaggaaccacatcctgggctactttgattatgccttcaccagcatcttcaccgtggagatcctgctgaagatgacagtgtttggagccttcctgcaccggggcagcttctgccgctcctggttcaacatgctggacctgctggtggtgtctgtgtccctcatcagctttggcatccacagcagcgccatctctgtggtgaagatcctgcgggtgctgcgggtgctgcggcccctgcgggccatcaacagagccaagggcctgaagcacgtggtgcagtgtgtgtttgtggccatccgcaccatcggcaacatcatgattgtgaccaccctgctgcagttcatgtttgcctgcatcggcgtgcagctgttcaagggcaagttctacacctgcacagatgaggccaagcacaccccccaggagtgcaagggcagcttcctggtgtacccagatggagatgtgtcccggcccctggtgcgggagcggctgtgggtgaacagcgacttcaactttgacaacgtgctgagcgccatgatggccctcttcaccgtgtccacctttgagggctggccagccctgctgtacaaggccattgatgcctatgcagaggaccacggccccatctacaactacagagtggagatctctgtgttcttcatcgtgtacatcatcatcatcgccttcttcatgatgaacatctttgtgggcttcgtcatcatcaccttccgggcccagggcgagcaggagtaccagaactgtgagctggacaagaaccagaggcagtgtgtggagtatgccctgaaggcccagcccctgcggcgctacatccccaagaacccccaccagtacagagtgtgggccaccgtgaacagcgctgcctttgagtacctgatgttcctgctgatcctgctgaacacagtggccctggccatgcagcactatgagcagacagcccccttcaactatgccatggacatcctgaacatggtgttcaccggcctcttcaccatcgagatggtgctgaagatcatcgccttcaagcccaagcactacttcacagatgcctggaacacctttgatgccctgattgtggtgggcagcatcgtggacattgctgtgacagaggtgaacaatggaggccacctgggggagagcagcgaggacagcagccgcatcagcatcaccttcttccgcctcttccgggtgatgaggctggtgaagctgctgagcaagggggagggcatccgcaccctgctgtggaccttcatcaagagcttccaggccctgccctacgtggccctgctgattgccatgatcttcttcatctatgctgtgattggcatgcagatgtttgggaaggtggccctgcaggacggcacccagatcaacagaaacaacaacttccagaccttcccccaggccgtgctgctgctcttccgctgtgccaccggggaggcctggcaggagatcatgctggccagcctgcccggcaacagatgtgaccctgagagtgactttggacctggagaggagttcacctgtggcagcaactttgccatcgcctacttcatctccttcttcatgctgtgtgccttcctgatcatcaacctgtttgtggccgtcatcatggacaactttgactacctgacccgggactggagcatcctgggcccccaccacctggatgagttcaagaggatctggagcgaatatgaccccggggccaagggccgcatcaagcacctggatgtggtggccctgctgcggcgcatccagccccccctgggctttgggaagctgtgcccccaccgggtggcctgcaagaggctggtggccatgaacatgcccctgaacagtgatggcaccgtgaccttcaatgccaccctgtttgccctggtgaggaccagcctgaagatcaagacagagggcaacctggagcaggccaaccaggagctgagaattgtcatcaagaagatctggaagaggatgaagcagaagctgctggatgaggtgatccccccaccagatgaggaggaggtgacagtgggcaagttctacgccaccttcctgatccaggactacttcaggaagttcagaagaaggaaggagaagggcctgctgggcaatgatgctgcccccagcaccagcagcgccctgcaggccggcctgcggagcctgcaggacctgggccctgagatgaggcaggccctgacctgtgacacagaggaggaggaggaggagggccaggagggcgtggaggaggaggatgagaaggacctggagaccaacaaggccaccatggtgtcccagcccagcgcccggcggggcagcggcatctctgtgtccctgcctgtgggggaccggctgcctgacagcctgagctttggccccagtgatgatgaccggggcacccccaccagcagccagcccagcgtgccccaggccggcagcaacacccaccggcggggcagcggggccctgatcttcaccatccctgaggagggcaacagccagcccaagggcaccaagggccagaacaagcaggatgaagatgaggaggtgcctgaccggctgagctacctggatgagcaggccggcaccccaccctgcagcgtgctgctgcccccccaccgggcccagcgctacatggatggccacctggtgccccggcggcggctgctgccccccaccccagctggcaggaagcccagcttcaccatccagtgcctgcagaggcagggcagctgtgaggacctgcccatccctggcacctaccaccggggcaggaacagcggccccaacagagcccagggctcctgggccaccccaccccagaggggccgcctgctgtatgcccccctgctgctggtggaggagggcgctgctggggagggctacctgggccgcagcagcggccccctgcggaccttcacctgcctgcacgtgcccggcacccacagcgaccccagccacggcaagaggggcagcgctgacagcctggtggaggccgtgctgatcagcgagggcctgggcctgtttgcccgggaccccaggtttgtggccctggccaagcaggagattgctgatgcctgccgcctgaccctggatgagatggacaatgctgccagtgacctgctggcccagggcaccagcagcctgtacagtgatgaggagagcatcctgagcagatttgatgaggaggacctgggagatgagatggcctgtgtgcacgccctgtag

SEQ ID NO: 145842 - DNA, 5934 bp, Artificial Sequence
  Description of Artificial Sequence: Synthetic coding sequence
atgtctgagagcgagggcggcaaggacaccaccccagagcccagccctgccaacggggccggccctggccctgagtggggcctgtgccccggccccccagctgtggagggggagagcagcggggccagcggcctgggcacccccaagagaagaaaccagcacagcaagcacaagacagtggccgtggccagcgcccagaggagcccccgggccctcttctgcctgaccctggccaaccccctgcggcgcagctgcatcagcatcgtggagtggaagccctttgacatcctgatcctgctgaccatctttgccaactgtgtggccctgggcgtgtacatccccttcccagaagatgacagcaacacagccaaccacaacctggagcaggtggagtatgtgttcctggtgatcttcaccgtggagaccgtgctgaagatcgtggcctacggcctggtgctgcaccccagcgcctacatcagaaatggctggaacctgctggacttcatcatcgtggtggtgggcctcttctctgtgctgctggagcagggccctggccggcctggagatgccccccacactggaggcaagccaggcggctttgatgtgaaggccctgcgggccttccgggtgctgcggcccctgcggctggtgtctggagtgcccagcctgcacatcgtgctgaacagcatcatgaaggccctggtgcccctgctgcacatcgccctgctggtgctcttcgtcatcatcatctatgccatcatcggcctggagctgttcctgggccgcatgcacaagacctgctacttcctgggcagtgacatggaggccgaggaggaccccagcccctgtgccagcagcggcagcggccgggcctgcaccctgaaccagacagagtgccggggccgctggccaggccccaatggaggcatcaccaactttgacaacttcttctttgccatgctgaccgtcttccagtgtgtgaccatggagggctggacagatgtgctgtactggatgcaggatgccatgggctatgagctgccctgggtgtactttgtgtccctggtgatcttcggcagcttctttgtgctgaacctggtgctgggcgtgctgagcggggagttcagcaaggagcgggagaaggccaaggcccggggggacttccagaagcagcgggagaagcagcagatggaggaggacctgcggggctacctggactggatcacccaggccgaggagctggacatggaggaccccagcgcagatgacaacctgggctccatggccgaggagggccgggccggccaccggccccagctggccgagctgaccaacagaagaagaggccgcctgcgctggttcagccacagcaccaggagcacccacagcaccagcagccacgccagcctgcctgccagtgacaccggctccatgacagagacccagggagatgaagatgaggaggagggcgccctggccagctgcacccgctgcctgaacaagatcatgaagaccagggtgtgccggcggctgcggcgggccaacagagtgctgcgggcccgctgcagaagagctgtgaagagcaatgcctgctactgggccgtgctgctgctggtgttcctgaacaccctgaccatcgccagcgagcaccacggccagcctgtgtggctgacccagatccaggagtatgccaacaaggtgctgctgtgcctcttcaccgtggagatgctgctgaagctgtatggcctgggccccagcgcctacgtgtcctccttcttcaacagatttgactgctttgtggtgtgtggcggcatcctggagaccaccctggtggaggtgggcgccatgcagcccctgggcatctctgtgctgcgctgtgtgcggctgctgcgcatcttcaaggtgaccaggcactgggccagcctgagcaacctggtggccagcctgctgaacagcatgaagagcatcgccagcctgctgctgctgctcttcctgttcatcatcatcttcagcctgctgggcatgcagctgtttggaggcaagttcaactttgaccagacccacaccaagaggagcacctttgacaccttcccccaggccctgctgactgtgttccagatcctgactggagaggactggaatgtggtgatgtatgatggcatcatggcctacggcggccccttcttccctggcatgctggtgtgcatctacttcatcatcctcttcatctgtggcaactacatcctgctgaatgtgttcctggccatcgctgtggacaacctggccagcggagatgctggaacagccaaggacaagggcggggagaagagcaatgagaaggacctgccccaggagaatgaaggcctggtgcctggggtggagaaggaggaggaggagggcgcccggcgggagggcgctgacatggaggaggaggaggaggaggaggaggaggaggaggaggaggaggaggaggagggcgctgggggcgtggagctgctgcaggaggtggtgcccaaggagaaggtggtgcccatccctgagggcagcgccttcttctgcctgagccagaccaaccccctgaggaagggctgccacaccctcatccaccaccacgtgttcaccaacctgatcctggtgttcatcatcctgagctctgtgtccctggccgctgaggaccccatccgggcccacagcttcaggaaccacatcctgggctactttgattatgccttcaccagcatcttcaccgtggagatcctgctgaagatgacagtgtttggagccttcctgcaccggggcagcttctgccgctcctggttcaacatgctggacctgctggtggtgtctgtgtccctcatcagctttggcatccacagcagcgccatctctgtggtgaagatcctgcgggtgctgcgggtgctgcggcccctgcgggccatcaacagagccaagggcctgaagcacgtggtgcagtgtgtgtttgtggccatccgcaccatcggcaacatcatgattgtgaccaccctgctgcagttcatgtttgcctgcattggagtgcagctgttcaagggcaagttctacacctgcacagatgaggccaagcacaccccccaggagtgcaagggcagcttcctggtgtacccagatggagatgtgtcccggcccctggtgcgggagcggctgtgggtgaacagcgacttcaactttgacaacgtgctgagcgccatgatggccctcttcaccgtgtccacctttgagggctggccagccctgctgtacaaggccattgatgcctatgcagaagatcatggccccatctacaactacagagtggagatcagcgtcttcttcatcgtgtacatcatcatcatcgccttcttcatgatgaacatctttgtgggctttgtgatcatcaccttccgggcccagggcgagcaggagtaccagaactgtgagctggacaagaaccagaggcagtgtgtggagtatgccctgaaggcccagcccctgcggcgctacatccccaagaacccccaccagtacagagtgtgggccaccgtgaacagcgctgcctttgagtacctgatgttcctgctgatcctgctgaacacagtggccctggccatgcagcactatgagcagacagcccccttcaactatgccatggacatcctgaacatggtgttcaccggcctcttcaccatcgagatggtgctgaagatcatcgccttcaagcccaagcactacttcacagatgcctggaacacctttgatgccctgattgtggtgggcagcatcgtggacattgctgtgacagaggtgaacaacggcggccacctgggggagagcagcgaggacagcagccgcatcagcatcaccttcttccgcctcttccgggtgatgaggctggtgaagctgctgagcaaaggagagggcatccgcaccctgctgtggaccttcatcaagagcttccaggccctgccctacgtggccctgctgattgccatgatcttcttcatctatgctgtgattggcatgcagatgtttgggaaggtggccctgcaggacggcacccagatcaacagaaacaacaacttccagaccttcccccaggccgtgctgctgctcttccgctgtgccactggagaggcctggcaggagatcatgctggccagcctgcccggcaacagatgtgaccctgagagtgactttggacctggagaggagttcacctgtggcagcaactttgccatcgcctacttcatctccttcttcatgctgtgtgccttcctgatcatcaacctgtttgtggccgtcatcatggacaactttgactacctgacccgggactggagcatcctgggcccccaccacctggatgagttcaagaggatctggagcgaatatgaccccggggccaagggccgcatcaagcacctggatgtggtggccctgctgcggcgcatccagccccccctgggctttgggaagctgtgcccccaccgggtggcctgcaagaggctggtggccatgaacatgcccctgaacagtgatggcaccgtgaccttcaatgccaccctgtttgccctggtgaggaccagcctgaagatcaagacagagggcaacctggagcaggccaaccaggagctgcgcatcgtcatcaagaagatctggaagaggatgaagcagaagctgctggatgaagtcatccccccaccagatgaggaggaggtgacagtgggcaagttctacgccaccttcctgatccaggactacttcaggaagttcagaagaaggaaggagaagggcctgctgggcaatgatgctgcccccagcaccagcagcgccctgcaggccggcctgcggagcctgcaggacctgggccctgagatgaggcaggccctgacctgtgacacagaggaggaggaggaggagggccaggagggcgtggaggaggaggatgagaaggacctggagaccaacaaggccaccatggtgtcccagcccagcgcccggcggggcagcggcatctctgtgtccctgcctgtgggggaccggctgcctgacagcctgagctttggccccagtgatgatgaccggggcacccccaccagcagccagcccagcgtgccccaggccggcagcaacacccacagaagaggcagcggggccctgatcttcaccatccctgaggagggcaacagccagcccaagggcaccaagggccagaacaagcaggatgaagatgaggaggtgcctgaccggctgagctacctggatgagcaggccggcaccccaccctgcagcgtgctgctgcccccccaccgggcccagcgctacatggatggccacctggtgccccggcggcggctgctgccccccaccccagctggcaggaagcccagcttcaccatccagtgcctgcagaggcagggcagctgtgaggacctgcccatccctggcacctaccaccggggcagaaattctggccccaacagagcccagggctcctgggccaccccaccccagaggggccgcctgctgtatgcccccctgctgctggtggaggagggcgccgccggggagggctacctgggccgcagcagcggccccctgcggaccttcacctgcctgcacgtgcccggcacccacagcgaccccagccacggcaagaggggcagcgctgacagcctggtggaggccgtgctgatcagcgagggcctgggcctgtttgcccgggaccccaggtttgtggccctggccaagcaggagattgctgatgcctgccgcctgaccctggatgagatggacaatgctgccagtgacctgctggcccagggcaccagcagcctgtacagtgatgaggagagcatcctgagcagatttgatgaggaggacctgggagatgagatggcctgtgtgcacgccctgtag

SEQ ID NO: 145843 - DNA, 5622 bp, Artificial Sequence
  Description of Artificial Sequence: Synthetic coding sequence
atggagcccagcagcccccaggatgagggcctgaggaagaagcagcccaagaagcctgtgcctgagatcctgcccaggcctccccgggccctcttctgcctgaccctggagaaccccctgaggaaggcctgcatcagcatcgtggagtggaagccctttgagaccatcatcctgctgaccatctttgccaactgtgtggccctggccgtgtacctgcccatgccagaagatgacaacaacagcctgaacctgggcctggagaagctggagtacttcttcctgattgtgttcagcattgaagctgccatgaagatcatcgcctacggcttcctgttccaccaggatgcctacctgcggagcggctggaatgtgctggacttcaccatcgtgttcctgggcgtcttcaccgtcatcctggagcaggtgaatgtcatccagagccacacagcccccatgagcagcaaaggagctggcctggatgtgaaggccctgcgggccttccgggtgctgcggcccctgcggctggtgtctggagtgcccagcctgcaggtggtgctgaacagcatcttcaaggccatgctgcccctcttccacatcgccctgctggtgctcttcatggtgatcatctatgccatcatcggcctggagctgttcaagggcaagatgcacaagacctgctacttcatcggcacagacatcgtggccaccgtggagaatgaggagcccagcccctgtgccaggacaggcagcggccgccgctgcaccatcaatggaagtgagtgccggggcggctggccaggccccaaccacggcatcacccactttgacaactttggcttctccatgctgactgtgtaccagtgcatcaccatggagggctggacagatgtgctgtactgggtgaatgatgccatcggaaatgagtggccctggatctactttgtgaccctcatcctgctgggcagcttcttcatcctgaacctggtgctgggcgtgctgagcggggagttcaccaaggagcgggagaaggccaagagccggggcaccttccagaagctgcgggagaagcagcagctggatgaggacctgcggggctacatgtcctggatcacccagggcgaggtgatggatgtggaggacttccgggagggcaagctgagcctggatgaaggaggcagtgacacagagagcctgtatgaaattgctggcctgaacaagatcatccagttcatccgccactggaggcagtggaaccgcatcttccgctggaagtgccacgacatcgtgaagagcaaggtgttctactggctggtgatcctgattgtggccctgaacaccctgagcatcgccagcgagcaccacaaccagcccctgtggctgacccggctgcaggacatcgccaacagagtgctgctgagcctcttcaccacagagatgctgatgaagatgtatggcctgggcctgcggcagtacttcatgagcatcttcaacagatttgactgctttgtggtgtgcagcggcatcctggagatcctgctggtggagagcggggccatgacccccctgggcatctctgtgctgcgctgcatccggctgctgcgcatcttcaagatcaccaagtactggaccagcctgagcaacctggtggccagcctgctgaacagcatccgcagcatcgccagcctgctgctgctgctcttcctgttcatcgtcatctttgccctgctgggcatgcagctgtttggaggccgctatgactttgaggacacagaggtgagaagaagcaactttgacaacttcccccaggccctgatcagcgtcttccaggtgctgaccggggaggactggacctccatgatgtacaacggcatcatggcctatggaggccccagctacccaggcatgctggtgtgcatctacttcatcatcctgtttgtgtgtggcaactacatcctgctgaatgtgttcctggccatcgctgtggacaacctggccgaggccgagagcctgaccagcgcccagaaggccaaggccgaggagaagaagaggaggaagatgagcaagggcctgcctgacaagtctgaggaggagaagagcaccatggccaagaagctggagcagaagcccaagggggagggcatccccaccacagccaagctgaagattgatgaatttgagagcaatgtgaatgaggtgaaggacccctaccccagcgctgacttccctggagatgatgaagaagatgagcctgagatccccctgagcccccggccccggcccctggccgagctgcagctgaaggagaaggctgtgcccatccctgaggccagcagcttcttcatcttcagccccaccaacaagatccgggtgctgtgccacagaattgtgaatgccacctggttcaccaacttcatcctgctcttcatcctgctgagcagcgctgccctggccgctgaggaccccatccgggctgacagcatgaggaaccagatcctgaagcactttgatattggcttcacctctgtgttcaccgtggagatcgtgctgaagatgaccacctacggggccttcctgcacaagggcagcttctgcaggaactacttcaacatgctggacctgctggtggtggccgtgtccctcatctccatgggcctggagagcagcgccatctctgtggtgaagatcctgcgggtgctgcgggtgctgcggcccctgcgggccatcaacagagccaagggcctgaagcacgtggtgcagtgcatgtttgtggccatcagcaccatcggcaacatcgtgctggtgaccaccctgctgcagttcatgtttgcctgcattggagtgcagctgttcaagggcaagttcttccgctgcacagacctgagcaagatgacagaggaggagtgccggggctactactacgtgtacaaggatggagaccccatgcagatcgagctgcggcaccgggagtgggtgcacagcgacttccactttgacaacgtgctgagcgccatgatgagcctcttcaccgtgtccacctttgagggctggccccagctgctgtacaaggccatcgacagcaatgcagaagatgtgggccccatctacaacaacagagtggagatggccatcttcttcatcatctacatcatcctgattgccttcttcatgatgaacatctttgtgggctttgtgattgtgaccttccaggagcagggcgagacagagtacaagaactgtgagctggacaagaaccagaggcagtgtgtgcagtatgccctgaaggcccggcccctgcgctgctacatccccaagaacccctaccagtaccaggtgtggtacatcgtgaccagcagctactttgagtacctgatgtttgccctgatcatgctgaacaccatctgcctgggcatgcagcactacaaccagagcgagcagatgaaccacatcagtgacatcctgaatgtggccttcaccatcatcttcaccctggagatgatcctgaagctgatggccttcaaggcccggggctactttggagacccctggaatgtgtttgacttcctgattgtgattggcagcatcattgatgtgatcctgtctgaaattgacaccttcctggccagcagcggcggcctgtactgcctgggcggcggctgtggaaatgtggaccctgatgaaagtgcccgcatcagcagcgccttcttccgcctcttccgggtgatgaggctcatcaagctgctgagcagagctgagggcgtgaggaccctgctgtggaccttcatcaagagcttccaggccctgccctacgtggccctgctgattgtgatgctgttcttcatctatgctgtgattggcatgcagatgtttgggaagatcgccctggtggatggcacccagatcaacagaaacaacaacttccagaccttcccccaggccgtgctgctgctcttccgctgtgccactggagaggcctggcaggagatcctgctggcctgcagctatggcaagctgtgtgaccctgagagtgactatgcccctggagaggagtacacctgtggcaccaactttgcctactactacttcatctccttctacatgctgtgtgccttcctggtgatcaacctgtttgtggccgtcatcatggacaactttgactacctgacccgggactggagcatcctgggcccccaccacctggatgagttcaaggccatctgggccgagtatgaccctgaggccaagggccgcatcaagcacctggatgtggtgaccctgctgcggcgcatccagccccccctgggctttgggaagttctgcccccaccgggtggcctgcaagaggctggtgggcatgaacatgcccctgaacagtgatggcaccgtgaccttcaatgccaccctgtttgccctggtgaggacagccctgaagatcaagacagagggcaactttgagcaggccaatgaggagctgcgggccatcatcaagaagatctggaagaggacctccatgaagctgctggaccaggtgattcctcccatcggagatgatgaggtgacagtgggcaagttctacgccaccttcctgatccaggagcacttcaggaagttcatgaagaggcaggaggagtactacggctaccggcccaagaaggacatcgtgcagatccaggccggcctgcggaccatcgaggaggaggccgcccctgagatctgcaggacagtgtctggggacctggccgctgaggaggagctggagcgggccatggtggaggccgccatggaggagggcatcttcagaagaactggaggcctgtttggccaggtggacaacttcctggagaggaccaacagcctgccccctgtgatggccaaccagaggcccctgcagtttgctgagattgagatggaggagatggagagccctgtgttcctggaggacttcccccaggaccccaggaccaaccccctggcccgggccaacaccaacaatgccaatgccaacgtggcctacggcaacagcaaccacagcaacagccacgtgttcagctctgtgcactatgaaagagagttccctgaggagacagagaccccagccacccggggccgggccctgggccagccctgccgggtgctgggcccccacagcaagccctgtgtggagatgctgaagggcctgctgacccagagggccatgccccggggccaggcccccccagccccctgccagtgcccccgggtggagagctccatgcctgaggacaggaagagcagcaccccaggcagcctgcacgaggagaccccccacagccgcagcacccgggagaacaccagccgctgcagcgccccagccacagccctgctgatccagaaggccctggtgcggggcggcctgggcaccctggccgcagatgccaacttcatcatggccaccggccaggccctggctgatgcctgccagatggagcctgaggaggtggagatcatggccacagagctgctgaagggccgggaggcccctgagggcatggccagcagcctgggctgcctgaacctgggcagcagcctgggcagcctggaccagcaccagggcagccaggagaccctcatccccccccggctgtag

SEQ ID NO: 145844 - DNA, 5565 bp, Artificial Sequence
  Description of Artificial Sequence: Synthetic coding sequence
atggagcccagcagcccccaggatgagggcctgaggaagaagcagcccaagaagcctgtgcctgagatcctgcccaggcctccccgggccctcttctgcctgaccctggagaaccccctgaggaaggcctgcatcagcatcgtggagtggaagccctttgagaccatcatcctgctgaccatctttgccaactgtgtggccctggccgtgtacctgcccatgccagaagatgacaacaacagcctgaacctgggcctggagaagctggagtacttcttcctgattgtgttcagcattgaagctgccatgaagatcatcgcctacggcttcctgttccaccaggatgcctacctgcggagcggctggaatgtgctggacttcaccatcgtgttcctgggcgtcttcaccgtcatcctggagcaggtgaatgtcatccagagccacacagcccccatgagcagcaaaggagctggcctggatgtgaaggccctgcgggccttccgggtgctgcggcccctgcggctggtgtctggagtgcccagcctgcaggtggtgctgaacagcatcttcaaggccatgctgcccctcttccacatcgccctgctggtgctcttcatggtgatcatctatgccatcatcggcctggagctgttcaagggcaagatgcacaagacctgctacttcatcggcacagacatcgtggccaccgtggagaatgaggagcccagcccctgtgccaggacaggcagcggccgccgctgcaccatcaatggaagtgagtgccggggcggctggccaggccccaaccacggcatcacccactttgacaactttggcttctccatgctgactgtgtaccagtgcatcaccatggagggctggacagatgtgctgtactgggtgaatgatgccatcggaaatgagtggccctggatctactttgtgaccctcatcctgctgggcagcttcttcatcctgaacctggtgctgggcgtgctgagcggggagttcaccaaggagcgggagaaggccaagagccggggcaccttccagaagctgcgggagaagcagcagctggatgaggacctgcggggctacatgtcctggatcacccagggcgaggtgatggatgtggaggacttccgggagggcaagctgagcctggatgaaggaggcagtgacacagagagcctgtatgaaattgctggcctgaacaagatcatccagttcatccgccactggaggcagtggaaccgcatcttccgctggaagtgccacgacatcgtgaagagcaaggtgttctactggctggtgatcctgattgtggccctgaacaccctgagcatcgccagcgagcaccacaaccagcccctgtggctgacccggctgcaggacatcgccaacagagtgctgctgagcctcttcaccacagagatgctgatgaagatgtatggcctgggcctgcggcagtacttcatgagcatcttcaacagatttgactgctttgtggtgtgcagcggcatcctggagatcctgctggtggagagcggggccatgacccccctgggcatctctgtgctgcgctgcatccggctgctgcgcatcttcaagatcaccaagtactggaccagcctgagcaacctggtggccagcctgctgaacagcatccgcagcatcgccagcctgctgctgctgctcttcctgttcatcgtcatctttgccctgctgggcatgcagctgtttggaggccgctatgactttgaggacacagaggtgagaagaagcaactttgacaacttcccccaggccctgatcagcgtcttccaggtgctgaccggggaggactggacctccatgatgtacaacggcatcatggcctatggaggccccagctacccaggcatgctggtgtgcatctacttcatcatcctgtttgtgtgtggcaactacatcctgctgaatgtgttcctggccatcgctgtggacaacctggccgaggccgagagcctgaccagcgcccagaaggccaaggccgaggagaagaagaggaggaagatgagcaagggcctgcctgacaagtctgaggaggagaagagcaccatggccaagaagctggagcagaagcccaagggggagggcatccccaccacagccaagctgaagattgatgaatttgagagcaatgtgaatgaggtgaaggacccctaccccagcgctgacttccctggagatgatgaagaagatgagcctgagatccccctgagcccccggccccggcccctggccgagctgcagctgaaggagaaggctgtgcccatccctgaggccagcagcttcttcatcttcagccccaccaacaagatccgggtgctgtgccacagaattgtgaatgccacctggttcaccaacttcatcctgctcttcatcctgctgagcagcgctgccctggccgctgaggaccccatccgggctgacagcatgaggaaccagatcctgaagcactttgatattggcttcacctctgtgttcaccgtggagatcgtgctgaagatgaccacctacggggccttcctgcacaagggcagcttctgcaggaactacttcaacatgctggacctgctggtggtggccgtgtccctcatctccatgggcctggagagcagcgccatctctgtggtgaagatcctgcgggtgctgcgggtgctgcggcccctgcgggccatcaacagagccaagggcctgaagcacgtggtgcagtgcatgtttgtggccatcagcaccatcggcaacatcgtgctggtgaccaccctgctgcagttcatgtttgcctgcattggagtgcagctgttcaagggcaagttcttccgctgcacagacctgagcaagatgacagaggaggagtgccggggctactactacgtgtacaaggatggagaccccatgcagatcgagctgcggcaccgggagtgggtgcacagcgacttccactttgacaacgtgctgagcgccatgatgagcctcttcaccgtgtccacctttgagggctggccccagctgctgtacaaggccatcgacagcaatgcagaagatgtgggccccatctacaacaacagagtggagatggccatcttcttcatcatctacatcatcctgattgccttcttcatgatgaacatctttgtgggctttgtgattgtgaccttccaggagcagggcgagacagagtacaagaactgtgagctggacaagaaccagaggcagtgtgtgcagtatgccctgaaggcccggcccctgcgctgctacatccccaagaacccctaccagtaccaggtgtggtacatcgtgaccagcagctactttgagtacctgatgtttgccctgatcatgctgaacaccatctgcctgggcatgcagcactacaaccagagcgagcagatgaaccacatcagtgacatcctgaatgtggccttcaccatcatcttcaccctggagatgatcctgaagctgatggccttcaaggcccggggctactttggagacccctggaatgtgtttgacttcctgattgtgattggcagcatcattgatgtgatcctgtctgaaattgatgatcctgatgagagcgcccgcatcagcagcgccttcttccgcctcttccgggtgatgaggctcatcaagctgctgagcagagctgagggcgtgaggaccctgctgtggaccttcatcaagagcttccaggccctgccctacgtggccctgctgattgtgatgctgttcttcatctatgctgtgattggcatgcagatgtttgggaagatcgccctggtggatggcacccagatcaacagaaacaacaacttccagaccttcccccaggccgtgctgctgctcttccgctgtgccaccggggaggcctggcaggagatcctgctggcctgcagctatggcaagctgtgtgaccctgagagtgactatgcccctggagaggagtacacctgtggcaccaactttgcctactactacttcatctccttctacatgctgtgtgccttcctggtgatcaacctgtttgtggccgtcatcatggacaactttgactacctgacccgggactggagcatcctgggcccccaccacctggatgagttcaaggccatctgggccgagtatgaccctgaggccaagggccgcatcaagcacctggatgtggtgaccctgctgcggcgcatccagccccccctgggctttgggaagttctgcccccaccgggtggcctgcaagaggctggtgggcatgaacatgcccctgaacagtgatggcaccgtgaccttcaatgccaccctgtttgccctggtgaggacagccctgaagatcaagacagagggcaactttgagcaggccaatgaggagctgcgggccatcatcaagaagatctggaagaggacctccatgaagctgctggaccaggtgatcccccccatcggagatgatgaggtgacagtgggcaagttctacgccaccttcctgatccaggagcacttcaggaagttcatgaagaggcaggaggagtactacggctaccggcccaagaaggacatcgtgcagatccaggccggcctgcggaccatcgaggaggaggccgcccctgagatctgcaggacagtgtctggggacctggccgctgaggaggagctggagcgggccatggtggaggccgccatggaggagggcatcttccggaggactggaggcctgtttggccaggtggacaacttcctggagaggaccaacagcctgccccctgtgatggccaaccagaggcccctgcagtttgctgagattgagatggaggagatggagagccctgtgttcctggaggacttcccccaggaccccaggaccaaccccctggcccgggccaacaccaacaatgccaatgccaacgtggcctacggcaacagcaaccacagcaacagccacgtgttcagctctgtgcactatgagcgggagttccctgaggagacagagaccccagccacccggggccgggccctgggccagccctgccgggtgctgggcccccacagcaagccctgtgtggagatgctgaagggcctgctgacccagagggccatgccccggggccaggcccccccagccccctgccagtgcccccgggtggagagctccatgcctgaggacaggaagagcagcaccccaggcagcctgcacgaggagaccccccacagccgcagcacccgggagaacaccagccgctgcagcgccccagccacagccctgctgatccagaaggccctggtgcggggcggcctgggcaccctggccgcagatgccaacttcatcatggccaccggccaggccctggctgatgcctgccagatggagcctgaggaggtggagatcatggccacagagctgctgaagggccgggaggcccctgagggcatggccagcagcctgggctgcctgaacctgggcagcagcctgggcagcctggaccagcaccagggcagccaggagaccctcatccccccccggctgtag

SEQ ID NO: 145845 - DNA, 4602 bp, Artificial Sequence
  Description of Artificial Sequence: Synthetic coding sequence
atgaagacccacctggaccggcccctggtggtggagctgggcagagatggagcccggggccctgtgggcggcaaggcccggcctgaggccgctgaggcccctgagggcgtggaccccccaagaagacaccaccgccaccgggacaaggacaagaccccagctgctggggaccaggacagagctgaggcccccaaggccgagagcggggagcccggggcccgggaggagcggccccggccccacaggagccacagcaaggaggccgccggccccccagaggcccggtctgagcggggccggggccctggccctgagggcggccgccgccaccaccggcggggcagccctgaggaggccgctgagcgggagcccaggaggcaccgggcccaccgccaccaggaccccagcaaagaatgtgccggggccaagggggagcggcgggcccggcaccggggcggcccccgggccggcccccgggaggccgagagcggggaggagcccgcccggcggcaccgggcccggcacaaggcccagcctgcccatgaagctgtggagaaggagaccacagagaaggaggccacagagaaggaggccgagatcgtggaggccgacaaggagaaggagctgaggaaccaccagccccgggagccccactgtgacctggagaccagcggcaccgtgacagtgggccccatgcacaccctgcccagcacctgcctgcagaaggtggaggagcagccagaagatgctgacaaccagagaaatgtgaccaggatgggcagccagcccccagaccccaacaccatcgtgcacatccctgtgatgctgaccggccccctgggggaggccaccgtggtgcccagcggaaatgtggacctggagagccaggccgagggcaagaaggaggtggaggctgatgatgtgatgaggagcggcccccggcccatcgtgccctacagctccatgttctgcctgagccccaccaacctgctgcggcgcttctgccactacatcgtgaccatgagatactttgaggtggtgatcctggtggtgattgccctgagcagcatcgccctggccgctgaggaccctgtgaggacagacagccccagaaataatgccctgaagtacctggactacatcttcaccggggtcttcacctttgagatggtgatcaagatgattgacctgggcctgctgctgcaccctggggcctacttccgggacctgtggaacatcctggacttcatcgtggtgtctggggccctggtggcctttgccttcagcagctttgtgggcggcagcaagggcaaggacatcaacaccatcaagagcctgcgggtgctgcgggtgctgcggcccctgaagaccatcaagaggctgcccaagctgaaggctgtgtttgactgtgtggtgaacagcctgaagaatgtgctgaacatcctgattgtgtacatgctgttcatgttcatctttgctgtgattgctgtgcagctgttcaagggcaagttcttctactgcacagatgagagcaaggagctggagcgggactgccggggccagtacctggactatgagaaggaggaggtggaggcccagccccggcagtggaagaagtatgacttccactatgacaacgtgctgtgggccctgctgaccctcttcaccgtgtccactggagagggctggcccatggtgctgaagcacagcgtggatgccacctatgaggagcagggccccagccctggctacaggatggagctgagcatcttctacgtggtgtactttgtggtgttccccttcttctttgtgaacatctttgtggccctgatcatcatcaccttccaggagcagggcgacaaggtgatgtctgaatgttccctggagaagaatgaaagagcctgcatcgactttgccatcagcgccaagcccctgacccgctacatgccccagaaccggcagagcttccagtacaagacctggacctttgtggtgtccccaccatttgagtacttcatcatggccatgattgccctgaacacagtggtgctgatgatgaagttctatgatgccccctatgaatatgagctgatgctgaagtgcctgaacatcgtgttcacctccatgttctccatggagtgtgtgctgaagatcatcgcctttggagtgctgaactacttcagagatgcctggaatgtgtttgattttgtgacagtgctgggcagcatcacagacatcctggtgacagaaattgccaacaacttcatcaacctgtccttcctgcggctcttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaacatcgccctggatgatgacaccagcatcaacagacacaacaacttccgcaccttcctgcaggccctgatgctgctcttccgcagcgccactggagaggcctggcatgagatcatgctgagctgcctgagcaaccaggcctgtgatgagcaggccaatgccacagaatgtggcagtgactttgcctacttctactttgtgtccttcatcttcctgtgcagcttcctgatgctgaacctgtttgtggccgtcatcatggacaactttgagtacctgacccgggacagcagcatcctgggcccccaccacctggatgagttcatccgggtgtgggccgagtatgaccctgctgcctgtggccgcatctcctacaatgacatgtttgagatgctgaagcacatgagcccccccctgggcctgggcaagaagtgcccagcccgggtggcctacaagaggctggtgaggatgaacatgcccatcagcaatgaagacatgacagtgcacttcaccagcaccctgatggccctgatcagaacagccctggagatcaagctggccccagctggcaccaagcagcaccagtgtgatgctgagctgaggaaggagatctctgtggtgtgggccaacctgccccagaagaccctggacctgctggtgcccccccacaagccagatgagatgacagtgggcaaggtgtatgctgccctgatgatctttgacttctacaagcagaacaagaccacccgggaccagatgcagcaggcccctgggggcctgagccagatgggccctgtgtccctcttccaccccctgaaggccaccctggagcagacccagcctgctgtgctgcggggggcccgggtcttcctgcggcagaagagcagcaccagcctgagcaatggaggagccatccagaaccaggagagcggcatcaaggagagcgtgtcctggggcacccagaggacccaggatgcccctcatgaggcccggccccccctggagcggggccacagcacagagatccctgtgggccgcagcggggccctggccgtggatgtgcagatgcagagcatcacccggcggggcccagatggagagccccagcccggcctggagagccagggccgggccgcctccatgccccggctggccgctgagacccagcctgtgacagatgccagccccatgaagaggagcatcagcaccctggcccagaggccccggggcacccacctgtgcagcaccaccccagaccggcccccacccagccaggccagcagccaccaccaccaccaccgctgccacagaagaagagacaggaagcagaggagcctggagaagggccccagcctgtctgctgacatggatggagcccccagcagcgctgtgggccctggcctgcccccaggagagggccccaccggctgcagaagagagcgggagcggcggcaggagcggggccgcagccaggagcggcggcagcccagcagcagcagcagcgagaagcagcgcttctacagctgtgacagatttggaggccgggagccccccaagcccaagcccagcctgagcagccaccccaccagccccacagctggccaggagcccggcccccacccccagggcagcggctctgtgaatggcagccccctgctgagcaccagcggggccagcaccccaggccggggcggccggcggcagctgccccagacccccctgaccccccggcccagcatcacctacaagacagccaacagcagccccatccactttgctggggcccagaccagcctgcctgccttcagccctggccgcctgagccggggcctgtctgagcacaatgccctgctgcagagggaccccctgagccagcccctggcccctggcagccgcatcggcagtgacccctacctgggccagaggctggacagcgaggcctctgtgcacgccctgcctgaggacaccctgacctttgaggaggccgtggccaccaacagcggccgcagcagcaggaccagctatgtgagcagcctgaccagccagagccaccccctgcggcgggtgcccaacggctaccactgcaccctgggcctgagcagcggcggccgggcccggcacagctaccaccacccagaccaggaccactggtgctag

SEQ ID NO: 145846 - DNA, 306 bp, Artificial Sequence
  Description of Artificial Sequence: Synthetic coding sequence
gacaacctggccaatgcccaggagctgaccaaggatgaggaggagatggaggaggccgccaaccagaagctggccctgcagaaggccaaggaggtggccgaggtgagccccatgtctgctgccaacatcagcattgctgcctttgtgaagcaggcccggggcaccgtgagccgcagcagctctgtgtcctctgtgaacagcccccggcagcagaacagcgccaaggcccggtctgtgtgggagcagagggccagccagctgcggctgcagaacctgcgggccagctgtgaggccctgtacagctag

SEQ ID NO: 145847 - DNA, 6714 bp, Artificial Sequence
  Description of Artificial Sequence: Synthetic coding sequence
atggtgcgctttggagatgagctgggcggccgctatggaggccctgggggcggggagcgggcccggggcggcggggccggcggggccggcggccctggccctgggggcctgcagcccggccagagggtgctgtacaagcagagcatcgcccagagggcccggaccatggccctgtacaaccccatccctgtgaagcagaactgcttcaccgtgaacagaagcctgtttgtgttttctgaggacaacgtggtgaggaaatatgccaagaggatcacagagtggcccccatttgagtacatgatcctggccaccatcatcgccaactgcatcgtgctggccctggagcagcacctgcctgatggagacaagacccccatgtctgagcggctggatgacacagagccctacttcatcggcatcttctgctttgaagctggcatcaagatcatcgccctgggctttgtgttccacaagggcagctacctgagaaatggctggaatgtgatggactttgtggtggtgctgaccggcatcctggccacagctggaacagactttgacctgcggaccctgcgggctgtgcgggtgctgcggcccctgaagctggtgtctggcatccccagcctgcaggtggtgctgaagagcatcatgaaggccatggtgcccctgctgcagatcggcctgctgctcttctttgccatcctgatgtttgccatcatcggcctggagttctacatgggcaagttccacaaggcctgcttccccaacagcacagatgctgagcctgtgggggacttcccctgtgggaaggaggccccagcccggctgtgtgagggggacacagagtgccgggagtactggccaggccccaactttggcatcaccaactttgacaacatcctgtttgccatcctgaccgtcttccagtgcatcaccatggagggctggacagacatcctgtacaacaccaatgatgctgctggcaacacctggaactggctgtacttcatccccctcatcatcatcggcagcttcttcatgctgaacctggtgctgggcgtgctgagcggggagtttgccaaggagcgggagcgggtggagaacagaagagccttcctgaagctgcggcggcagcagcagatcgagcgggagctgaatggctacctggagtggatcttcaaggccgaggaggtgatgctggccgaggaggacagaaatgctgaggagaagagccccctggatgtgctgaagagagctgccaccaagaagagcagaaatgacctgattcatgctgaggagggagaagatagatttgctgacctgtgtgctgtgggcagcccctttgcccgggccagcctgaagagcggcaagacagagagcagcagctacttccggaggaaggagaagatgttccgcttcttcatccggaggatggtgaaggcccagagcttctactgggtggtgctgtgtgtggtggccctgaacaccctgtgtgtggccatggtgcactacaaccagccccggcggctgaccaccaccctgtactttgctgagtttgtgttcctgggcctcttcctgacagagatgagcctgaagatgtatggcctgggccccaggagctacttccgcagcagcttcaactgctttgattttggagtcatcgtgggctctgtgtttgaggtggtgtgggccgccatcaagccaggcagcagctttggcatctctgtgctgcgggccctgcggctgctgcgcatcttcaaggtgaccaagtactggagcagcctgaggaacctggtggtgtccctgctgaacagcatgaagagcatcatcagcctgctcttcctgctcttcctgttcatcgtggtgtttgccctgctgggcatgcagctgtttggaggccagttcaacttccaggatgagacccccaccaccaactttgacaccttccctgctgccatcctgactgtgttccagatcctgactggagaggactggaatgctgtgatgtaccatggaattgagagccagggcggcgtgtccaagggcatgttcagcagcttctacttcatcgtgctgaccctgtttggaaactacaccctgctgaatgtgttcctggccatcgctgtggacaacctggccaatgcccaggagctgaccaaggatgaggaggagatggaggaggccgccaaccagaagctggccctgcagaaggccaaggaggtggccgaggtgagccccatgtctgctgccaacatcagcattgctgcccggcagcagaacagcgccaaggcccggtctgtgtgggagcagagggccagccagctgcggctgcagaacctgcgggccagctgtgaggccctgtacagcgagatggaccctgaggagcggctgcgctttgccaccaccaggcacctgcggccagacatgaagacccacctggaccggcccctggtggtggagctgggcagagatggagcccggggccctgtgggcggcaaggcccggcctgaggccgctgaggcccctgagggcgtggaccccccaagaagacaccaccgccaccgggacaaggacaagaccccagctgctggggaccaggacagagctgaggcccccaaggccgagagcggggagcccggggcccgggaggagcggccccggccccacaggagccacagcaaggaggccgccggccccccagaggcccggtctgagcggggccggggccctggccctgagggcggccgccgccaccaccggcggggcagccctgaggaggccgctgagcgggagcccaggaggcaccgggcccaccgccaccaggaccccagcaaagaatgtgccggggccaagggggagcggcgggcccggcaccggggcggcccccgggccggcccccgggaggccgagagcggggaggagcccgcccggcggcaccgggcccggcacaaggcccagcctgcccatgaagctgtggagaaggagaccacagagaaggaggccacagagaaggaggccgagatcgtggaggccgacaaggagaaggagctgaggaaccaccagccccgggagccccactgtgacctggagaccagcggcaccgtgacagtgggccccatgcacaccctgcccagcacctgcctgcagaaggtggaggagcagccagaagatgctgacaaccagagaaatgtgaccaggatgggcagccagcccccagaccccaacaccatcgtgcacatccctgtgatgctgaccggccccctgggggaggccaccgtggtgcccagcggaaatgtggacctggagagccaggccgagggcaagaaggaggtggaggctgatgatgtgatgaggagcggcccccggcccatcgtgccctacagctccatgttctgcctgagccccaccaacctgctgcggcgcttctgccactacatcgtgaccatgagatactttgaggtggtgatcctggtggtgattgccctgagcagcatcgccctggccgctgaggaccctgtgaggacagacagccccagaaataatgccctgaagtacctggactacatcttcaccggggtcttcacctttgagatggtgatcaagatgattgacctgggcctgctgctgcaccctggggcctacttccgggacctgtggaacatcctggacttcatcgtggtgtctggggccctggtggcctttgccttcagcggcagcaagggcaaggacatcaacaccatcaagagcctgcgggtgctgcgggtgctgcggcccctgaagaccatcaagaggctgcccaagctgaaggctgtgtttgactgtgtggtgaacagcctgaagaatgtgctgaacatcctgattgtgtacatgctgttcatgttcatctttgctgtgattgctgtgcagctgttcaagggcaagttcttctactgcacagatgagagcaaggagctggagcgggactgccggggccagtacctggactatgagaaggaggaggtggaggcccagccccggcagtggaagaagtatgacttccactatgacaacgtgctgtgggccctgctgaccctcttcaccgtgtccactggagagggctggcccatggtgctgaagcacagcgtggatgccacctatgaggagcagggccccagccctggctacaggatggagctgagcatcttctacgtggtgtactttgtggtgttccccttcttctttgtgaacatctttgtggccctgatcatcatcaccttccaggagcagggcgacaaggtgatgtctgaatgttccctggagaagaatgaaagagcctgcatcgactttgccatcagcgccaagcccctgacccgctacatgccccagaaccggcagagcttccagtacaagacctggacctttgtggtgtccccaccatttgagtacttcatcatggccatgattgccctgaacacagtggtgctgatgatgaagttctatgatgccccctatgaatatgagctgatgctgaagtgcctgaacatcgtgttcacctccatgttctccatggagtgtgtgctgaagatcatcgcctttggagtgctgaactacttcagagatgcctggaatgtgtttgattttgtgacagtgctgggcagcatcacagacatcctggtgacagaaattgctgagaccaacaacttcatcaacctgtccttcctgcggctcttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaacatcgccctggatgatgacaccagcatcaacagacacaacaacttccgcaccttcctgcaggccctgatgctgctcttccgcagcgccactggagaggcctggcatgagatcatgctgagctgcctgagcaaccaggcctgtgatgagcaggccaatgccacagaatgtggcagtgactttgcctacttctactttgtgtccttcatcttcctgtgcagcttcctgatgctgaacctgtttgtggccgtcatcatggacaactttgagtacctgacccgggacagcagcatcctgggcccccaccacctggatgagttcatccgggtgtgggccgagtatgaccctgctgcctgtggccgcatctcctacaatgacatgtttgagatgctgaagcacatgagcccccccctgggcctgggcaagaagtgcccagcccgggtggcctacaagaggctggtgaggatgaacatgcccatcagcaatgaagacatgacagtgcacttcaccagcaccctgatggccctgatcagaacagccctggagatcaagctggccccagctggcaccaagcagcaccagtgtgatgctgagctgaggaaggagatctctgtggtgtgggccaacctgccccagaagaccctggacctgctggtgcccccccacaagccagatgagatgacagtgggcaaggtgtatgctgccctgatgatctttgacttctacaagcagaacaagaccacccgggaccagatgcagcaggcccctgggggcctgagccagatgggccctgtgtccctcttccaccccctgaaggccaccctggagcagacccagcctgctgtgctgcggggggcccgggtcttcctgcggcagaagagcagcaccagcctgagcaatggaggagccatccagaaccaggagagcggcatcaaggagagcgtgtcctggggcacccagaggacccaggatgcccctcatgaggcccggccccccctggagcggggccacagcacagagatccctgtgggccgcagcggggccctggccgtggatgtgcagatgcagagcatcacccggcggggcccagatggagagccccagcccggcctggagagccagggccgggccgcctccatgccccggctggccgctgagacccagcctgtgacagatgccagccccatgaagaggagcatcagcaccctggcccagaggccccggggcacccacctgtgcagcaccaccccagaccggcccccacccagccaggccagcagccaccaccaccaccaccgctgccacagaagaagagacaggaagcagaggagcctggagaagggccccagcctgtctgctgacatggatggagcccccagcagcgctgtgggccctggcctgcccccaggagagggccccaccggctgcagaagagagcgggagcggcggcaggagcggggccgcagccaggagcggcggcagcccagcagcagcagcagcgagaagcagcgcttctacagctgtgacagatttggaggccgggagccccccaagcccaagcccagcctgagcagccaccccaccagccccacagctggccaggagcccggcccccacccccaggccggcagcgctgtgggcttccccaacaccaccccctgctgccgggagacccccagcgccagcccctggcccctggccctggagctggccctgaccctgacctggggctctgtgtggacagtgcggcccctgagcaccccctgcctgcggaccctgagcctgagccggcggctgtggccacccaccagggctgcccctcctggcctgcccacctgccccccatag

SEQ ID NO: 145848 - DNA, 7023 bp, Artificial Sequence
  Description of Artificial Sequence: Synthetic coding sequence
atggtgcgctttggagatgagctgggcggccgctatggaggccctgggggcggggagcgggcccggggcggcggggccggcggggccggcggccctggccctgggggcctgcagcccggccagagggtgctgtacaagcagagcatcgcccagagggcccggaccatggccctgtacaaccccatccctgtgaagcagaactgcttcaccgtgaacagaagcctgtttgtgttttctgaggacaacgtggtgaggaaatatgccaagaggatcacagagtggcccccatttgagtacatgatcctggccaccatcatcgccaactgcatcgtgctggccctggagcagcacctgcctgatggagacaagacccccatgtctgagcggctggatgacacagagccctacttcatcggcatcttctgctttgaagctggcatcaagatcatcgccctgggctttgtgttccacaagggcagctacctgagaaatggctggaatgtgatggactttgtggtggtgctgaccggcatcctggccacagctggaacagactttgacctgcggaccctgcgggctgtgcgggtgctgcggcccctgaagctggtgtctggcatccccagcctgcaggtggtgctgaagagcatcatgaaggccatggtgcccctgctgcagatcggcctgctgctcttctttgccatcctgatgtttgccatcatcggcctggagttctacatgggcaagttccacaaggcctgcttccccaacagcacagatgctgagcctgtgggggacttcccctgtgggaaggaggccccagcccggctgtgtgagggggacacagagtgccgggagtactggccaggccccaactttggcatcaccaactttgacaacatcctgtttgccatcctgaccgtcttccagtgcatcaccatggagggctggacagacatcctgtacaacaccaatgatgctgctggcaacacctggaactggctgtacttcatccccctcatcatcatcggcagcttcttcatgctgaacctggtgctgggcgtgctgagcggggagtttgccaaggagcgggagcgggtggagaacagaagagccttcctgaagctgcggcggcagcagcagatcgagcgggagctgaatggctacctggagtggatcttcaaggccgaggaggtgatgctggccgaggaggacagaaatgctgaggagaagagccccctggatgctgtgctgaagagagctgccaccaagaagagcagaaatgacctgattcatgctgaggagggggaggacagatttgctgacctgtgtgctgtgggcagcccctttgcccgggccagcctgaagagcggcaagacagagagcagcagctacttccggaggaaggagaagatgttccgcttcttcatccggaggatggtgaaggcccagagcttctactgggtggtgctgtgtgtggtggccctgaacaccctgtgtgtggccatggtgcactacaaccagccccggcggctgaccaccaccctgtactttgctgagtttgtgttcctgggcctcttcctgacagagatgagcctgaagatgtatggcctgggccccaggagctacttccgcagcagcttcaactgctttgattttggagtgattgtgggctctgtgtttgaggtggtgtgggccgccatcaagccaggcagcagctttggcatctctgtgctgcgggccctgcggctgctgcgcatcttcaaggtgaccaagtactggagcagcctgaggaacctggtggtgtccctgctgaacagcatgaagagcatcatcagcctgctcttcctgctcttcctgttcatcgtggtgtttgccctgctgggcatgcagctgtttggaggccagttcaacttccaggatgagacccccaccaccaactttgacaccttccctgctgccatcctgaccgtcttccagatcctgaccggggaggactggaatgctgtgatgtaccacggcatcgagagccagggcggcgtgtccaagggcatgttcagcagcttctacttcatcgtgctgaccctgtttggaaactacaccctgctgaatgtgttcctggccatcgctgtggacaacctggccaatgcccaggagctgaccaaggatgaggaggagatggaggaggccgccaaccagaagctggccctgcagaaggccaaggaggtggccgaggtgagccccatgtctgctgccaacatcagcattgctgcccggcagcagaacagcgccaaggcccggtctgtgtgggagcagagggccagccagctgcggctgcagaacctgcgggccagctgtgaggccctgtacagcgagatggaccctgaggagcggctgcgctttgccaccaccaggcacctgcggccagacatgaagacccacctggaccggcccctggtggtggagctgggcagagatggagcccggggccctgtgggcggcaaggcccggcctgaggccgctgaggcccctgagggcgtggaccccccccggcggcaccaccgccaccgggacaaggacaagaccccagctgctggggaccaggacagagctgaggcccccaaggccgagagcggggagcccggggcccgggaggagcggccccggccccacaggagccacagcaaggaggccgccggccccccagaggcccggtctgagcggggccggggccctggccctgagggcggcagaagacaccacagaagaggcagccctgaggaggccgctgagcgggagccccggcggcaccgggcccaccgccaccaggaccccagcaaagaatgtgccggggccaagggggagcggcgggcccggcacagaggaggccccagggctggcccccgggaggccgagagcggggaggagcccgcccggcggcaccgggcccggcacaaggcccagcctgcccacgaggccgtggagaaggagaccacagagaaggaggccacagagaaggaggccgagatcgtggaggccgacaaggagaaggagctgaggaaccaccagccccgggagccccactgtgacctggagaccagcggcaccgtgacagtgggccccatgcacaccctgcccagcacctgcctgcagaaggtggaggagcagccagaagatgctgacaaccagagaaatgtgaccaggatgggcagccagcccccagaccccaacaccatcgtgcacatccctgtgatgctgaccggccccctgggggaggccaccgtggtgcccagcggaaatgtggacctggagagccaggccgagggcaagaaggaggtggaggctgatgatgtgatgaggagcggcccccggcccatcgtgccctacagctccatgttctgcctgagccccaccaacctgctgcggcgcttctgccactacatcgtgaccatgagatactttgaggtggtgatcctggtggtgattgccctgagcagcatcgccctggccgcagaagatcctgtgaggacagacagccccaggaacaatgccctgaagtacctggactacatcttcaccggggtcttcacctttgagatggtgatcaagatgattgacctgggcctgctgctgcaccctggggcctacttccgggacctgtggaacatcctggacttcatcgtggtgtctggggccctggtggcctttgccttcagcggcagcaagggcaaggacatcaacaccatcaagagcctgcgggtgctgcgggtgctgcggcccctgaagaccatcaagaggctgcccaagctgaaggctgtgtttgactgtgtggtgaacagcctgaagaatgtgctgaacatcctgattgtgtacatgctgttcatgttcatctttgctgtgattgctgtgcagctgttcaagggcaagttcttctactgcacagatgagagcaaggagctggagcgggactgccggggccagtacctggactatgagaaggaggaggtggaggcccagccccggcagtggaagaagtatgacttccactatgacaacgtgctgtgggccctgctgaccctcttcaccgtgtccactggagagggctggcccatggtgctgaagcacagcgtggatgccacctatgaggagcagggccccagccctggctacaggatggagctgagcatcttctacgtggtgtactttgtggtgttccccttcttctttgtgaacatctttgtggccctgatcatcatcaccttccaggagcagggcgacaaggtgatgtctgagtgcagcctggagaagaatgaaagagcctgcatcgactttgccatcagcgccaagcccctgacccgctacatgccccagaaccggcagagcttccagtacaagacctggacctttgtggtgagccccccatttgagtacttcatcatggccatgattgccctgaacacagtggtgctgatgatgaagttctatgatgccccctatgaatatgagctgatgctgaagtgcctgaacatcgtgttcacctccatgttctccatggagtgtgtgctgaagatcatcgccttcggcgtgctgaactacttcagagatgcctggaatgtgtttgattttgtgacagtgctgggcagcatcacagacatcctggtgacagaaattgctgagaccaacaacttcatcaacctgtccttcctgcggctcttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaatattgccctggatgatgacaccagcatcaacagacacaacaacttccgcaccttcctgcaggccctgatgctgctcttccgcagcgccaccggggaggcctggcatgagatcatgctgagctgcctgagcaaccaggcctgtgatgagcaggccaatgccacagaatgtggcagtgactttgcctacttctactttgtgtccttcatcttcctgtgcagcttcctgatgctgaacctgtttgtggccgtcatcatggacaactttgagtacctgacccgggacagcagcatcctgggcccccaccacctggatgagttcatccgggtgtgggccgagtatgaccctgctgcctgtggccgcatctcctacaatgacatgtttgagatgctgaagcacatgagcccccccctgggcctgggcaagaagtgcccagcccgggtggcctacaagaggctggtgaggatgaacatgcccatcagcaatgaagacatgacagtgcacttcaccagcaccctgatggccctgatcagaacagccctggagatcaagctggccccagctggcaccaagcagcaccagtgtgatgctgagctgaggaaggagatctctgtggtgtgggccaacctgccccagaagaccctggacctgctggtgcccccccacaagccagatgagatgacagtgggcaaggtgtatgctgccctgatgatctttgacttctacaagcagaacaagaccacccgggaccagatgcagcaggcccctgggggcctgagccagatgggccctgtgtccctcttccaccccctgaaggccaccctggagcagacccagcctgctgtgctgcggggggcccgggtcttcctgcggcagaagagcagcaccagcctgagcaatggaggagccatccagaaccaggagagcggcatcaaggagagcgtgtcctggggcacccagaggacccaggatgcccctcatgaggcccggccccccctggagcggggccacagcacagagatccctgtgggccgcagcggggccctggccgtggatgtgcagatgcagagcatcacccggcggggcccagatggagagccccagcccggcctggagagccagggccgggccgcctccatgccccggctggccgctgagacccagcctgtgacagatgccagccccatgaagaggagcatcagcaccctggcccagaggccccggggcacccacctgtgcagcaccaccccagaccggcccccacccagccaggccagcagccaccaccaccaccaccgctgccacagaagaagagacaggaagcagaggagcctggagaagggccccagcctgtctgctgacatggatggagcccccagcagcgctgtgggccctggcctgcccccaggagagggccccaccggctgccggcgggagcgggagcggcggcaggagcggggccgcagccaggagcggcggcagcccagcagcagcagcagcgagaagcagcgcttctacagctgtgacagatttggaggccgggagccccccaagcccaagcccagcctgagcagccaccccaccagccccacagctggccaggagcccggcccccacccccagggcagcggctctgtgaatggcagccccctgctgagcaccagcggggccagcaccccaggccggggcggccggcggcagctgccccagacccccctgaccccccggcccagcatcacctacaagacagccaacagcagccccatccactttgctggggcccagaccagcctgcctgccttcagccctggccgcctgagccggggcctgtctgagcacaatgccctgctgcagagggaccccctgagccagcccctggcccctggcagcagaattggaagtgacccctacctgggccagaggctggacagcgaggcctctgtgcacgccctgcctgaggacaccctgacctttgaggaggccgtggccaccaacagcggccgcagcagcaggaccagctatgtgagcagcctgaccagccagagccaccccctgcggcgggtgcccaacggctaccactgcaccctgggcctgagcagcggcggccgggcccggcacagctaccaccacccagaccaggaccactggtgctag

SEQ ID NO: 145849 - DNA, 7017 bp, Artificial Sequence
  Description of Artificial Sequence: Synthetic coding sequence
atggtgcgctttggagatgagctgggcggccgctatggaggccctgggggcggggagcgggcccggggcggcggggccggcggggccggcggccctggccctgggggcctgcagcccggccagagggtgctgtacaagcagagcatcgcccagagggcccggaccatggccctgtacaaccccatccctgtgaagcagaactgcttcaccgtgaacagaagcctgtttgtgttttctgaggacaacgtggtgaggaaatatgccaagaggatcacagagtggcccccatttgagtacatgatcctggccaccatcatcgccaactgcatcgtgctggccctggagcagcacctgcctgatggagacaagacccccatgtctgagcggctggatgacacagagccctacttcatcggcatcttctgctttgaagctggcatcaagatcatcgccctgggctttgtgttccacaagggcagctacctgagaaatggctggaatgtgatggactttgtggtggtgctgaccggcatcctggccacagctggaacagactttgacctgcggaccctgcgggctgtgcgggtgctgcggcccctgaagctggtgtctggcatccccagcctgcaggtggtgctgaagagcatcatgaaggccatggtgcccctgctgcagatcggcctgctgctcttctttgccatcctgatgtttgccatcatcggcctggagttctacatgggcaagttccacaaggcctgcttccccaacagcacagatgctgagcctgtgggggacttcccctgtgggaaggaggccccagcccggctgtgtgagggggacacagagtgccgggagtactggccaggccccaactttggcatcaccaactttgacaacatcctgtttgccatcctgaccgtcttccagtgcatcaccatggagggctggacagacatcctgtacaacaccaatgatgctgctggcaacacctggaactggctgtacttcatccccctcatcatcatcggcagcttcttcatgctgaacctggtgctgggcgtgctgagcggggagtttgccaaggagcgggagcgggtggagaacagaagagccttcctgaagctgcggcggcagcagcagatcgagcgggagctgaatggctacctggagtggatcttcaaggccgaggaggtgatgctggccgaggaggacagaaatgctgaggagaagagccccctggatgctgtgctgaagagagctgccaccaagaagagcagaaatgacctgattcatgctgaggagggggaggacagatttgctgacctgtgtgctgtgggcagcccctttgcccgggccagcctgaagagcggcaagacagagagcagcagctacttccggaggaaggagaagatgttccgcttcttcatccggaggatggtgaaggcccagagcttctactgggtggtgctgtgtgtggtggccctgaacaccctgtgtgtggccatggtgcactacaaccagccccggcggctgaccaccaccctgtactttgctgagtttgtgttcctgggcctcttcctgacagagatgagcctgaagatgtatggcctgggccccaggagctacttccgcagcagcttcaactgctttgattttggagtgattgtgggctctgtgtttgaggtggtgtgggccgccatcaagccaggcagcagctttggcatctctgtgctgcgggccctgcggctgctgcgcatcttcaaggtgaccaagtactggagcagcctgaggaacctggtggtgtccctgctgaacagcatgaagagcatcatcagcctgctcttcctgctcttcctgttcatcgtggtgtttgccctgctgggcatgcagctgtttggaggccagttcaacttccaggatgagacccccaccaccaactttgacaccttccctgctgccatcctgaccgtcttccagatcctgaccggggaggactggaatgctgtgatgtaccacggcatcgagagccagggcggcgtgtccaagggcatgttcagcagcttctacttcatcgtgctgaccctgtttggaaactacaccctgctgaatgtgttcctggccatcgctgtggacaacctggccaatgcccaggagctgaccaaggatgaggaggagatggaggaggccgccaaccagaagctggccctgcagaaggccaaggaggtggccgaggtgagccccatgtctgctgccaacatcagcattgctgcccggcagcagaacagcgccaaggcccggtctgtgtgggagcagagggccagccagctgcggctgcagaacctgcgggccagctgtgaggccctgtacagcgagatggaccctgaggagcggctgcgctttgccaccaccaggcacctgcggccagacatgaagacccacctggaccggcccctggtggtggagctgggcagagatggagcccggggccctgtgggcggcaaggcccggcctgaggccgctgaggcccctgagggcgtggaccccccccggcggcaccaccgccaccgggacaaggacaagaccccagctgctggggaccaggacagagctgaggcccccaaggccgagagcggggagcccggggcccgggaggagcggccccggccccacaggagccacagcaaggaggccgccggccccccagaggcccggtctgagcggggccggggccctggccctgagggcggcagaagacaccacagaagaggcagccctgaggaggccgctgagcgggagccccggcggcaccgggcccaccgccaccaggaccccagcaaagaatgtgccggggccaagggggagcggcgggcccggcacagaggaggccccagggctggcccccgggaggccgagagcggggaggagcccgcccggcggcaccgggcccggcacaaggcccagcctgcccacgaggccgtggagaaggagaccacagagaaggaggccacagagaaggaggccgagatcgtggaggccgacaaggagaaggagctgaggaaccaccagccccgggagccccactgtgacctggagaccagcggcaccgtgacagtgggccccatgcacaccctgcccagcacctgcctgcagaaggtggaggagcagccagaagatgctgacaaccagagaaatgtgaccaggatgggcagccagcccccagaccccaacaccatcgtgcacatccctgtgatgctgaccggccccctgggggaggccaccgtggtgcccagcggaaatgtggacctggagagccaggccgagggcaagaaggaggtggaggctgatgatgtgatgaggagcggcccccggcccatcgtgccctacagctccatgttctgcctgagccccaccaacctgctgcggcgcttctgccactacatcgtgaccatgagatactttgaggtggtgatcctggtggtgattgccctgagcagcatcgccctggccgcagaagatcctgtgaggacagacagccccaggaacaatgccctgaagtacctggactacatcttcaccggggtcttcacctttgagatggtgatcaagatgattgacctgggcctgctgctgcaccctggggcctacttccgggacctgtggaacatcctggacttcatcgtggtgtctggggccctggtggcctttgccttcagcggcagcaagggcaaggacatcaacaccatcaagagcctgcgggtgctgcgggtgctgcggcccctgaagaccatcaagaggctgcccaagctgaaggctgtgtttgactgtgtggtgaacagcctgaagaatgtgctgaacatcctgattgtgtacatgctgttcatgttcatctttgctgtgattgctgtgcagctgttcaagggcaagttcttctactgcacagatgagagcaaggagctggagcgggactgccggggccagtacctggactatgagaaggaggaggtggaggcccagccccggcagtggaagaagtatgacttccactatgacaacgtgctgtgggccctgctgaccctcttcaccgtgtccactggagagggctggcccatggtgctgaagcacagcgtggatgccacctatgaggagcagggccccagccctggctacaggatggagctgagcatcttctacgtggtgtactttgtggtgttccccttcttctttgtgaacatctttgtggccctgatcatcatcaccttccaggagcagggcgacaaggtgatgtctgagtgcagcctggagaagaatgaaagagcctgcatcgactttgccatcagcgccaagcccctgacccgctacatgccccagaaccggcagagcttccagtacaagacctggacctttgtggtgagccccccatttgagtacttcatcatggccatgattgccctgaacacagtggtgctgatgatgaagttctatgatgccccctatgaatatgagctgatgctgaagtgcctgaacatcgtgttcacctccatgttctccatggagtgtgtgctgaagatcatcgccttcggcgtgctgaactacttcagagatgcctggaatgtgtttgattttgtgacagtgctgggcagcatcacagacatcctggtgacagagatcgccaacaacttcatcaacctgtccttcctgcggctcttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaatattgccctggatgatgacaccagcatcaacagacacaacaacttccgcaccttcctgcaggccctgatgctgctcttccgcagcgccaccggggaggcctggcatgagatcatgctgagctgcctgagcaaccaggcctgtgatgagcaggccaatgccacagaatgtggcagtgactttgcctacttctactttgtgtccttcatcttcctgtgcagcttcctgatgctgaacctgtttgtggccgtcatcatggacaactttgagtacctgacccgggacagcagcatcctgggcccccaccacctggatgagttcatccgggtgtgggccgagtatgaccctgctgcctgtggccgcatctcctacaatgacatgtttgagatgctgaagcacatgagcccccccctgggcctgggcaagaagtgcccagcccgggtggcctacaagaggctggtgaggatgaacatgcccatcagcaatgaagacatgacagtgcacttcaccagcaccctgatggccctgatcagaacagccctggagatcaagctggccccagctggcaccaagcagcaccagtgtgatgctgagctgaggaaggagatctctgtggtgtgggccaacctgccccagaagaccctggacctgctggtgcccccccacaagccagatgagatgacagtgggcaaggtgtatgctgccctgatgatctttgacttctacaagcagaacaagaccacccgggaccagatgcagcaggcccctgggggcctgagccagatgggccctgtgtccctcttccaccccctgaaggccaccctggagcagacccagcctgctgtgctgcggggggcccgggtcttcctgcggcagaagagcagcaccagcctgagcaatggaggagccatccagaaccaggagagcggcatcaaggagagcgtgtcctggggcacccagaggacccaggatgcccctcatgaggcccggccccccctggagcggggccacagcacagagatccctgtgggccgcagcggggccctggccgtggatgtgcagatgcagagcatcacccggcggggcccagatggagagccccagcccggcctggagagccagggccgggccgcctccatgccccggctggccgctgagacccagcctgtgacagatgccagccccatgaagaggagcatcagcaccctggcccagaggccccggggcacccacctgtgcagcaccaccccagaccggcccccacccagccaggccagcagccaccaccaccaccaccgctgccacagaagaagagacaggaagcagaggagcctggagaagggccccagcctgtctgctgacatggatggagcccccagcagcgctgtgggccctggcctgcccccaggagagggccccaccggctgccggcgggagcgggagcggcggcaggagcggggccgcagccaggagcggcggcagcccagcagcagcagcagcgagaagcagcgcttctacagctgtgacagatttggaggccgggagccccccaagcccaagcccagcctgagcagccaccccaccagccccacagctggccaggagcccggcccccacccccagggcagcggctctgtgaatggcagccccctgctgagcaccagcggggccagcaccccaggccggggcggccggcggcagctgccccagacccccctgaccccccggcccagcatcacctacaagacagccaacagcagccccatccactttgctggggcccagaccagcctgcctgccttcagccctggccgcctgagccggggcctgtctgagcacaatgccctgctgcagagggaccccctgagccagcccctggcccctggcagcagaattggaagtgacccctacctgggccagaggctggacagcgaggcctctgtgcacgccctgcctgaggacaccctgacctttgaggaggccgtggccaccaacagcggccgcagcagcaggaccagctatgtgagcagcctgaccagccagagccaccccctgcggcgggtgcccaacggctaccactgcaccctgggcctgagcagcggcggccgggcccggcacagctaccaccacccagaccaggaccactggtgctag

SEQ ID NO: 145850 - DNA, 7014 bp, Artificial Sequence
  Description of Artificial Sequence: Synthetic coding sequence
atggtgcgctttggagatgagctgggcggccgctatggaggccctgggggcggggagcgggcccggggcggcggggccggcggggccggcggccctggccctgggggcctgcagcccggccagagggtgctgtacaagcagagcatcgcccagagggcccggaccatggccctgtacaaccccatccctgtgaagcagaactgcttcaccgtgaacagaagcctgtttgtgttttctgaggacaacgtggtgaggaaatatgccaagaggatcacagagtggcccccatttgagtacatgatcctggccaccatcatcgccaactgcatcgtgctggccctggagcagcacctgcctgatggagacaagacccccatgtctgagcggctggatgacacagagccctacttcatcggcatcttctgctttgaagctggcatcaagatcatcgccctgggctttgtgttccacaagggcagctacctgagaaatggctggaatgtgatggactttgtggtggtgctgaccggcatcctggccacagctggaacagactttgacctgcggaccctgcgggctgtgcgggtgctgcggcccctgaagctggtgtctggcatccccagcctgcaggtggtgctgaagagcatcatgaaggccatggtgcccctgctgcagatcggcctgctgctcttctttgccatcctgatgtttgccatcatcggcctggagttctacatgggcaagttccacaaggcctgcttccccaacagcacagatgctgagcctgtgggggacttcccctgtgggaaggaggccccagcccggctgtgtgagggggacacagagtgccgggagtactggccaggccccaactttggcatcaccaactttgacaacatcctgtttgccatcctgaccgtcttccagtgcatcaccatggagggctggacagacatcctgtacaacaccaatgatgctgctggcaacacctggaactggctgtacttcatccccctcatcatcatcggcagcttcttcatgctgaacctggtgctgggcgtgctgagcggggagtttgccaaggagcgggagcgggtggagaacagaagagccttcctgaagctgcggcggcagcagcagatcgagcgggagctgaatggctacctggagtggatcttcaaggccgaggaggtgatgctggccgaggaggacagaaatgctgaggagaagagccccctggatgtgctgaagagagctgccaccaagaagagcagaaatgacctgattcatgctgaggagggagaagatagatttgctgacctgtgtgctgtgggcagcccctttgcccgggccagcctgaagagcggcaagacagagagcagcagctacttccggaggaaggagaagatgttccgcttcttcatccggaggatggtgaaggcccagagcttctactgggtggtgctgtgtgtggtggccctgaacaccctgtgtgtggccatggtgcactacaaccagccccggcggctgaccaccaccctgtactttgctgagtttgtgttcctgggcctcttcctgacagagatgagcctgaagatgtatggcctgggccccaggagctacttccgcagcagcttcaactgctttgattttggagtcatcgtgggctctgtgtttgaggtggtgtgggccgccatcaagccaggcagcagctttggcatctctgtgctgcgggccctgcggctgctgcgcatcttcaaggtgaccaagtactggagcagcctgaggaacctggtggtgtccctgctgaacagcatgaagagcatcatcagcctgctcttcctgctcttcctgttcatcgtggtgtttgccctgctgggcatgcagctgtttggaggccagttcaacttccaggatgagacccccaccaccaactttgacaccttccctgctgccatcctgactgtgttccagatcctgactggagaggactggaatgctgtgatgtaccatggaattgagagccagggcggcgtgtccaagggcatgttcagcagcttctacttcatcgtgctgaccctgtttggaaactacaccctgctgaatgtgttcctggccatcgctgtggacaacctggccaatgcccaggagctgaccaaggatgaggaggagatggaggaggccgccaaccagaagctggccctgcagaaggccaaggaggtggccgaggtgagccccatgtctgctgccaacatcagcattgctgcccggcagcagaacagcgccaaggcccggtctgtgtgggagcagagggccagccagctgcggctgcagaacctgcgggccagctgtgaggccctgtacagcgagatggaccctgaggagcggctgcgctttgccaccaccaggcacctgcggccagacatgaagacccacctggaccggcccctggtggtggagctgggcagagatggagcccggggccctgtgggcggcaaggcccggcctgaggccgctgaggcccctgagggcgtggaccccccaagaagacaccaccgccaccgggacaaggacaagaccccagctgctggggaccaggacagagctgaggcccccaaggccgagagcggggagcccggggcccgggaggagcggccccggccccacaggagccacagcaaggaggccgccggccccccagaggcccggtctgagcggggccggggccctggccctgagggcggccgccgccaccaccggcggggcagccctgaggaggccgctgagcgggagcccaggaggcaccgggcccaccgccaccaggaccccagcaaagaatgtgccggggccaagggggagcggcgggcccggcaccggggcggcccccgggccggcccccgggaggccgagagcggggaggagcccgcccggcggcaccgggcccggcacaaggcccagcctgcccatgaagctgtggagaaggagaccacagagaaggaggccacagagaaggaggccgagatcgtggaggccgacaaggagaaggagctgaggaaccaccagccccgggagccccactgtgacctggagaccagcggcaccgtgacagtgggccccatgcacaccctgcccagcacctgcctgcagaaggtggaggagcagccagaagatgctgacaaccagagaaatgtgaccaggatgggcagccagcccccagaccccaacaccatcgtgcacatccctgtgatgctgaccggccccctgggggaggccaccgtggtgcccagcggaaatgtggacctggagagccaggccgagggcaagaaggaggtggaggctgatgatgtgatgaggagcggcccccggcccatcgtgccctacagctccatgttctgcctgagccccaccaacctgctgcggcgcttctgccactacatcgtgaccatgagatactttgaggtggtgatcctggtggtgattgccctgagcagcatcgccctggccgctgaggaccctgtgaggacagacagccccagaaataatgccctgaagtacctggactacatcttcaccggggtcttcacctttgagatggtgatcaagatgattgacctgggcctgctgctgcaccctggggcctacttccgggacctgtggaacatcctggacttcatcgtggtgtctggggccctggtggcctttgccttcagcggcagcaagggcaaggacatcaacaccatcaagagcctgcgggtgctgcgggtgctgcggcccctgaagaccatcaagaggctgcccaagctgaaggctgtgtttgactgtgtggtgaacagcctgaagaatgtgctgaacatcctgattgtgtacatgctgttcatgttcatctttgctgtgattgctgtgcagctgttcaagggcaagttcttctactgcacagatgagagcaaggagctggagcgggactgccggggccagtacctggactatgagaaggaggaggtggaggcccagccccggcagtggaagaagtatgacttccactatgacaacgtgctgtgggccctgctgaccctcttcaccgtgtccactggagagggctggcccatggtgctgaagcacagcgtggatgccacctatgaggagcagggccccagccctggctacaggatggagctgagcatcttctacgtggtgtactttgtggtgttccccttcttctttgtgaacatctttgtggccctgatcatcatcaccttccaggagcagggcgacaaggtgatgtctgaatgttccctggagaagaatgaaagagcctgcatcgactttgccatcagcgccaagcccctgacccgctacatgccccagaaccggcagagcttccagtacaagacctggacctttgtggtgtccccaccatttgagtacttcatcatggccatgattgccctgaacacagtggtgctgatgatgaagttctatgatgccccctatgaatatgagctgatgctgaagtgcctgaacatcgtgttcacctccatgttctccatggagtgtgtgctgaagatcatcgcctttggagtgctgaactacttcagagatgcctggaatgtgtttgattttgtgacagtgctgggcagcatcacagacatcctggtgacagaaattgccaacaacttcatcaacctgtccttcctgcggctcttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaacatcgccctggatgatgacaccagcatcaacagacacaacaacttccgcaccttcctgcaggccctgatgctgctcttccgcagcgccactggagaggcctggcatgagatcatgctgagctgcctgagcaaccaggcctgtgatgagcaggccaatgccacagaatgtggcagtgactttgcctacttctactttgtgtccttcatcttcctgtgcagcttcctgatgctgaacctgtttgtggccgtcatcatggacaactttgagtacctgacccgggacagcagcatcctgggcccccaccacctggatgagttcatccgggtgtgggccgagtatgaccctgctgcctgtggccgcatctcctacaatgacatgtttgagatgctgaagcacatgagcccccccctgggcctgggcaagaagtgcccagcccgggtggcctacaagaggctggtgaggatgaacatgcccatcagcaatgaagacatgacagtgcacttcaccagcaccctgatggccctgatcagaacagccctggagatcaagctggccccagctggcaccaagcagcaccagtgtgatgctgagctgaggaaggagatctctgtggtgtgggccaacctgccccagaagaccctggacctgctggtgcccccccacaagccagatgagatgacagtgggcaaggtgtatgctgccctgatgatctttgacttctacaagcagaacaagaccacccgggaccagatgcagcaggcccctgggggcctgagccagatgggccctgtgtccctcttccaccccctgaaggccaccctggagcagacccagcctgctgtgctgcggggggcccgggtcttcctgcggcagaagagcagcaccagcctgagcaatggaggagccatccagaaccaggagagcggcatcaaggagagcgtgtcctggggcacccagaggacccaggatgcccctcatgaggcccggccccccctggagcggggccacagcacagagatccctgtgggccgcagcggggccctggccgtggatgtgcagatgcagagcatcacccggcggggcccagatggagagccccagcccggcctggagagccagggccgggccgcctccatgccccggctggccgctgagacccagcctgtgacagatgccagccccatgaagaggagcatcagcaccctggcccagaggccccggggcacccacctgtgcagcaccaccccagaccggcccccacccagccaggccagcagccaccaccaccaccaccgctgccacagaagaagagacaggaagcagaggagcctggagaagggccccagcctgtctgctgacatggatggagcccccagcagcgctgtgggccctggcctgcccccaggagagggccccaccggctgcagaagagagcgggagcggcggcaggagcggggccgcagccaggagcggcggcagcccagcagcagcagcagcgagaagcagcgcttctacagctgtgacagatttggaggccgggagccccccaagcccaagcccagcctgagcagccaccccaccagccccacagctggccaggagcccggcccccacccccagggcagcggctctgtgaatggcagccccctgctgagcaccagcggggccagcaccccaggccggggcggccggcggcagctgccccagacccccctgaccccccggcccagcatcacctacaagacagccaacagcagccccatccactttgctggggcccagaccagcctgcctgccttcagccctggccgcctgagccggggcctgtctgagcacaatgccctgctgcagagggaccccctgagccagcccctggcccctggcagccgcatcggcagtgacccctacctgggccagaggctggacagcgaggcctctgtgcacgccctgcctgaggacaccctgacctttgaggaggccgtggccaccaacagcggccgcagcagcaggaccagctatgtgagcagcctgaccagccagagccaccccctgcggcgggtgcccaacggctaccactgcaccctgggcctgagcagcggcggccgggcccggcacagctaccaccacccagaccaggaccactggtgctag

SEQ ID NO: 145851 - DNA, 495 bp, Artificial Sequence
  Description of Artificial Sequence: Synthetic coding sequence
aacttccgcaccttcctgcaggccctgatgctgctcttccgcagcgccactggagaggcctggcatgagatcatgctgagctgcctgagcaaccaggcctgtgatgagcaggccaatgccacagaatgtggcagtgactttgcctacttctactttgtgtccttcatcttcctgtgcagcttcctgatgctgaacctgtttgtggccgtcatcatggacaactttgagtacctgacccgggacagcagcatcctgggcccccaccacctggatgagttcatccgggtgtgggccgagtatgaccctgctgcctgctgccgcatccactacaaggacatgtacagcctgctgcgctgcatcgcccctcctgtgggcctgggcaagaactgcccccggcggctggcctacaagaggctggtgaggatgaacatgcccatcagcaatgaagacatgacagtgcacttcaccagcaccctgatggccctgatcagatag

SEQ ID NO: 145852 - DNA, 327 bp, Artificial Sequence
  Description of Artificial Sequence: Synthetic coding sequence
ctgaggaaccaccagccccgggagccccactgtgacctggagaccagcggcaccgtgacagtgggccccatgcacaccctgcccagcacctgcctgcagaaggtggaggagcagccagaagatgctgacaaccagagaaatgtgaccaggatgggcagccagcccccagaccccaacaccatcgtgcacatccctgtgatgctgaccggccccctgggggaggccaccgtggtgcccaccctggagaagaatgtgtgcctcttcctgctgacctccatggtgtctgatgagaagagcaccgtcatccgcatcgtgttcttcctgtag

SEQ ID NO: 145853 - DNA, 7020 bp, Artificial Sequence
  Description of Artificial Sequence: Synthetic coding sequence
atggtgcgctttggagatgagctgggcggccgctatggaggccctgggggcggggagcgggcccggggcggcggggccggcggggccggcggccctggccctgggggcctgcagcccggccagagggtgctgtacaagcagagcatcgcccagagggcccggaccatggccctgtacaaccccatccctgtgaagcagaactgcttcaccgtgaacagaagcctgtttgtgttttctgaggacaacgtggtgaggaaatatgccaagaggatcacagagtggcccccatttgagtacatgatcctggccaccatcatcgccaactgcatcgtgctggccctggagcagcacctgcctgatggagacaagacccccatgtctgagcggctggatgacacagagccctacttcatcggcatcttctgctttgaagctggcatcaagatcatcgccctgggctttgtgttccacaagggcagctacctgagaaatggctggaatgtgatggactttgtggtggtgctgaccggcatcctggccacagctggaacagactttgacctgcggaccctgcgggctgtgcgggtgctgcggcccctgaagctggtgtctggcatccccagcctgcaggtggtgctgaagagcatcatgaaggccatggtgcccctgctgcagatcggcctgctgctcttctttgccatcctgatgtttgccatcatcggcctggagttctacatgggcaagttccacaaggcctgcttccccaacagcacagatgctgagcctgtgggggacttcccctgtgggaaggaggccccagcccggctgtgtgagggggacacagagtgccgggagtactggccaggccccaactttggcatcaccaactttgacaacatcctgtttgccatcctgaccgtcttccagtgcatcaccatggagggctggacagacatcctgtacaacaccaatgatgctgctggcaacacctggaactggctgtacttcatccccctcatcatcatcggcagcttcttcatgctgaacctggtgctgggcgtgctgagcggggagtttgccaaggagcgggagcgggtggagaacagaagagccttcctgaagctgcggcggcagcagcagatcgagcgggagctgaatggctacctggagtggatcttcaaggccgaggaggtgatgctggccgaggaggacagaaatgctgaggagaagagccccctggatgtgctgaagagagctgccaccaagaagagcagaaatgacctgattcatgctgaggagggagaagatagatttgctgacctgtgtgctgtgggcagcccctttgcccgggccagcctgaagagcggcaagacagagagcagcagctacttccggaggaaggagaagatgttccgcttcttcatccggaggatggtgaaggcccagagcttctactgggtggtgctgtgtgtggtggccctgaacaccctgtgtgtggccatggtgcactacaaccagccccggcggctgaccaccaccctgtactttgctgagtttgtgttcctgggcctcttcctgacagagatgagcctgaagatgtatggcctgggccccaggagctacttccgcagcagcttcaactgctttgattttggagtcatcgtgggctctgtgtttgaggtggtgtgggccgccatcaagccaggcagcagctttggcatctctgtgctgcgggccctgcggctgctgcgcatcttcaaggtgaccaagtactggagcagcctgaggaacctggtggtgtccctgctgaacagcatgaagagcatcatcagcctgctcttcctgctcttcctgttcatcgtggtgtttgccctgctgggcatgcagctgtttggaggccagttcaacttccaggatgagacccccaccaccaactttgacaccttccctgctgccatcctgactgtgttccagatcctgactggagaggactggaatgctgtgatgtaccatggaattgagagccagggcggcgtgtccaagggcatgttcagcagcttctacttcatcgtgctgaccctgtttggaaactacaccctgctgaatgtgttcctggccatcgctgtggacaacctggccaatgcccaggagctgaccaaggatgaggaggagatggaggaggccgccaaccagaagctggccctgcagaaggccaaggaggtggccgaggtgagccccatgtctgctgccaacatcagcattgctgcccggcagcagaacagcgccaaggcccggtctgtgtgggagcagagggccagccagctgcggctgcagaacctgcgggccagctgtgaggccctgtacagcgagatggaccctgaggagcggctgcgctttgccaccaccaggcacctgcggccagacatgaagacccacctggaccggcccctggtggtggagctgggcagagatggagcccggggccctgtgggcggcaaggcccggcctgaggccgctgaggcccctgagggcgtggaccccccaagaagacaccaccgccaccgggacaaggacaagaccccagctgctggggaccaggacagagctgaggcccccaaggccgagagcggggagcccggggcccgggaggagcggccccggccccacaggagccacagcaaggaggccgccggccccccagaggcccggtctgagcggggccggggccctggccctgagggcggccgccgccaccaccggcggggcagccctgaggaggccgctgagcgggagcccaggaggcaccgggcccaccgccaccaggaccccagcaaagaatgtgccggggccaagggggagcggcgggcccggcaccggggcggcccccgggccggcccccgggaggccgagagcggggaggagcccgcccggcggcaccgggcccggcacaaggcccagcctgcccatgaagctgtggagaaggagaccacagagaaggaggccacagagaaggaggccgagatcgtggaggccgacaaggagaaggagctgaggaaccaccagccccgggagccccactgtgacctggagaccagcggcaccgtgacagtgggccccatgcacaccctgcccagcacctgcctgcagaaggtggaggagcagccagaagatgctgacaaccagagaaatgtgaccaggatgggcagccagcccccagaccccaacaccatcgtgcacatccctgtgatgctgaccggccccctgggggaggccaccgtggtgcccagcggaaatgtggacctggagagccaggccgagggcaagaaggaggtggaggctgatgatgtgatgaggagcggcccccggcccatcgtgccctacagctccatgttctgcctgagccccaccaacctgctgcggcgcttctgccactacatcgtgaccatgagatactttgaggtggtgatcctggtggtgattgccctgagcagcatcgccctggccgctgaggaccctgtgaggacagacagccccagaaataatgccctgaagtacctggactacatcttcaccggggtcttcacctttgagatggtgatcaagatgattgacctgggcctgctgctgcaccctggggcctacttccgggacctgtggaacatcctggacttcatcgtggtgtctggggccctggtggcctttgccttcagcggcagcaagggcaaggacatcaacaccatcaagagcctgcgggtgctgcgggtgctgcggcccctgaagaccatcaagaggctgcccaagctgaaggctgtgtttgactgtgtggtgaacagcctgaagaatgtgctgaacatcctgattgtgtacatgctgttcatgttcatctttgctgtgattgctgtgcagctgttcaagggcaagttcttctactgcacagatgagagcaaggagctggagcgggactgccggggccagtacctggactatgagaaggaggaggtggaggcccagccccggcagtggaagaagtatgacttccactatgacaacgtgctgtgggccctgctgaccctcttcaccgtgtccactggagagggctggcccatggtgctgaagcacagcgtggatgccacctatgaggagcagggccccagccctggctacaggatggagctgagcatcttctacgtggtgtactttgtggtgttccccttcttctttgtgaacatctttgtggccctgatcatcatcaccttccaggagcagggcgacaaggtgatgtctgaatgttccctggagaagaatgaaagagcctgcatcgactttgccatcagcgccaagcccctgacccgctacatgccccagaaccggcagagcttccagtacaagacctggacctttgtggtgtccccaccatttgagtacttcatcatggccatgattgccctgaacacagtggtgctgatgatgaagttctatgatgccccctatgaatatgagctgatgctgaagtgcctgaacatcgtgttcacctccatgttctccatggagtgtgtgctgaagatcatcgcctttggagtgctgaactacttcagagatgcctggaatgtgtttgattttgtgacagtgctgggcagcatcacagacatcctggtgacagaaattgctgagaccaacaacttcatcaacctgtccttcctgcggctcttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaacatcgccctggatgatgacaccagcatcaacagacacaacaacttccgcaccttcctgcaggccctgatgctgctcttccgcagcgccactggagaggcctggcatgagatcatgctgagctgcctgagcaaccaggcctgtgatgagcaggccaatgccacagaatgtggcagtgactttgcctacttctactttgtgtccttcatcttcctgtgcagcttcctgatgctgaacctgtttgtggccgtcatcatggacaactttgagtacctgacccgggacagcagcatcctgggcccccaccacctggatgagttcatccgggtgtgggccgagtatgaccctgctgcctgtggccgcatctcctacaatgacatgtttgagatgctgaagcacatgagcccccccctgggcctgggcaagaagtgcccagcccgggtggcctacaagaggctggtgaggatgaacatgcccatcagcaatgaagacatgacagtgcacttcaccagcaccctgatggccctgatcagaacagccctggagatcaagctggccccagctggcaccaagcagcaccagtgtgatgctgagctgaggaaggagatctctgtggtgtgggccaacctgccccagaagaccctggacctgctggtgcccccccacaagccagatgagatgacagtgggcaaggtgtatgctgccctgatgatctttgacttctacaagcagaacaagaccacccgggaccagatgcagcaggcccctgggggcctgagccagatgggccctgtgtccctcttccaccccctgaaggccaccctggagcagacccagcctgctgtgctgcggggggcccgggtcttcctgcggcagaagagcagcaccagcctgagcaatggaggagccatccagaaccaggagagcggcatcaaggagagcgtgtcctggggcacccagaggacccaggatgcccctcatgaggcccggccccccctggagcggggccacagcacagagatccctgtgggccgcagcggggccctggccgtggatgtgcagatgcagagcatcacccggcggggcccagatggagagccccagcccggcctggagagccagggccgggccgcctccatgccccggctggccgctgagacccagcctgtgacagatgccagccccatgaagaggagcatcagcaccctggcccagaggccccggggcacccacctgtgcagcaccaccccagaccggcccccacccagccaggccagcagccaccaccaccaccaccgctgccacagaagaagagacaggaagcagaggagcctggagaagggccccagcctgtctgctgacatggatggagcccccagcagcgctgtgggccctggcctgcccccaggagagggccccaccggctgcagaagagagcgggagcggcggcaggagcggggccgcagccaggagcggcggcagcccagcagcagcagcagcgagaagcagcgcttctacagctgtgacagatttggaggccgggagccccccaagcccaagcccagcctgagcagccaccccaccagccccacagctggccaggagcccggcccccacccccagggcagcggctctgtgaatggcagccccctgctgagcaccagcggggccagcaccccaggccggggcggccggcggcagctgccccagacccccctgaccccccggcccagcatcacctacaagacagccaacagcagccccatccactttgctggggcccagaccagcctgcctgccttcagccctggccgcctgagccggggcctgtctgagcacaatgccctgctgcagagggaccccctgagccagcccctggcccctggcagccgcatcggcagtgacccctacctgggccagaggctggacagcgaggcctctgtgcacgccctgcctgaggacaccctgacctttgaggaggccgtggccaccaacagcggccgcagcagcaggaccagctatgtgagcagcctgaccagccagagccaccccctgcggcgggtgcccaacggctaccactgcaccctgggcctgagcagcggcggccgggcccggcacagctaccaccacccagaccaggaccactggtgctag

SEQ ID NO: 145854 - DNA, 498 bp, Artificial Sequence
  Description of Artificial Sequence: Synthetic coding sequence
tgaaacttccgcaccttcctgcaggccctgatgctgctcttccgcagcgccaccggggaggcctggcatgagatcatgctgagctgcctgagcaaccaggcctgtgatgagcaggccaatgccacagaatgtggcagtgactttgcctacttctactttgtgtccttcatcttcctgtgcagcttcctgatgctgaacctgtttgtggccgtcatcatggacaactttgagtacctgacccgggacagcagcatcctgggcccccaccacctggatgagttcatccgggtgtgggccgagtatgaccctgctgcctgctgccgcatccactacaaggacatgtacagcctgctgcgctgcatcgcccctcctgtgggcctgggcaagaactgcccccggcggctggcctacaagaggctggtgaggatgaacatgcccatcagcaatgaagacatgacagtgcacttcaccagcaccctgatggccctgatcagatag

SEQ ID NO: 145855 - DNA, 564 bp, Artificial Sequence
  Description of Artificial Sequence: Synthetic coding sequence
ctgaggaaccaccagccccgggagccccactgtgacctggagaccagcggcaccgtgacagtgggccccatgcacaccctgcccagcacctgcctgcagaaggtggaggagcagccagaagatgctgacaaccagagaaatgtgaccaggatgggcagccagcccccagaccccaacaccatcgtgcacatccctgtgatgctgaccggccccctgggggaggccaccgtggtgcccagccccaccatcggccgcctgcaggccgaggagcagggcgagcccgcccgggtgtccaagctgaacctggagagtgatgtgcggggccaggaggccagcagcactggagagcgctaccgcctgggcggcggcaatgtggacctggagagccaggccgagggcaagaaggaggtggaggctgatgatgtgatgaggagcggcccccggcccatcgtgccctacagctccatgttctgcctgagccccaccaacctgctgcggcgcttctgccactacatcgtgaccatgagatactttgaggtggtgatcctggtggtgattgcctag

SEQ ID NO: 145856 - DNA, 6786 bp, Artificial Sequence
  Description of Artificial Sequence: Synthetic coding sequence
atggccaggtttggagatgagatgcctgcccgctatggaggcggcggcagcggggctgctgctggggtggtggtgggcagcggcggcggcagaggagctgggggcagccggcagggcggccagcccggggcccagaggatgtacaagcagagcatggcccagagggcccggaccatggccctgtacaaccccatccctgtgcggcagaactgcctgactgtgaacagaagcctcttcctgttctctgaagataatgtggtgaggaaatatgccaagaagatcacagagtggcccccatttgagtacatgatcctggccaccatcatcgccaactgcatcgtgctggccctggagcagcacctgcctgatgatgacaagacccccatgtctgagcggctggatgacacagagccctacttcatcggcatcttctgctttgaggccggcatcaagatcatcgccctgggctttgccttccacaagggcagctacctgagaaatggctggaatgtgatggactttgtggtggtgctgaccggcatcctggccaccgtgggcacagaatttgacctgcggaccctgcgggctgtgcgggtgctgcggcccctgaagctggtgtctggcatccccagcctgcaggtggtgctgaagagcatcatgaaggccatgatccccctgctgcagatcggcctgctgctcttctttgccatcctgatctttgccatcatcggcctggagttctacatgggcaagttccacaccacctgctttgaggagggcacagatgacatccagggcgagagccctgccccctgtggcacagaggagcccgcccggacctgccccaacggcaccaagtgccagccctactgggagggccccaacaacggcatcacccagtttgacaacatcctgtttgctgtgctgaccgtcttccagtgcatcaccatggagggctggacagacctgctgtacaacagcaatgatgccagcggcaacacctggaactggctgtacttcatccccctcatcatcatcggcagcttcttcatgctgaacctggtgctgggcgtgctgagcggggagtttgccaaggagcgggagcgggtggagaacagaagagccttcctgaagctgcggcggcagcagcagatcgagcgggagctgaatggctacatggagtggatcagcaaggccgaggaggtgatcctggccgaggatgaaacagatggagagcagaggcacccctttgatggagccctgcggaggaccaccatcaagaagagcaagacagacctgctgaaccctgaggaggccgaggaccagctggccgacatcgcctctgtgggcagcccctttgcccgggccagcatcaagagcgccaagctggagaacagcaccttcttccacaagaaggagaggaggatgaggttctacatccggaggatggtgaagacccaggccttctactggacagtgctgagcctggtggccctgaacaccctgtgtgtggccatcgtgcactacaaccagcctgagtggctgagtgacttcctgtactatgcagagttcatcttcctgggcctcttcatgtctgagatgttcatcaagatgtatggcctgggcacccggccctacttccacagcagcttcaactgctttgactgtggggtcatcatcggcagcatctttgaggtgatctgggccgtcatcaagccaggcaccagctttggcatctctgtgctgcgggccctgcggctgctgcgcatcttcaaggtgaccaagtactgggccagcctgaggaacctggtggtgtccctgctgaacagcatgaagagcatcatcagcctgctcttcctgctcttcctgttcatcgtggtgtttgccctgctgggcatgcagctgtttggaggccagttcaactttgatgagggcaccccacccaccaactttgacaccttccctgctgccatcatgaccgtcttccagatcctgaccggggaggactggaatgaggtgatgtatgatggcatcaagagccagggcggcgtgcagggcggcatggtgttcagcatctacttcatcgtgctgaccctgtttggaaactacaccctgctgaatgtgttcctggccatcgctgtggacaacctggccaatgcccaggagctgaccaaggatgagcaggaggaggaggaggccgccaaccagaagctggccctgcagaaggccaaggaggtggccgaggtgagccccctgtctgctgccaacatgagcattgctgtgaaggagcagcagaagaaccagaagccagccaagtctgtgtgggagcagaggaccagcgagatgaggaagcagaacctgctggccagccgggaggccctgtacaatgagatggaccctgatgagcgctggaaggccgcctacaccaggcacctgcggccagacatgaagacccacctggaccggcccctggtggtggacccccaggagaacagaaacaacaacaccaacaagagcagagctgctgagcccaccgtggaccagaggctgggccagcagagagctgaggacttcctgaggaagcaggcccgctaccatgaccgggcccgggaccccagcggcagcgctggcctggatgcccggcggccctgggccggcagccaggaggccgagctgagccgggagggcccctacggccgggagagtgaccaccacgcccgggagggcagcctggagcagcccggcttctgggagggggaggccgagcggggcaaggccggggacccccacagaagacatgtgcaccggcagggcggcagccgggagagccgcagcggcagccccaggactggagcagatggagagcacagaagacaccgggcccacagaagacctggagaggagggccctgaggacaaggccgagcggcgggcccggcaccgggagggcagcaggcctgcccggggcggggagggggagggggagggcccagatggaggagagaggagaagaagacaccgccacggggccccagccacctatgaaggagatgcccggcgggaggacaaggagaggaggcacagaagaaggaaggagaaccagggcagcggcgtgcctgtgtctggccccaacctgagcaccacccggcccatccagcaggacctgggccggcaggacccccccctggccgaggacatcgacaacatgaagaacaacaagctggccacagctgagagcgctgcccctcatggcagcctgggccatgctggcctgccccagagccctgccaagatgggcaacagcacagaccccggccccatgctggccatcccagccatggccaccaacccccagaatgctgccagcaggaggacccccaacaaccctggcaaccccagcaaccctggcccccccaagaccccagagaacagcctcatcgtgaccaaccccagcggcacccagaccaacagcgccaagacagccaggaagccagaccacaccaccgtggacatccccccagcctgccccccacccctgaaccacacagtggtgcaggtgaacaagaatgccaacccagaccccctgcccaagaaggaggaggagaagaaggaggaggaggaggatgacagaggagaagatggccccaagcccatgccaccctacagctccatgttcatcctgagcaccaccaaccccctgcggcggctgtgccactacatcctgaacctgcgctactttgagatgtgcatcctgatggtgattgccatgagcagcatcgccctggccgctgaggaccctgtgcagcccaatgcccccagaaataatgtgctgcgctactttgattatgtgttcaccggggtcttcacctttgagatggtgatcaagatgattgacctgggcctggtgctgcaccagggcgcctacttccgggacctgtggaacatcctggacttcatcgtggtgtctggggccctggtggcctttgccttcaccggcaacagcaagggcaaggacatcaacaccatcaagagcctgcgggtgctgcgggtgctgcggcccctgaagaccatcaagaggctgcccaagctgaaggctgtgtttgactgtgtggtgaacagcctgaagaatgtgttcaacatcctgattgtgtacatgctgttcatgttcatctttgctgtggtggccgtgcagctgttcaagggcaagttcttccactgcacagatgagagcaaggagtttgagaaggactgccggggcaagtacctgctgtatgagaagaatgaggtgaaggcccgggaccgggagtggaagaagtatgagttccactatgacaacgtgctgtgggccctgctgaccctcttcaccgtgtccactggagagggctggccccaggtgctgaagcacagcgtggatgccacctttgagaaccagggccccagccctggctacaggatggagatgagcatcttctacgtggtgtactttgtggtgttccccttcttctttgtgaacatctttgtggccctgatcatcatcaccttccaggagcagggcgacaagatgatggaggagtacagcctggagaagaatgaaagagcctgcatcgactttgccatcagcgccaagcccctgaccaggcacatgccccagaacaagcagagcttccagtacaggatgtggcagtttgtggtgagccccccatttgagtacaccatcatggccatgattgccctgaacaccatcgtgctgatgatgaagttctacggggcctctgtggcctatgaaaatgccctgcgggtcttcaacatcgtgttcaccagcctcttcagcctggagtgtgtgctgaaggtgatggccttcggcatcctgaactacttcagagatgcctggaacatctttgattttgtgacagtgctgggcagcatcacagacatcctggtgacagaatttggaaacaacttcatcaacctgtccttcctgcggctcttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaatattggaattgatgtggaggatgaggacagtgatgaagatgagttccagatcacagagcacaacaacttccgcaccttcttccaggccctgatgctgctcttccgcagcgccaccggggaggcctggcacaacatcatgctgagctgcctgagcggcaagccctgtgacaagaacagcggcatcctgaccagagaatgtggaaatgaatttgcctacttctactttgtgtccttcatcttcctgtgcagcttcctgatgctgaacctgtttgtggccgtcatcatggacaactttgagtacctgacccgggacagcagcatcctgggcccccaccacctggatgaatatgtgcgggtgtgggccgagtatgaccctgctgcctgtggccgcatccactacaaggacatgtacagcctgctgcgggtcatcagcccccccctgggcctgggcaagaagtgcccccaccgggtggcctgcaagaggctgctgaggatggacctgcctgtggctgatgacaacacagtgcacttcaacagcaccctgatggccctgatcagaacagccctggacatcaagatcgccaagggcggcgctgacaagcagcagatggatgctgagctgaggaaggagatgatggccatctggcccaacctgagccagaagaccctggacctgctggtgaccccccacaagagcacagacctgactgtgggcaagatctatgctgccatgatgatcatggagtactaccggcagagcaaggccaagaagctgcaggccatgagggaggagcaggacaggacccccctgatgttccagaggatggagccccccagccccacccaggagggcggccctggccagaatgccctgcccagcacccagctggaccccggcggggccctgatggcccatgaaagtggcctgaaggagagccccagctgggtgacccagagggcccaggagatgttccagaagacaggcacctggagccctgagcagggccccccaacagacatgcccaacagccagcccaacagccagagcgtggagatgagggagatgggcagagatggctacagcgacagcgagcactacctgcccatggagggccagggccgggccgcctccatgccccggctgcctgctgagaaccagaggcggcggggccggccccggggcaacaacctgagcaccatcagtgacaccagccccatgaagaggtctgcctctgtgctgggccccaaggcccggcggctggatgactacagcctggagcgggtgcccccagaggagaaccagaggcaccaccagaggcggcgggacaggagccaccgggccagcgagaggagcctgggccgctacacagatgtggacaccggcctgggcacagacctgtccatgaccacccagagcggggacctgcccagcaaggagcgggaccaggagcggggccggcccaaggacaggaagcaccggcagcaccaccaccaccaccaccaccaccaccaccccccacctccagacaaggacagatatgcccaggagaggccagaccacggccgggcccgggcccgggaccagcgctggagccgcagccccagcgagggccgggagcacatggcccaccggcagtag

SEQ ID NO: 145857 - DNA, 7488 bp, Artificial Sequence
  Description of Artificial Sequence: Synthetic coding sequence
atggccaggtttggagatgagatgcctgcccgctatggaggcggcggcagcggggctgctgctggggtggtggtgggcagcggcggcggcagaggagctgggggcagccggcagggcggccagcccggggcccagaggatgtacaagcagagcatggcccagagggcccggaccatggccctgtacaaccccatccctgtgcggcagaactgcctgactgtgaacagaagcctcttcctgttctctgaagataatgtggtgaggaaatatgccaagaagatcacagagtggcccccatttgagtacatgatcctggccaccatcatcgccaactgcatcgtgctggccctggagcagcacctgcctgatgatgacaagacccccatgtctgagcggctggatgacacagagccctacttcatcggcatcttctgctttgaggccggcatcaagatcatcgccctgggctttgccttccacaagggcagctacctgagaaatggctggaatgtgatggactttgtggtggtgctgaccggcatcctggccaccgtgggcacagaatttgacctgcggaccctgcgggctgtgcgggtgctgcggcccctgaagctggtgtctggcatccccagcctgcaggtggtgctgaagagcatcatgaaggccatgatccccctgctgcagatcggcctgctgctcttctttgccatcctgatctttgccatcatcggcctggagttctacatgggcaagttccacaccacctgctttgaggagggcacagatgacatccagggcgagagccctgccccctgtggcacagaggagcccgcccggacctgccccaacggcaccaagtgccagccctactgggagggccccaacaacggcatcacccagtttgacaacatcctgtttgctgtgctgaccgtcttccagtgcatcaccatggagggctggacagacctgctgtacaacagcaatgatgccagcggcaacacctggaactggctgtacttcatccccctcatcatcatcggcagcttcttcatgctgaacctggtgctgggcgtgctgagcggggagtttgccaaggagcgggagcgggtggagaacagaagagccttcctgaagctgcggcggcagcagcagatcgagcgggagctgaatggctacatggagtggatcagcaaggccgaggaggtgatcctggccgaggatgaaacagatggagagcagaggcacccctttgatggagccctgcggaggaccaccatcaagaagagcaagacagacctgctgaaccctgaggaggccgaggaccagctggccgacatcgcctctgtgggcagcccctttgcccgggccagcatcaagagcgccaagctggagaacagcaccttcttccacaagaaggagaggaggatgaggttctacatccggaggatggtgaagacccaggccttctactggacagtgctgagcctggtggccctgaacaccctgtgtgtggccatcgtgcactacaaccagcctgagtggctgagtgacttcctgtactatgcagagttcatcttcctgggcctcttcatgtctgagatgttcatcaagatgtatggcctgggcacccggccctacttccacagcagcttcaactgctttgactgtggggtcatcatcggcagcatctttgaggtgatctgggccgtcatcaagccaggcaccagctttggcatctctgtgctgcgggccctgcggctgctgcgcatcttcaaggtgaccaagtactgggccagcctgaggaacctggtggtgtccctgctgaacagcatgaagagcatcatcagcctgctcttcctgctcttcctgttcatcgtggtgtttgccctgctgggcatgcagctgtttggaggccagttcaactttgatgagggcaccccacccaccaactttgacaccttccctgctgccatcatgaccgtcttccagatcctgaccggggaggactggaatgaggtgatgtatgatggcatcaagagccagggcggcgtgcagggcggcatggtgttcagcatctacttcatcgtgctgaccctgtttggaaactacaccctgctgaatgtgttcctggccatcgctgtggacaacctggccaatgcccaggagctgaccaaggatgagcaggaggaggaggaggccgccaaccagaagctggccctgcagaaggccaaggaggtggccgaggtgagccccctgtctgctgccaacatgagcattgctgtgaaggagcagcagaagaaccagaagccagccaagtctgtgtgggagcagaggaccagcgagatgaggaagcagaacctgctggccagccgggaggccctgtacaatgagatggaccctgatgagcgctggaaggccgcctacaccaggcacctgcggccagacatgaagacccacctggaccggcccctggtggtggacccccaggagaacagaaacaacaacaccaacaagagcagagctgctgagcccaccgtggaccagaggctgggccagcagagagctgaggacttcctgaggaagcaggcccgctaccatgaccgggcccgggaccccagcggcagcgctggcctggatgcccggcggccctgggccggcagccaggaggccgagctgagccgggagggcccctacggccgggagagtgaccaccacgcccgggagggcagcctggagcagcccggcttctgggagggggaggccgagcggggcaaggccggggacccccacagaagacatgtgcaccggcagggcggcagccgggagagccgcagcggcagccccaggactggagcagatggagagcacagaagacaccgggcccacagaagacctggagaggagggccctgaggacaaggccgagcggcgggcccggcaccgggagggcagcaggcctgcccggggcggggagggggagggggagggcccagatggaggagagaggagaagaagacaccgccacggggccccagccacctatgaaggagatgcccggcgggaggacaaggagaggaggcacagaagaaggaaggagaaccagggcagcggcgtgcctgtgtctggccccaacctgagcaccacccggcccatccagcaggacctgggccggcaggacccccccctggccgaggacatcgacaacatgaagaacaacaagctggccacagctgagagcgctgcccctcatggcagcctgggccatgctggcctgccccagagccctgccaagatgggcaacagcacagaccccggccccatgctggccatcccagccatggccaccaacccccagaatgctgccagcaggaggacccccaacaaccctggcaaccccagcaaccctggcccccccaagaccccagagaacagcctcatcgtgaccaaccccagcggcacccagaccaacagcgccaagacagccaggaagccagaccacaccaccgtggacatccccccagcctgccccccacccctgaaccacacagtggtgcaggtgaacaagaatgccaacccagaccccctgcccaagaaggaggaggagaagaaggaggaggaggaggatgacagaggagaagatggccccaagcccatgccaccctacagctccatgttcatcctgagcaccaccaaccccctgcggcggctgtgccactacatcctgaacctgcgctactttgagatgtgcatcctgatggtgattgccatgagcagcatcgccctggccgctgaggaccctgtgcagcccaatgcccccagaaataatgtgctgcgctactttgattatgtgttcaccggggtcttcacctttgagatggtgatcaagatgattgacctgggcctggtgctgcaccagggcgcctacttccgggacctgtggaacatcctggacttcatcgtggtgtctggggccctggtggcctttgccttcaccggcaacagcaagggcaaggacatcaacaccatcaagagcctgcgggtgctgcgggtgctgcggcccctgaagaccatcaagaggctgcccaagctgaaggctgtgtttgactgtgtggtgaacagcctgaagaatgtgttcaacatcctgattgtgtacatgctgttcatgttcatctttgctgtggtggccgtgcagctgttcaagggcaagttcttccactgcacagatgagagcaaggagtttgagaaggactgccggggcaagtacctgctgtatgagaagaatgaggtgaaggcccgggaccgggagtggaagaagtatgagttccactatgacaacgtgctgtgggccctgctgaccctcttcaccgtgtccactggagagggctggccccaggtgctgaagcacagcgtggatgccacctttgagaaccagggccccagccctggctacaggatggagatgagcatcttctacgtggtgtactttgtggtgttccccttcttctttgtgaacatctttgtggccctgatcatcatcaccttccaggagcagggcgacaagatgatggaggagtacagcctggagaagaatgaaagagcctgcatcgactttgccatcagcgccaagcccctgaccaggcacatgccccagaacaagcagagcttccagtacaggatgtggcagtttgtggtgagccccccatttgagtacaccatcatggccatgattgccctgaacaccatcgtgctgatgatgaagttctacggggcctctgtggcctatgaaaatgccctgcgggtcttcaacatcgtgttcaccagcctcttcagcctggagtgtgtgctgaaggtgatggccttcggcatcctgaactacttcagagatgcctggaacatctttgattttgtgacagtgctgggcagcatcacagacatcctggtgacagaatttggaaacaacttcatcaacctgtccttcctgcggctcttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaatattggaattgatgtggaggatgaggacagtgatgaagatgagttccagatcacagagcacaacaacttccgcaccttcttccaggccctgatgctgctcttccgcagcgccaccggggaggcctggcacaacatcatgctgagctgcctgagcggcaagccctgtgacaagaacagcggcatcctgaccagagaatgtggaaatgaatttgcctacttctactttgtgtccttcatcttcctgtgcagcttcctgatgctgaacctgtttgtggccgtcatcatggacaactttgagtacctgacccgggacagcagcatcctgggcccccaccacctggatgaatatgtgcgggtgtgggccgagtatgaccctgctgcctggggccgcatgccctacctggacatgtaccagatgctgcggcacatgagcccccccctgggcctgggcaagaagtgcccagcccgggtggcctacaagaggctgctgaggatggacctgcctgtggctgatgacaacacagtgcacttcaacagcaccctgatggccctgatcagaacagccctggacatcaagatcgccaagggcggcgctgacaagcagcagatggatgctgagctgaggaaggagatgatggccatctggcccaacctgagccagaagaccctggacctgctggtgaccccccacaagagcacagacctgactgtgggcaagatctatgctgccatgatgatcatggagtactaccggcagagcaaggccaagaagctgcaggccatgagggaggagcaggacaggacccccctgatgttccagaggatggagccccccagccccacccaggagggcggccctggccagaatgccctgcccagcacccagctggaccccggcggggccctgatggcccatgaaagtggcctgaaggagagccccagctgggtgacccagagggcccaggagatgttccagaagacaggcacctggagccctgagcagggccccccaacagacatgcccaacagccagcccaacagccagagcgtggagatgagggagatgggcagagatggctacagcgacagcgagcactacctgcccatggagggccagggccgggccgcctccatgccccggctgcctgctgagaaccagaccatcagtgacaccagccccatgaagaggtctgcctctgtgctgggccccaaggcccggcggctggatgactacagcctggagcgggtgcccccagaggagaaccagaggcaccaccagaggcggcgggacaggagccaccgggccagcgagaggagcctgggccgctacacagatgtggacaccggcctgggcacagacctgtccatgaccacccagagcggggacctgcccagcaaggagcgggaccaggagcggggccggcccaaggacaggaagcaccggcagcaccaccaccaccaccaccaccaccaccaccccccacctccagacaaggacagatatgcccaggagaggccagaccacggccgggcccgggcccgggaccagcgctggagccgcagccccagcgagggccgggagcacatggcccaccggcagggcagcagctctgtgtctggcagccctgcccccagcaccagcggcaccagcaccccaagaagaggccggcggcagctgccccagacccccagcaccccccggccccacgtgtcctacagccctgtgatcaggaaggccggcggcagcggccccccccagcagcagcagcagcagcagcagcagcagcagcagcaggccgtggcccggcccggccgggccgccaccagcggcccccggcgctacccaggccccacagctgagcccctggccggggaccggcccccaactggaggccacagcagcggccgcagccccaggatggagcggcgggtgcccggccctgcccggtctgagagcccccgggcctgccgccacggcggggcccgctggccagccagcggcccccacgtgtctgagggccccccaggccccaggcaccacggctactaccggggcagtgactatgatgaagcagatggccctggcagcggcggcggggaggaggccatggccggggcctatgatgcccctcctcctgtgagacatgccagcagcggggccaccggccgcagccccaggaccccccgggccagcggccctgcctgtgccagccccagcagacatggaagaaggctgcccaacggctactacccagcccacggcctggcccggccccggggccctggcagcaggaagggcctgcacgagccctacagcgagagtgatgatgactggtgctag

SEQ ID NO: 145858 - DNA, 7521 bp, Artificial Sequence
  Description of Artificial Sequence: Synthetic coding sequence
atggccaggtttggagatgagatgcctgcccgctatggaggcggcggcagcggggctgctgctggggtggtggtgggcagcggcggcggcagaggagctgggggcagccggcagggcggccagcccggggcccagaggatgtacaagcagagcatggcccagagggcccggaccatggccctgtacaaccccatccctgtgcggcagaactgcctgactgtgaacagaagcctcttcctgttctctgaagataatgtggtgaggaaatatgccaagaagatcacagagtggcccccatttgagtacatgatcctggccaccatcatcgccaactgcatcgtgctggccctggagcagcacctgcctgatgatgacaagacccccatgtctgagcggctggatgacacagagccctacttcatcggcatcttctgctttgaggccggcatcaagatcatcgccctgggctttgccttccacaagggcagctacctgagaaatggctggaatgtgatggactttgtggtggtgctgaccggcatcctggccaccgtgggcacagaatttgacctgcggaccctgcgggctgtgcgggtgctgcggcccctgaagctggtgtctggcatccccagcctgcaggtggtgctgaagagcatcatgaaggccatgatccccctgctgcagatcggcctgctgctcttctttgccatcctgatctttgccatcatcggcctggagttctacatgggcaagttccacaccacctgctttgaggagggcacagatgacatccagggcgagagccctgccccctgtggcacagaggagcccgcccggacctgccccaacggcaccaagtgccagccctactgggagggccccaacaacggcatcacccagtttgacaacatcctgtttgctgtgctgaccgtcttccagtgcatcaccatggagggctggacagacctgctgtacaacagcaatgatgccagcggcaacacctggaactggctgtacttcatccccctcatcatcatcggcagcttcttcatgctgaacctggtgctgggcgtgctgagcggggagtttgccaaggagcgggagcgggtggagaacagaagagccttcctgaagctgcggcggcagcagcagatcgagcgggagctgaatggctacatggagtggatcagcaaggccgaggaggtgatcctggccgaggatgaaacagatggagagcagaggcacccctttgatgccctgcggaggaccaccatcaagaagagcaagacagacctgctgaaccctgaggaggccgaggaccagctggccgacatcgcctctgtgggcagcccctttgcccgggccagcatcaagagcgccaagctggagaacagcaccttcttccacaagaaggagaggaggatgaggttctacatccggaggatggtgaagacccaggccttctactggacagtgctgagcctggtggccctgaacaccctgtgtgtggccatcgtgcactacaaccagcctgagtggctgagtgacttcctgtactatgcagagttcatcttcctgggcctcttcatgtctgagatgttcatcaagatgtatggcctgggcacccggccctacttccacagcagcttcaactgctttgactgtggggtcatcatcggcagcatctttgaagtcatctgggccgtcatcaagccaggcaccagctttggcatctctgtgctgcgggccctgcggctgctgcgcatcttcaaggtgaccaagtactgggccagcctgaggaacctggtggtgtccctgctgaacagcatgaagagcatcatcagcctgctcttcctgctcttcctgttcatcgtggtgtttgccctgctgggcatgcagctgtttggaggccagttcaactttgatgagggcaccccacccaccaactttgacaccttccctgctgccatcatgacagtgttccagatcctgactggagaggactggaatgaggtgatgtatgatggcatcaagagccagggcggcgtgcagggcggcatggtgttcagcatctacttcatcgtgctgaccctgtttggaaactacaccctgctgaatgtgttcctggccatcgctgtggacaacctggccaatgcccaggagctgaccaaggatgagcaggaggaggaggaggccgccaaccagaagctggccctgcagaaggccaaggaggtggccgaggtgagccccctgtctgctgccaacatgagcattgctgtgaaggagcagcagaagaaccagaagccagccaagtctgtgtgggagcagaggaccagcgagatgaggaagcagaacctgctggccagccgggaggccctgtacaatgagatggaccctgatgagcgctggaaggccgcctacaccaggcacctgcggccagacatgaagacccacctggaccggcccctggtggtggacccccaggagaacagaaacaacaacaccaacaagagcagagctgctgagcccaccgtggaccagaggctgggccagcagagagctgaggacttcctgaggaagcaggcccgctaccatgaccgggcccgggaccccagcggcagcgctggcctggatgcccggcggccctgggccggcagccaggaggccgagctgagccgggagggcccctacggccgggagagtgaccaccacgcccgggagggcagcctggagcagcccggcttctgggagggggaggccgagcggggcaaggccggggacccccaccggcggcacgtgcaccggcagggcggcagccgggagagccgcagcggcagccccaggactggagcagatggagagcaccggcggcaccgggcccaccggcggcctggagaggagggccctgaggacaaggccgagcggcgggcccggcaccgggagggcagcaggcctgcccggggcggggagggggagggggagggcccagatggaggagagaggagaagaagacacagacatggagccccagccacctatgaaggagatgcccggcgggaggacaaggagcggcggcacagaagaagaaaagaaaaccagggcagcggcgtgcctgtgtctggccccaacctgagcaccacccggcccatccagcaggacctgggccggcaggacccccccctggctgaagatattgacaacatgaagaacaacaagctggccacagctgagagcgctgccccccacggcagcctgggccacgccggcctgccccagagccctgccaagatgggcaacagcacagatcctggccccatgctggccatcccagccatggccaccaacccccagaatgctgccagcaggaggacccccaacaaccctggcaaccccagcaaccctggcccccccaagaccccagagaacagcctgattgtgaccaaccccagcggcacccagaccaacagcgccaagacagccaggaagccagaccacaccaccgtggacatccccccagcctgccccccacccctgaaccacacagtggtgcaggtgaacaagaatgccaacccagaccccctgcccaagaaggaggaggagaagaaggaggaggaggaggatgacagaggagaagatggccccaagcccatgccaccctacagctccatgttcatcctgagcaccaccaaccccctgcggcggctgtgccactacatcctgaacctgcgctactttgagatgtgcatcctgatggtgattgccatgagcagcatcgccctggccgcagaagatcctgtgcagcccaatgcccccaggaacaacgtgctgcgctactttgattatgtgttcaccggggtcttcacctttgagatggtgatcaagatgattgacctgggcctggtgctgcaccagggcgcctacttccgggacctgtggaacatcctggacttcatcgtggtgtctggggccctggtggcctttgccttcaccggcaacagcaagggcaaggacatcaacaccatcaagagcctgcgggtgctgcgggtgctgcggcccctgaagaccatcaagaggctgcccaagctgaaggctgtgtttgactgtgtggtgaacagcctgaagaatgtgttcaacatcctgattgtgtacatgctgttcatgttcatctttgctgtggtggccgtgcagctgttcaagggcaagttcttccactgcacagatgagagcaaggagtttgagaaggactgccggggcaagtacctgctgtatgagaagaatgaggtgaaggcccgggaccgggagtggaagaagtatgagttccactatgacaacgtgctgtgggccctgctgaccctcttcaccgtgtccactggagagggctggccccaggtgctgaagcacagcgtggatgccacctttgagaaccagggccccagccctggctacaggatggagatgagcatcttctacgtggtgtactttgtggtgttccccttcttctttgtgaacatctttgtggccctgatcatcatcaccttccaggagcagggcgacaagatgatggaggagtacagcctggagaagaatgaaagagcctgcatcgactttgccatcagcgccaagcccctgaccaggcacatgccccagaacaagcagagcttccagtacaggatgtggcagtttgtggtgtccccaccatttgagtacaccatcatggccatgattgccctgaacaccatcgtgctgatgatgaagttctatggagcctctgtggcctatgaaaatgccctgcgggtcttcaacatcgtgttcaccagcctcttcagcctggagtgtgtgctgaaggtgatggccttcggcatcctgaactacttcagagatgcctggaacatctttgattttgtgacagtgctgggcagcatcacagacatcctggtgacagaatttggaaacaacttcatcaacctgtccttcctgcggctcttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaacatcggcattgatgtggaggatgaagattctgatgaagatgagttccagatcacagagcacaacaacttccgcaccttcttccaggccctgatgctgctcttccgcagcgccactggagaggcctggcacaacatcatgctgagctgcctgagcggcaagccctgtgacaagaacagcggcatcctgacccgggagtgtggaaatgaatttgcctacttctactttgtgtccttcatcttcctgtgcagcttcctgatgctgaacctgtttgtggccgtcatcatggacaactttgagtacctgacccgggacagcagcatcctgggcccccaccacctggatgaatatgtgcgggtgtgggccgagtatgaccctgctgcctggggccgcatgccctacctggacatgtaccagatgctgcggcacatgagcccccccctgggcctgggcaagaagtgcccagcccgggtggcctacaagaggctgctgaggatggacctgcctgtggctgatgacaacacagtgcacttcaacagcaccctgatggccctgatcagaacagccctggacatcaagatcgccaagggcggcgctgacaagcagcagatggatgctgagctgaggaaggagatgatggccatctggcccaacctgagccagaagaccctggacctgctggtgaccccccacaagagcacagacctgactgtgggcaagatctatgctgccatgatgatcatggagtactaccggcagagcaaggccaagaagctgcaggccatgagggaggagcaggacaggacccccctgatgttccagaggatggagccccccagccccacccaggagggcggccctggccagaatgccctgcccagcacccagctggaccctggaggagccctgatggcccacgagagcggcctgaaggagagccccagctgggtgacccagagggcccaggagatgttccagaagacaggcacctggagccctgagcagggccccccaacagacatgcccaacagccagcccaacagccagagcgtggagatgagggagatgggcagagatggctacagcgacagcgagcactacctgcccatggagggccagggccgggccgcctccatgccccggctgcctgctgagaaccagaggagaagaggccggccccggggcaacaacctgagcaccatcagtgacaccagccccatgaagaggtctgcctctgtgctgggccccaaggcccggcggctggatgactacagcctggagcgggtgcccccagaggagaaccagaggcaccaccagaggagaagagacaggagccaccgggccagcgagaggagcctgggccgctacacagatgtggacaccggcctgggcacagacctgtccatgaccacccagagcggggacctgcccagcaaggagcgggaccaggagcggggccggcccaaggacaggaagcaccggcagcaccaccaccaccaccaccaccaccaccaccccccacctccagacaaggacagatatgcccaggagaggccagaccacggccgggcccgggcccgggaccagcgctggagccgcagccccagcgagggccgggagcacatggcccaccggcagggcagcagctctgtgtctggcagccctgcccccagcaccagcggcaccagcaccccccggcggggccggcggcagctgccccagacccccagcaccccccggccccacgtgtcctacagccctgtgatcaggaaggccggcggcagcggccccccccagcagcagcagcagcagcagcagcagcagcagcagcaggccgtggcccggcccggccgggccgccaccagcggcccccggcgctacccaggccccacagctgagcccctggccggggaccggccccccaccggcggccacagcagcggccgcagccccaggatggagaggagagtgcccggccctgcccggtctgagagcccccgggcctgcagacatggaggagcccgctggccagccagcggcccccacgtgtctgagggccccccaggccccaggcaccacggctactaccggggcagtgactatgatgaagcagatggccctggcagcggcggcggggaggaggccatggccggggcctatgatgcccctcctcctgtgagacatgccagcagcggggccaccggccgcagccccaggaccccccgggccagcggccctgcctgtgccagccccagccgccacggccggcggctgcccaacggctactacccagcccacggcctggcccggccccggggccctggcagcaggaagggcctgcacgagccctacagcgagagtgatgatgactggtgctag

SEQ ID NO: 145859 - DNA, 7539 bp, Artificial Sequence
  Description of Artificial Sequence: Synthetic coding sequence
atggccaggtttggagatgagatgcctgcccgctatggaggcggcggcagcggggctgctgctggggtggtggtgggcagcggcggcggcagaggagctgggggcagccggcagggcggccagcccggggcccagaggatgtacaagcagagcatggcccagagggcccggaccatggccctgtacaaccccatccctgtgcggcagaactgcctgactgtgaacagaagcctcttcctgttctctgaagataatgtggtgaggaaatatgccaagaagatcacagagtggcccccatttgagtacatgatcctggccaccatcatcgccaactgcatcgtgctggccctggagcagcacctgcctgatgatgacaagacccccatgtctgagcggctggatgacacagagccctacttcatcggcatcttctgctttgaggccggcatcaagatcatcgccctgggctttgccttccacaagggcagctacctgagaaatggctggaatgtgatggactttgtggtggtgctgaccggcatcctggccaccgtgggcacagaatttgacctgcggaccctgcgggctgtgcgggtgctgcggcccctgaagctggtgtctggcatccccagcctgcaggtggtgctgaagagcatcatgaaggccatgatccccctgctgcagatcggcctgctgctcttctttgccatcctgatctttgccatcatcggcctggagttctacatgggcaagttccacaccacctgctttgaggagggcacagatgacatccagggcgagagccctgccccctgtggcacagaggagcccgcccggacctgccccaacggcaccaagtgccagccctactgggagggccccaacaacggcatcacccagtttgacaacatcctgtttgctgtgctgaccgtcttccagtgcatcaccatggagggctggacagacctgctgtacaacagcaatgatgccagcggcaacacctggaactggctgtacttcatccccctcatcatcatcggcagcttcttcatgctgaacctggtgctgggcgtgctgagcggggagtttgccaaggagcgggagcgggtggagaacagaagagccttcctgaagctgcggcggcagcagcagatcgagcgggagctgaatggctacatggagtggatcagcaaggccgaggaggtgatcctggccgaggatgaaacagatggagagcagaggcacccctttgatggagccctgcggaggaccaccatcaagaagagcaagacagacctgctgaaccctgaggaggccgaggaccagctggccgacatcgcctctgtgggcagcccctttgcccgggccagcatcaagagcgccaagctggagaacagcaccttcttccacaagaaggagaggaggatgaggttctacatccggaggatggtgaagacccaggccttctactggacagtgctgagcctggtggccctgaacaccctgtgtgtggccatcgtgcactacaaccagcctgagtggctgagtgacttcctgtactatgcagagttcatcttcctgggcctcttcatgtctgagatgttcatcaagatgtatggcctgggcacccggccctacttccacagcagcttcaactgctttgactgtggggtcatcatcggcagcatctttgaggtgatctgggccgtcatcaagccaggcaccagctttggcatctctgtgctgcgggccctgcggctgctgcgcatcttcaaggtgaccaagtactgggccagcctgaggaacctggtggtgtccctgctgaacagcatgaagagcatcatcagcctgctcttcctgctcttcctgttcatcgtggtgtttgccctgctgggcatgcagctgtttggaggccagttcaactttgatgagggcaccccacccaccaactttgacaccttccctgctgccatcatgaccgtcttccagatcctgaccggggaggactggaatgaggtgatgtatgatggcatcaagagccagggcggcgtgcagggcggcatggtgttcagcatctacttcatcgtgctgaccctgtttggaaactacaccctgctgaatgtgttcctggccatcgctgtggacaacctggccaatgcccaggagctgaccaaggtggaggctgatgagcaggaggaggaggaggccgccaaccagaagctggccctgcagaaggccaaggaggtggccgaggtgagccccctgtctgctgccaacatgagcattgctgtgaaggagcagcagaagaaccagaagccagccaagtctgtgtgggagcagaggaccagcgagatgaggaagcagaacctgctggccagccgggaggccctgtacaatgagatggaccctgatgagcgctggaaggccgcctacaccaggcacctgcggccagacatgaagacccacctggaccggcccctggtggtggacccccaggagaacagaaacaacaacaccaacaagagcagagctgctgagcccaccgtggaccagaggctgggccagcagagagctgaggacttcctgaggaagcaggcccgctaccatgaccgggcccgggaccccagcggcagcgctggcctggatgcccggcggccctgggccggcagccaggaggccgagctgagccgggagggcccctacggccgggagagtgaccaccacgcccgggagggcagcctggagcagcccggcttctgggagggggaggccgagcggggcaaggccggggacccccaccggcggcacgtgcaccggcagggcggcagccgggagagccgcagcggcagccccaggactggagcagatggagagcaccggcggcaccgggcccaccggcggcctggagaggagggccctgaggacaaggccgagcggcgggcccggcaccgggagggcagcaggcctgcccggggcggggagggggagggggagggcccagatggaggagagaggagaagaagacacagacatggagccccagccacctatgaaggagatgcccggcgggaggacaaggagcggcggcacagaagaagaaaagaaaaccagggcagcggcgtgcctgtgtctggccccaacctgagcaccacccggcccatccagcaggacctgggccggcaggacccccccctggctgaagatattgacaacatgaagaacaacaagctggccacagctgagagcgctgccccccacggcagcctgggccacgccggcctgccccagagccctgccaagatgggcaacagcacagatcctggccccatgctggccatcccagccatggccaccaacccccagaatgctgccagcaggaggacccccaacaaccctggcaaccccagcaaccctggcccccccaagaccccagagaacagcctgattgtgaccaaccccagcggcacccagaccaacagcgccaagacagccaggaagccagaccacaccaccgtggacatccccccagcctgccccccacccctgaaccacacagtggtgcaggtgaacaagaatgccaacccagaccccctgcccaagaaggaggaggagaagaaggaggaggaggaggatgacagaggagaagatggccccaagcccatgccaccctacagctccatgttcatcctgagcaccaccaaccccctgcggcggctgtgccactacatcctgaacctgcgctactttgagatgtgcatcctgatggtgattgccatgagcagcatcgccctggccgcagaagatcctgtgcagcccaatgcccccaggaacaacgtgctgcgctactttgattatgtgttcaccggggtcttcacctttgagatggtgatcaagatgattgacctgggcctggtgctgcaccagggcgcctacttccgggacctgtggaacatcctggacttcatcgtggtgtctggggccctggtggcctttgccttcaccggcaacagcaagggcaaggacatcaacaccatcaagagcctgcgggtgctgcgggtgctgcggcccctgaagaccatcaagaggctgcccaagctgaaggctgtgtttgactgtgtggtgaacagcctgaagaatgtgttcaacatcctgattgtgtacatgctgttcatgttcatctttgctgtggtggccgtgcagctgttcaagggcaagttcttccactgcacagatgagagcaaggagtttgagaaggactgccggggcaagtacctgctgtatgagaagaatgaggtgaaggcccgggaccgggagtggaagaagtatgagttccactatgacaacgtgctgtgggccctgctgaccctcttcaccgtgtccactggagagggctggccccaggtgctgaagcacagcgtggatgccacctttgagaaccagggccccagccctggctacaggatggagatgagcatcttctacgtggtgtactttgtggtgttccccttcttctttgtgaacatctttgtggccctgatcatcatcaccttccaggagcagggcgacaagatgatggaggagtacagcctggagaagaatgaaagagcctgcatcgactttgccatcagcgccaagcccctgaccaggcacatgccccagaacaagcagagcttccagtacaggatgtggcagtttgtggtgtccccaccatttgagtacaccatcatggccatgattgccctgaacaccatcgtgctgatgatgaagttctatggagcctctgtggcctatgaaaatgccctgcgggtcttcaacatcgtgttcaccagcctcttcagcctggagtgtgtgctgaaggtgatggccttcggcatcctgaactacttcagagatgcctggaacatctttgattttgtgacagtgctgggcagcatcacagacatcctggtgacagaatttggaaaccccaacaacttcatcaacctgtccttcctgcggctcttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaacatcggcattgatgtggaggatgaagattctgatgaagatgagttccagatcacagagcacaacaacttccgcaccttcttccaggccctgatgctgctcttccgcagcgccactggagaggcctggcacaacatcatgctgagctgcctgagcggcaagccctgtgacaagaacagcggcatcctgacccgggagtgtggaaatgaatttgcctacttctactttgtgtccttcatcttcctgtgcagcttcctgatgctgaacctgtttgtggccgtcatcatggacaactttgagtacctgacccgggacagcagcatcctgggcccccaccacctggatgaatatgtgcgggtgtgggccgagtatgaccctgctgcctggggccgcatgccctacctggacatgtaccagatgctgcggcacatgagcccccccctgggcctgggcaagaagtgcccagcccgggtggcctacaagaggctgctgaggatggacctgcctgtggctgatgacaacacagtgcacttcaacagcaccctgatggccctgatcagaacagccctggacatcaagatcgccaagggcggcgctgacaagcagcagatggatgctgagctgaggaaggagatgatggccatctggcccaacctgagccagaagaccctggacctgctggtgaccccccacaagagcacagacctgactgtgggcaagatctatgctgccatgatgatcatggagtactaccggcagagcaaggccaagaagctgcaggccatgagggaggagcaggacaggacccccctgatgttccagaggatggagccccccagccccacccaggagggcggccctggccagaatgccctgcccagcacccagctggaccctggaggagccctgatggcccacgagagcggcctgaaggagagccccagctgggtgacccagagggcccaggagatgttccagaagacaggcacctggagccctgagcagggccccccaacagacatgcccaacagccagcccaacagccagagcgtggagatgagggagatgggcagagatggctacagcgacagcgagcactacctgcccatggagggccagggccgggccgcctccatgccccggctgcctgctgagaaccagaggagaagaggccggccccggggcaacaacctgagcaccatcagtgacaccagccccatgaagaggtctgcctctgtgctgggccccaaggcccggcggctggatgactacagcctggagcgggtgcccccagaggagaaccagaggcaccaccagaggagaagagacaggagccaccgggccagcgagaggagcctgggccgctacacagatgtggacaccggcctgggcacagacctgtccatgaccacccagagcggggacctgcccagcaaggagcgggaccaggagcggggccggcccaaggacaggaagcaccggcagcaccaccaccaccaccaccaccaccaccaccccccacctccagacaaggacagatatgcccaggagaggccagaccacggccgggcccgggcccgggaccagcgctggagccgcagccccagcgagggccgggagcacatggcccaccggcagggcagcagctctgtgtctggcagccctgcccccagcaccagcggcaccagcaccccccggcggggccggcggcagctgccccagacccccagcaccccccggccccacgtgtcctacagccctgtgatcaggaaggccggcggcagcggccccccccagcagcagcagcagcagcagcagcagcagcagcagcaggccgtggcccggcccggccgggccgccaccagcggcccccggcgctacccaggccccacagctgagcccctggccggggaccggccccccaccggcggccacagcagcggccgcagccccaggatggagaggagagtgcccggccctgcccggtctgagagcccccgggcctgcagacatggaggagcccgctggccagccagcggcccccacgtgtctgagggccccccaggccccaggcaccacggctactaccggggcagtgactatgatgaagcagatggccctggcagcggcggcggggaggaggccatggccggggcctatgatgcccctcctcctgtgagacatgccagcagcggggccaccggccgcagccccaggaccccccgggccagcggccctgcctgtgccagccccagccgccacggccggcggctgcccaacggctactacccagcccacggcctggcccggccccggggccctggcagcaggaagggcctgcacgagccctacagcgagagtgatgatgactggtgctag

SEQ ID NO: 145860 - DNA, 804 bp, Artificial Sequence
  Description of Artificial Sequence: Synthetic coding sequence
atgctgttcatgttcatctttgctgtggtggccgtgcagctgttcaagggcaagttcttccactgcacagatgagagcaaggagtttgagaaggactgccggggcaagtacctgctgtatgagaagaatgaggtgaaggcccgggaccgggagtggaagaagtatgagttccactatgacaacgtgctgtgggccctgctgaccctcttcaccgtgtccactggagagggctggccccaggtgctgaagcacagcgtggatgccacctttgagaaccagggccccagccctggctacaggatggagatgagcatcttctacgtggtgtactttgtggtgttccccttcttctttgtgaacatctttgtggccctgatcatcatcaccttccaggagcagggcgacaagatgatggaggagtacagcctggagaagaatgaaagagcctgcatcgactttgccatcagcgccaagcccctgaccaggcacatgccccagaacaagcagagcttccagtacaggatgtggcagtttgtggtgagccccccatttgagtacaccatcatggccatgattgccctgaacaccatcgtgctgatgatgaagttctacggggcctctgtggcctatgaaaatgccctgcgggtcttcaacatcgtgttcaccagcctcttcagcctggagtgtgtgctgaaggtgatggccttcggcatcctgaactacttcagagatgcctggaacatctttgattttgtgacagtgctgggcagcatcacagacatcctggtgacagaatttggatag

SEQ ID NO: 145861 - DNA, 6795 bp, Artificial Sequence
  Description of Artificial Sequence: Synthetic coding sequence
atggccctgtacaaccccatccctgtgcggcagaactgcttcaccgtgaacagaagcctcttcatctttggagaggacaacatcgtgaggaaatatgccaagaagctgattgactggcccccatttgagtacatgatcctggccaccatcatcgccaactgcatcgtgctggccctggagcagcacctgcctgaagatgacaagacccccatgagccggcggctggagaagacagagccctacttcatcggcatcttctgctttgaggccggcatcaagatcgtggccctgggcttcatcttccacaagggcagctacctgagaaatggctggaatgtgatggacttcatcgtggtgctgagcggcatcctggccacagctggcacccacttcaacacccacgtggacctgcggaccctgcgggctgtgcgggtgctgcggcccctgaagctggtgtctggcatccccagcctgcagatcgtgctgaagagcatcatgaaggccatggtgcccctgctgcagatcggcctgctgctcttctttgccatcctgatgtttgccatcatcggcctggagttctacagcggcaagctgcaccgggcctgcttcatgaacaacagcggcatcctggagggctttgatcctccccacccctgtggggtgcagggctgcccagctggctatgagtgcaaggactggattggccccaatgatggcatcacccagtttgacaacatcctgtttgctgtgctgaccgtcttccagtgcatcaccatggagggctggaccaccgtgctgtacaacaccaatgatgccctgggcgccacctggaactggctgtacttcatccccctcatcatcatcggcagcttctttgtgctgaacctggtgctgggcgtgctgagcggggagtttgccaaggagcgggagcgggtggagaacagaagagccttcatgaagctgcggcggcagcagcagatcgagcgggagctgaatggctaccgggcctggattgacaaggccgaggaggtgatgctggccgaggagaacaagaatgccggcaccagcgccctggaggtgctgcggcgggccaccatcaagaggagcaggacagaggccatgacccgggacagcagtgatgagcactgtgtggacatcagctctgtgggcacccccctggcccgggccagcatcaagagcgccaaggtggatggagtgtcctacttccgccacaaggagcggctgctgcgcatcagcatccgccacatggtgaagagccaggtgttctactggatcgtgctgagcctggtggccctgaacacagcctgtgtggccatcgtgcaccacaaccagccccagtggctgacccacctgctgtactatgcagagttcctgttcctgggcctcttcctgctggagatgagcctgaagatgtatggcatgggcccccggctgtacttccacagcagcttcaactgctttgattttggagtgacagtgggcagcatctttgaggtggtgtgggccatcttccggcccggcaccagctttggcatctctgtgctgcgggccctgcggctgctgcgcatcttcaagatcaccaagtactgggccagcctgaggaacctggtggtgtccctgatgagctccatgaagagcatcatcagcctgctcttcctgctcttcctgttcatcgtggtgtttgccctgctgggcatgcagctgtttggaggccgcttcaacttcaatgatggcacccccagcgccaactttgacaccttccctgctgccatcatgaccgtcttccagatcctgaccggggaggactggaatgaggtgatgtacaacggcatccgcagccagggcggcgtgagcagcggcatgtggagcgccatctacttcatcgtgctgaccctgtttggaaactacaccctgctgaatgtgttcctggccatcgctgtggacaacctggccaatgcccaggagctgaccaaggatgagcaggaggaggaggaggccttcaaccagaagcacgccctgcagaaggccaaggaggtgagccccatgtctgcccccaacatgcccagcattgagcgggacagaagaagaagacaccacatgtccatgtgggagcccaggagcagccacctgcgggagaggagaagaagacaccacatgtctgtgtgggagcagaggaccagccagctgaggaagcacatgcagatgagcagccaggaggccctgaaccgggaggaggcccccaccatgaaccccctgaaccccctgaaccccctgagcagcctgaaccccctgaatgcccaccccagcctgtacagaagaccccgggccatcgagggcctggccctgggcctggccctggagaagtttgaggaggagcgcatcagccggggcggcagcctgaagggagatggaggagacaggagcagcgccctggacaaccagaggacccccctgagcctgggccagcgggagcccccctggctggcccggccctgccacggcaactgtgaccccacccagcaggaggccggcggcggggaggccgtggtgacctttgaggaccgggcccggcaccggcagagccagaggaggagccgccacagaagagtgaggacagagggcaaggagagcagcagcgccagccgcagccgcagcgccagccaggagaggagcctggatgaggccatgcccacagaaggagagaaggaccacgagctgcggggcaaccacggggccaaggagcccaccatccaggaggagcgggcccaggacctgcggaggaccaacagcctgatggtgtcccggggcagcggcctggccggcggcctggatgaagctgacacccccctggtgctgccccaccctgagctggaggtgggcaagcacgtggtgctgacagagcaggagcctgagggcagcagcgagcaggccctgctgggcaatgtgcagctggacatgggccgggtcatcagccagagcgagccagacctgagctgcatcacagccaacacagacaaggccaccacagagagcacctctgtgacagtggccatcccagatgtggaccccctggtggacagcacagtggtgcacatcagcaacaagacagatggagaggccagccccctgaaggaggccgagatcagagaagatgaggaggaggtggagaagaagaagcagaagaaggagaagcgggagaccgggaaggccatggtgccccacagctccatgttcatcttcagcaccaccaaccccatccggcgggcctgccactacatcgtgaacctgcgctactttgagatgtgcatcctgctggtgattgctgccagcagcatcgccctggccgctgaggaccctgtgctgaccaacagcgagaggaacaaggtgctgcgctactttgattatgtgttcaccggggtcttcacctttgagatggtgatcaagatgattgaccagggcctcatcctgcaggacggcagctacttccgggacctgtggaacatcctggactttgtggtggtggtgggcgccctggtggcctttgccctggccaacagcatgaagaccaacaagggccgggacatcaagaccatcaagagcctgcgggtgctgcgggtgctgcggcccctgaagaccatcaagaggctgcccaagctgaaggctgtgtttgactgtgtggtgaccagcctgaagaatgtgttcaacatcctgattgtgtacaagctgttcatgttcatctttgctgtgattgctgtgcagctgttcaagggcaagttcttctactgcacagacagcagcaaggacacagagaaggaatgtattggcaactacgtggaccacgagaagaacaagatggaggtgaagggccgggagtggaagagacatgagttccactatgacaacatcatctgggccctgctgaccctcttcaccgtgtccactggagagggctggccccaggtgctgcagcacagcgtggatgtgacagaggaggaccggggccccagccgcagcaacaggatggagatgagcatcttctacgtggtgtactttgtggtgttccccttcttctttgtgaacatctttgtggccctgatcatcatcaccttccaggagcagggcgacaagatgatggaggagtgcagcctggagaagaatgaaagagcctgcatcgactttgccatcagcgccaagcccctgacccgctacatgccccagaacagacacaccttccagtacagagtgtggcactttgtggtgagccccagctttgagtacaccatcatggccatgattgccctgaacacagtggtgctgatgatgaagtactacagcgccccctgcacctatgagctggccctgaagtacctgaacatcgccttcaccatggtgttcagcctggagtgtgtgctgaaggtgattgccttcggcttcctgaactacttccgggacacctggaacatctttgacttcatcaccgtcatcggcagcatcacagagatcatcctgacagacagcaagctggtgaacaccagcggcttcaacatgtccttcctgaagctgttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaacatcaagctggatgaggagagccacatcaacagacacaacaacttccgctccttcttcggcagcctgatgctgctcttccgcagcgccaccggggaggcctggcaggagatcatgctgagctgcctgggggagaagggctgtgagccagacaccacagcccccagcggccagaatgaaaatgaaagatgtggcacagacctggcctacgtgtactttgtgtccttcatcttcttctgcagcttcctgatgctgaacctgtttgtggccgtcatcatggacaactttgagtacctgacccgggacagcagcatcctgggcccccaccacctggatgaatttgtgcgggtgtgggccgagtatgacagagctgcctgtggccgcatccactacacagagatgtatgagatgctgaccctgatgagcccccccctgggcctgggcaagcgctgccccagcaaggtggcctacaagaggctggtgctgatgaacatgcctgtggccgaggacatgacagtgcacttcaccagcaccctgatggccctgatcagaacagccctggacatcaagatcgccaagggcggcgctgaccggcagcagctggacagcgagctgcagaaggagaccctggccatctggccccacctgagccagaagatgctggacctgctggtgcccatgcccaaggccagtgacctgactgtgggcaagatctatgctgccatgatgatcatggactactacaagcagagcaaggtgaagaagcagaggcagcagctggaggagcagaagaatgcccccatgttccagaggatggagcccagcagcctgccccaggagatcatcgccaatgccaaggccctgccctacctgcagcaggaccctgtgtctggcctgagcggccgcagcggctaccccagcatgagccccctgagcccccaggacatcttccagctggcctgcatggaccctgcagatgatggccagttccaggagcggcagagcctggagcctgaggtgtctgagctgaagtctgtgcagcccagcaaccacggcatctacctgcccagcgacacccaggagcacgccggcagcggccgggccagctccatgccccggctgactgtggacccccaggtggtgacagaccccagctccatgagaagaagcttcagcaccatccgggacaagaggagcaacagctcctggctggaggagttctccatggagaggagcagcgagaacacctacaagagcagaagaagaagctaccacagcagcctgcggctgagcgcccaccggctgaacagcgacagcggccacaagagtgacacccacaggtctgggggccgggagcggggccgcagcaaggagaggaagcacctgctgagcccagatgtgagccgctgcaacagcgaggagcggggcacccaggccgactgggagagccctgagcggcggcagagccgcagccccagcgagggccgcagccagacccccaaccggcagggcaccggcagcctgtctgagagcagcatccccagcgtgtctgacaccagcaccccccggcgcagccggcggcagctgccccctgtgccccccaagccccggcccctgctgagctacagcagcctcatcagacatgctggcagcatcagccccccagcagatggcagcgaggagggcagccccctgaccagccaggccctggagagcaacaatgcctgcctgacagagagcagcaacagcccccacccccagcagagccagcacgccagcccccagcgctacatcagcgagccctacctggccctgcacgaggacagccacgccagtgactgtggggaggaggagaccctgacctttgaagctgctgtggccaccagcctgggccgcagcaacaccatcggcagcgccccacccctgcggcacagctggcagatgcccaacggccactacagaagaagaagaagaggaggccctggccctggcatgatgtgtggggctgtgaacaacctgctgagtgacacagaggaggatgacaagtgctag

SEQ ID NO: 145862 - DNA, 6609 bp, Artificial Sequence
  Description of Artificial Sequence: Synthetic coding sequence
atggccctgtacaaccccatccctgtgcggcagaactgcttcaccgtgaacagaagcctcttcatctttggagaggacaacatcgtgaggaaatatgccaagaagctgattgactggcccccatttgagtacatgatcctggccaccatcatcgccaactgcatcgtgctggccctggagcagcacctgcctgaagatgacaagacccccatgagccggcggctggagaagacagagccctacttcatcggcatcttctgctttgaggccggcatcaagatcgtggccctgggcttcatcttccacaagggcagctacctgagaaatggctggaatgtgatggacttcatcgtggtgctgagcggcatcctggccacagctggcacccacttcaacacccacgtggacctgcggaccctgcgggctgtgcgggtgctgcggcccctgaagctggtgtctggcatccccagcctgcagatcgtgctgaagagcatcatgaaggccatggtgcccctgctgcagatcggcctgctgctcttctttgccatcctgatgtttgccatcatcggcctggagttctacagcggcaagctgcaccgggcctgcttcatgaacaacagcggcatcctggagggctttgatcctccccacccctgtggggtgcagggctgcccagctggctatgagtgcaaggactggattggccccaatgatggcatcacccagtttgacaacatcctgtttgctgtgctgaccgtcttccagtgcatcaccatggagggctggaccaccgtgctgtacaacaccaatgatgccctgggcgccacctggaactggctgtacttcatccccctcatcatcatcggcagcttctttgtgctgaacctggtgctgggcgtgctgagcggggagtttgccaaggagcgggagcgggtggagaacagaagagccttcatgaagctgcggcggcagcagcagatcgagcgggagctgaatggctaccgggcctggattgacaaggccgaggaggtgatgctggccgaggagaacaagaatgccggcaccagcgccctggaggtgctgcggcgggccaccatcaagaggagcaggacagaggccatgacccgggacagcagtgatgagcactgtgtggacatcagctctgtgggcacccccctggcccgggccagcatcaagagcgccaaggtggatggagtgtcctacttccgccacaaggagcggctgctgcgcatcagcatccgccacatggtgaagagccaggtgttctactggatcgtgctgagcctggtggccctgaacacagcctgtgtggccatcgtgcaccacaaccagccccagtggctgacccacctgctgtactatgcagagttcctgttcctgggcctcttcctgctggagatgagcctgaagatgtatggcatgggcccccggctgtacttccacagcagcttcaactgctttgattttggagtgacagtgggcagcatctttgaggtggtgtgggccatcttccggcccggcaccagctttggcatctctgtgctgcgggccctgcggctgctgcgcatcttcaagatcaccaagtactgggccagcctgaggaacctggtggtgtccctgatgagctccatgaagagcatcatcagcctgctcttcctgctcttcctgttcatcgtggtgtttgccctgctgggcatgcagctgtttggaggccgcttcaacttcaatgatggcacccccagcgccaactttgacaccttccctgctgccatcatgaccgtcttccagatcctgaccggggaggactggaatgaggtgatgtacaacggcatccgcagccagggcggcgtgagcagcggcatgtggagcgccatctacttcatcgtgctgaccctgtttggaaactacaccctgctgaatgtgttcctggccatcgctgtggacaacctggccaatgcccaggagctgaccaaggatgagcaggaggaggaggaggccttcaaccagaagcacgccctgcagaaggccaaggaggtgagccccatgtctgcccccaacatgcccagcattgagcgggagaggagaagaagacaccacatgtctgtgtgggagcagaggaccagccagctgaggaagcacatgcagatgagcagccaggaggccctgaaccgggaggaggcccccaccatgaaccccctgaaccccctgaaccccctgagcagcctgaaccccctgaatgcccaccccagcctgtaccgccggccccgggccatcgagggcctggccctgggcctggccctggagaagtttgaggaggagcgcatcagcagaggaggcagcctgaagggagatggaggagacaggagcagcgccctggacaaccagaggacccccctgagcctgggccagcgggagcccccctggctggcccggccctgccacggcaactgtgaccccacccagcaggaggccggcggcggggaggccgtggtgacctttgaagatcgggcccggcaccggcagagccagaggaggagccgccaccggcgggtgaggacagagggcaaggagagcagcagcgccagccgcagccgcagcgccagccaggagaggagcctggatgaggccatgcccacagaaggagagaaggaccacgagctgcggggcaaccacggggccaaggagcccaccatccaggaggagcgggcccaggacctgcggaggaccaacagcctgatggtgtcccggggcagcggcctggccggcggcctggatgaggccgacacccccctggtgctgccccaccctgagctggaggtgggcaagcacgtggtgctgacagagcaggagcctgagggcagcagcgagcaggccctgctgggcaatgtgcagctggacatgggccgggtcatcagccagagcgagccagacctgagctgcatcacagccaacacagacaaggccaccacagagagcacctctgtgacagtggccatcccagatgtggaccccctggtggacagcacagtggtgcacatcagcaacaagacagatggagaggccagccccctgaaggaggccgagatccgggaggatgaggaggaggtggagaagaagaagcagaagaaggagaagcgggagaccgggaaggccatggtgccccacagctccatgttcatcttcagcaccaccaaccccatcagaagagcctgccactacatcgtgaacctgcgctactttgagatgtgcatcctgctggtgattgctgccagcagcatcgccctggccgcagaagatcctgtgctgaccaacagcgagaggaacaaggtgctgcgctactttgattatgtgttcaccggggtcttcacctttgagatggtgatcaagatgattgaccagggcctcatcctgcaggacggcagctacttccgggacctgtggaacatcctggactttgtggtggtggtgggcgccctggtggcctttgccctggccaacagcatgaagaccaacaagggccgggacatcaagaccatcaagagcctgcgggtgctgcgggtgctgcggcccctgaagaccatcaagaggctgcccaagctgaaggctgtgtttgactgtgtggtgaccagcctgaagaatgtgttcaacatcctgattgtgtacaagctgttcatgttcatctttgctgtgattgctgtgcagctgttcaagggcaagttcttctactgcacagacagcagcaaggacacagagaaggagtgcatcggcaactacgtggaccacgagaagaacaagatggaggtgaagggccgggagtggaagagacatgagttccactatgacaacatcatctgggccctgctgaccctcttcaccgtgtccactggagagggctggccccaggtgctgcagcacagcgtggatgtgacagaagaagatcggggccccagccgcagcaacaggatggagatgagcatcttctacgtggtgtactttgtggtgttccccttcttctttgtgaacatctttgtggccctgatcatcatcaccttccaggagcagggcgacaagatgatggaggagtgcagcctggagaagaatgaaagagcctgcatcgactttgccatcagcgccaagcccctgacccgctacatgccccagaacagacacaccttccagtacagagtgtggcactttgtggtgagccccagctttgagtacaccatcatggccatgattgccctgaacacagtggtgctgatgatgaagtactacagcgccccctgcacctatgagctggccctgaagtacctgaacatcgccttcaccatggtgttcagcctggagtgtgtgctgaaggtgattgccttcggcttcctgaactacttccgggacacctggaacatctttgacttcatcaccgtgattggcagcatcacagagatcatcctgacagacagcaagctggtgaacaccagcggcttcaacatgtccttcctgaagctgttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaacatcaagctggatgaggagagccacatcaacagacacaacaacttccgctccttcttcggcagcctgatgctgctcttccgcagcgccactggagaggcctggcaggagatcatgctgagctgcctgggggagaagggctgtgagccagacaccacagcccccagcggccagaatgaaaatgaaagatgtggcacagacctggcctacgtgtactttgtgtccttcatcttcttctgcagcttcctgatgctgaacctgtttgtggccgtcatcatggacaactttgagtacctgacccgggacagcagcatcctgggcccccaccacctggatgaatttgtgcgggtgtgggccgagtatgaccgggccgcctgtggccgcatcccctacaaggacatgtacaagctggtgcgggtcatcagcccccccctgggcctgggggagaactgcccctacagagtggcctgcaagaggctggtgctgatgaacatgcctgtggccgaggacatgacagtgcacttcaccagcaccctgatggccctgatcagaacagccctggacatcaagatcgccaagggcggcgctgaccggcagcagctggacagcgagctgcagaaggagaccctggccatctggccccacctgagccagaagatgctggacctgctggtgcccatgcccaaggccagtgacctgactgtgggcaagatctatgctgccatgatgatcatggactactacaagcagagcaaggtgaagaagcagaggcagcagctggaggagcagaagaatgcccccatgttccagaggatggagcccagcagcctgccccaggagatcatcgccaatgccaaggccctgccctacctgcagcaggaccctgtgtctggcctgagcggccgcagcggctaccccagcatgagccccctgagcccccaggacatcttccagctggcctgcatggaccctgcagatgatggccagttccaggagcggcagagcctggtggtgacagaccccagctccatgagaagaagcttcagcaccatccgggacaagaggagcaacagctcctggctggaggagttctccatggagaggagcagcgagaacacctacaagagcagaagaagaagctaccacagcagcctgcggctgagcgcccaccggctgaacagcgacagcggccacaagagtgacacccacaggtctgggggccgggagcggggccgcagcaaggagaggaagcacctgctgagcccagatgtgagccgctgcaacagcgaggagcggggcacccaggccgactgggagagccctgagcggcggcagagccgcagccccagcgagggccgcagccagacccccaaccggcagggcaccggcagcctgtctgagagcagcatccccagcgtgtctgacaccagcaccccccggcgcagccggcggcagctgccccctgtgccccccaagccccggcccctgctgagctacagcagcctcatcagacatgctggcagcatcagccccccagcagatggcagcgaggagggcagccccctgaccagccaggccctggagagcaacaatgcctgcctgacagagagcagcaacagcccccacccccagcagagccagcacgccagcccccagcgctacatcagcgagccctacctggccctgcacgaggacagccacgccagtgactgtggggaggaggagaccctgacctttgaagctgctgtggccaccagcctgggccgcagcaacaccatcggcagcgccccacccctgcggcacagctggcagatgcccaacggccactacagaagaagaagaagaggaggccctggccctggcatgatgtgtggggctgtgaacaacctgctgagtgacacagaggaggatgacaagtgctag

SEQ ID NO: 145863 - DNA, 6885 bp, Artificial Sequence
  Description of Artificial Sequence: Synthetic coding sequence
atggccaggtttggagaggccgtggtggcccggcccggcagcggagatggagacagcgaccagagcaggaaccggcagggcacccctgtgcctgccagcggccaggccgccgcctacaagcagaccaaggcccagagggcccggaccatggccctgtacaaccccatccctgtgcggcagaactgcttcaccgtgaacagaagcctcttcatctttggagaggacaacatcgtgaggaaatatgccaagaagctgattgactggcccccatttgagtacatgatcctggccaccatcatcgccaactgcatcgtgctggccctggagcagcacctgcctgaagatgacaagacccccatgagccggcggctggagaagacagagccctacttcatcggcatcttctgctttgaagctggcatcaagatcgtggccctgggcttcatcttccacaagggcagctacctgagaaatggctggaatgtgatggacttcatcgtggtgctgagcggcatcctggccacagctggcacccacttcaacacccacgtggacctgcggaccctgcgggctgtgcgggtgctgcggcccctgaagctggtgtctggcatccccagcctgcagatcgtgctgaagagcatcatgaaggccatggtgcccctgctgcagatcggcctgctgctcttctttgccatcctgatgtttgccatcatcggcctggagttctacagcggcaagctgcaccgggcctgcttcatgaacaacagcggcatcctggagggctttgaccccccccacccctgtggggtgcagggctgcccagctggctatgagtgcaaggactggattggccccaatgatggcatcacccagtttgacaacatcctgtttgctgtgctgactgtgttccagtgcatcaccatggagggctggaccaccgtgctgtacaacaccaatgatgccctgggcgccacctggaactggctgtacttcatccccctcatcatcatcggcagcttctttgtgctgaacctggtgctgggcgtgctgtctggagaatttgccaaggagcgggagcgggtggagaacagaagagccttcatgaagctgcggcggcagcagcagatcgagcgggagctgaatggctaccgggcctggattgacaaggccgaggaggtgatgctggccgaggagaacaagaatgccggcaccagcgccctggaggtgctgcggcgggccaccatcaagaggagcaggacagaggccatgacccgggacagcagtgatgagcactgtgtggacatcagctctgtgggcacccccctggcccgggccagcatcaagagcgccaaggtggatggagtgtcctacttccgccacaaggagcggctgctgcgcatcagcatccgccacatggtgaagagccaggtgttctactggatcgtgctgagcctggtggccctgaacacagcctgtgtggccatcgtgcaccacaaccagccccagtggctgacccacctgctgtactatgcagagttcctgttcctgggcctcttcctgctggagatgagcctgaagatgtatggcatgggcccccggctgtacttccacagcagcttcaactgctttgattttggagtgacagtgggcagcatctttgaggtggtgtgggccatcttccggcccggcaccagctttggcatctctgtgctgcgggccctgcggctgctgcgcatcttcaagatcaccaagtactgggccagcctgaggaacctggtggtgtccctgatgagctccatgaagagcatcatcagcctgctcttcctgctcttcctgttcatcgtggtgtttgccctgctgggcatgcagctgtttggaggccgcttcaacttcaatgatggcaccccatctgccaactttgacaccttccctgctgccatcatgacagtgttccagatcctgactggagaggactggaatgaggtgatgtacaacggcatccgcagccagggcggcgtgagcagcggcatgtggagcgccatctacttcatcgtgctgaccctgtttggaaactacaccctgctgaatgtgttcctggccatcgctgtggacaacctggccaatgcccaggagctgaccaaggatgagcaggaggaggaggaggccttcaaccagaagcacgccctgcagaaggccaaggaggtgagccccatgtctgcccccaacatgcccagcattgaaagagagaggagaagaagacaccacatgtctgtgtgggagcagaggaccagccagctgaggaagcacatgcagatgagcagccaggaggccctgaaccgggaggaggcccccaccatgaaccccctgaaccccctgaaccccctgagcagcctgaaccccctgaatgcccaccccagcctgtacagaagaccccgggccatcgagggcctggccctgggcctggccctggagaagtttgaggaggagcgcatcagccggggcggcagcctgaagggagatggaggagacaggagcagcgccctggacaaccagaggacccccctgagcctgggccagcgggagcccccctggctggcccggccctgccacggcaactgtgaccccacccagcaggaggccggcggcggggaggccgtggtgacctttgaggaccgggcccggcaccggcagagccagaggaggagccgccacagaagagtgaggacagagggcaaggagagcagcagcgccagccgcagccgcagcgccagccaggagaggagcctggatgaggccatgcccacagaaggagagaaggaccacgagctgcggggcaaccacggggccaaggagcccaccatccaggaggagcgggcccaggacctgcggaggaccaacagcctgatggtgtcccggggcagcggcctggccggcggcctggatgaagctgacacccccctggtgctgccccaccctgagctggaggtgggcaagcacgtggtgctgacagagcaggagcctgagggcagcagcgagcaggccctgctgggcaatgtgcagctggacatgggccgggtcatcagccagagcgagccagacctgagctgcatcacagccaacacagacaaggccaccacagagagcacctctgtgacagtggccatcccagatgtggaccccctggtggacagcacagtggtgcacatcagcaacaagacagatggagaggccagccccctgaaggaggccgagatcagagaagatgaggaggaggtggagaagaagaagcagaagaaggagaagcgggagaccgggaaggccatggtgccccacagctccatgttcatcttcagcaccaccaaccccatccggcgggcctgccactacatcgtgaacctgcgctactttgagatgtgcatcctgctggtgattgctgccagcagcatcgccctggccgctgaggaccctgtgctgaccaacagcgagaggaacaaggtgctgcgctactttgattatgtgttcaccggggtcttcacctttgagatggtgatcaagatgattgaccagggcctcatcctgcaggacggcagctacttccgggacctgtggaacatcctggactttgtggtggtggtgggcgccctggtggcctttgccctggccaatgccctgggcaccaacaagggccgggacatcaagaccatcaagagcctgcgggtgctgcgggtgctgcggcccctgaagaccatcaagaggctgcccaagctgaaggctgtgtttgactgtgtggtgaccagcctgaagaatgtgttcaacatcctgattgtgtacaagctgttcatgttcatctttgctgtgattgctgtgcagctgttcaagggcaagttcttctactgcacagacagcagcaaggacacagagaaggaatgtattggcaactacgtggaccacgagaagaacaagatggaggtgaagggccgggagtggaagagacatgagttccactatgacaacatcatctgggccctgctgaccctcttcaccgtgtccactggagagggctggccccaggtgctgcagcacagcgtggatgtgacagaggaggaccggggccccagccgcagcaacaggatggagatgagcatcttctacgtggtgtactttgtggtgttccccttcttctttgtgaacatctttgtggccctgatcatcatcaccttccaggagcagggcgacaagatgatggaggagtgcagcctggagaagaatgaaagagcctgcatcgactttgccatcagcgccaagcccctgacccgctacatgccccagaacagacacaccttccagtacagagtgtggcactttgtggtgagccccagctttgagtacaccatcatggccatgattgccctgaacacagtggtgctgatgatgaagtactacagcgccccctgcacctatgagctggccctgaagtacctgaacatcgccttcaccatggtgttcagcctggagtgtgtgctgaaggtgattgccttcggcttcctgaactacttccgggacacctggaacatctttgacttcatcaccgtcatcggcagcatcacagagatcatcctgacagacagcaagctggtgaacaccagcggcttcaacatgtccttcctgaagctgttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaacatcaagctggatgaggagagccacatcaacagacacaacaacttccgctccttcttcggcagcctgatgctgctcttccgcagcgccaccggggaggcctggcaggagatcatgctgagctgcctgggggagaagggctgtgagccagacaccacagcccccagcggccagaatgaaaatgaaagatgtggcacagacctggcctacgtgtactttgtgtccttcatcttcttctgcagcttcctgatgctgaacctgtttgtggccgtcatcatggacaactttgagtacctgacccgggacagcagcatcctgggcccccaccacctggatgaatttgtgcgggtgtgggccgagtatgacagagctgcctgtggccgcatccactacacagagatgtatgagatgctgaccctgatgagcccccccctgggcctgggcaagcgctgccccagcaaggtggcctacaagaggctggtgctgatgaacatgcctgtggccgaggacatgacagtgcacttcaccagcaccctgatggccctgatcagaacagccctggacatcaagatcgccaagggcggcgctgaccggcagcagctggacagcgagctgcagaaggagaccctggccatctggccccacctgagccagaagatgctggacctgctggtgcccatgcccaaggccagtgacctgactgtgggcaagatctatgctgccatgatgatcatggactactacaagcagagcaaggtgaagaagcagaggcagcagctggaggagcagaagaatgcccccatgttccagaggatggagcccagcagcctgccccaggagatcatcgccaatgccaaggccctgccctacctgcagcaggaccctgtgtctggcctgagcggccgcagcggctaccccagcatgagccccctgagcccccaggacatcttccagctggcctgcatggaccctgcagatgatggccagttccaggagcggcagagcctggagcctgaggtgtctgagctgaagtctgtgcagcccagcaaccacggcatctacctgcccagcgacacccaggagcacgccggcagcggccgggccagctccatgccccggctgactgtggacccccaggtggtgacagaccccagctccatgagaagaagcttcagcaccatccgggacaagaggagcaacagctcctggctggaggagttctccatggagaggagcagcgagaacacctacaagagcagaagaagaagctaccacagcagcctgcggctgagcgcccaccggctgaacagcgacagcggccacaagagtgacacccacaggtctgggggccgggagcggggccgcagcaaggagaggaagcacctgctgagcccagatgtgagccgctgcaacagcgaggagcggggcacccaggccgactgggagagccctgagcggcggcagagccgcagccccagcgagggccgcagccagacccccaaccggcagggcaccggcagcctgtctgagagcagcatccccagcgtgtctgacaccagcaccccccggcgcagccggcggcagctgccccctgtgccccccaagccccggcccctgctgagctacagcagcctcatcagacatgctggcagcatcagccccccagcagatggcagcgaggagggcagccccctgaccagccaggccctggagagcaacaatgcctgcctgacagagagcagcaacagcccccacccccagcagagccagcacgccagcccccagcgctacatcagcgagccctacctggccctgcacgaggacagccacgccagtgactgtggggaggaggagaccctgacctttgaagctgctgtggccaccagcctgggccgcagcaacaccatcggcagcgccccacccctgcggcacagctggcagatgcccaacggccactacagaagaagaagaagaggaggccctggccctggcatgatgtgtggggctgtgaacaacctgctgagtgacacagaggaggatgacaagtgctag

SEQ ID NO: 145864 - DNA, 5634 bp, Artificial Sequence
  Description of Artificial Sequence: Synthetic coding sequence
atgctggccgaggagaacaagaatgccggcaccagcgccctggaggtgctgcggcgggccaccatcaagaggagcaggacagaggccatgacccgggacagcagtgatgagcactgtgtggacatcagctctgtgggcacccccctggcccgggccagcatcaagagcgccaaggtggatggagtgtcctacttccgccacaaggagcggctgctgcgcatcagcatccgccacatggtgaagagccaggtgttctactggatcgtgctgagcctggtggccctgaacacagcctgtgtggccatcgtgcaccacaaccagccccagtggctgacccacctgctgtactatgcagagttcctgttcctgggcctcttcctgctggagatgagcctgaagatgtatggcatgggcccccggctgtacttccacagcagcttcaactgctttgattttggagtgacagtgggcagcatctttgaggtggtgtgggccatcttccggcccggcaccagctttggcatctctgtgctgcgggccctgcggctgctgcgcatcttcaagatcaccaagtactgggccagcctgaggaacctggtggtgtccctgatgagctccatgaagagcatcatcagcctgctcttcctgctcttcctgttcatcgtggtgtttgccctgctgggcatgcagctgtttggaggccgcttcaacttcaatgatggcacccccagcgccaactttgacaccttccctgctgccatcatgaccgtcttccagatcctgaccggggaggactggaatgaggtgatgtacaacggcatccgcagccagggcggcgtgagcagcggcatgtggagcgccatctacttcatcgtgctgaccctgtttggaaactacaccctgctgaatgtgttcctggccatcgctgtggacaacctggccaatgcccaggagctgaccaaggatgagcaggaggaggaggaggccttcaaccagaagcacgccctgcagaaggccaaggaggtgagccccatgtctgcccccaacatgcccagcattgagcgggacagaagaagaagacaccacatgtccatgtgggagcccaggagcagccacctgcgggagaggagaagaagacaccacatgtctgtgtgggagcagaggaccagccagctgaggaagcacatgcagatgagcagccaggaggccctgaaccgggaggaggcccccaccatgaaccccctgaaccccctgaaccccctgagcagcctgaaccccctgaatgcccaccccagcctgtacagaagaccccgggccatcgagggcctggccctgggcctggccctggagaagtttgaggaggagcgcatcagccggggcggcagcctgaagggagatggaggagacaggagcagcgccctggacaaccagaggacccccctgagcctgggccagcgggagcccccctggctggcccggccctgccacggcaactgtgaccccacccagcaggaggccggcggcggggaggccgtggtgacctttgaggaccgggcccggcaccggcagagccagaggaggagccgccacagaagagtgaggacagagggcaaggagagcagcagcgccagccgcagccgcagcgccagccaggagaggagcctggatgaggccatgcccacagaaggagagaaggaccacgagctgcggggcaaccacggggccaaggagcccaccatccaggaggagcgggcccaggacctgcggaggaccaacagcctgatggtgtcccggggcagcggcctggccggcggcctggatgaagctgacacccccctggtgctgccccaccctgagctggaggtgggcaagcacgtggtgctgacagagcaggagcctgagggcagcagcgagcaggccctgctgggcaatgtgcagctggacatgggccgggtcatcagccagagcgagccagacctgagctgcatcacagccaacacagacaaggccaccacagagagcacctctgtgacagtggccatcccagatgtggaccccctggtggacagcacagtggtgcacatcagcaacaagacagatggagaggccagccccctgaaggaggccgagatcagagaagatgaggaggaggtggagaagaagaagcagaagaaggagaagcgggagaccgggaaggccatggtgccccacagctccatgttcatcttcagcaccaccaaccccatccggcgggcctgccactacatcgtgaacctgcgctactttgagatgtgcatcctgctggtgattgctgccagcagcatcgccctggccgctgaggaccctgtgctgaccaacagcgagaggaacaaggtgctgcgctactttgattatgtgttcaccggggtcttcacctttgagatggtgatcaagatgattgaccagggcctcatcctgcaggacggcagctacttccgggacctgtggaacatcctggactttgtggtggtggtgggcgccctggtggcctttgccctggccatgagcctggagaccaacaagggccgggacatcaagaccatcaagagcctgcgggtgctgcgggtgctgcggcccctgaagaccatcaagaggctgcccaagctgaaggctgtgtttgactgtgtggtgaccagcctgaagaatgtgttcaacatcctgattgtgtacaagctgttcatgttcatctttgctgtgattgctgtgcagctgttcaagggcaagttcttctactgcacagacagcagcaaggacacagagaaggaatgtattggcaactacgtggaccacgagaagaacaagatggaggtgaagggccgggagtggaagagacatgagttccactatgacaacatcatctgggccctgctgaccctcttcaccgtgtccactggagagggctggccccaggtgctgcagcacagcgtggatgtgacagaggaggaccggggccccagccgcagcaacaggatggagatgagcatcttctacgtggtgtactttgtggtgttccccttcttctttgtgaacatctttgtggccctgatcatcatcaccttccaggagcagggcgacaagatgatggaggagtgcagcctggagaagaatgaaagagcctgcatcgactttgccatcagcgccaagcccctgacccgctacatgccccagaacagacacaccttccagtacagagtgtggcactttgtggtgagccccagctttgagtacaccatcatggccatgattgccctgaacacagtggtgctgatgatgaagtactacagcgccccctgcacctatgagctggccctgaagtacctgaacatcgccttcaccatggtgttcagcctggagtgtgtgctgaaggtgattgccttcggcttcctgaactacttccgggacacctggaacatctttgacttcatcaccgtcatcggcagcatcacagagatcatcctgacagacagcaagctggtgaacaccagcggcttcaacatgtccttcctgaagctgttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaacatcaagctggatgaggagagccacatcaacagacacaacaacttccgctccttcttcggcagcctgatgctgctcttccgcagcgccaccggggaggcctggcaggagatcatgctgagctgcctgggggagaagggctgtgagccagacaccacagcccccagcggccagaatgaaaatgaaagatgtggcacagacctggcctacgtgtactttgtgtccttcatcttcttctgcagcttcctgatgctgaacctgtttgtggccgtcatcatggacaactttgagtacctgacccgggacagcagcatcctgggcccccaccacctggatgaatttgtgcgggtgtgggccgagtatgacagagctgcctgtggccgcatccactacacagagatgtatgagatgctgaccctgatgagcccccccctgggcctgggcaagcgctgccccagcaaggtggcctacaagaggctggtgctgatgaacatgcctgtggccgaggacatgacagtgcacttcaccagcaccctgatggccctgatcagaacagccctggacatcaagatcgccaagggcggcgctgaccggcagcagctggacagcgagctgcagaaggagaccctggccatctggccccacctgagccagaagatgctggacctgctggtgcccatgcccaaggccagtgacctgactgtgggcaagatctatgctgccatgatgatcatggactactacaagcagagcaaggtgaagaagcagaggcagcagctggaggagcagaagaatgcccccatgttccagaggatggagcccagcagcctgccccaggagatcatcgccaatgccaaggccctgccctacctgcagcaggaccctgtgtctggcctgagcggccgcagcggctaccccagcatgagccccctgagcccccaggacatcttccagctggcctgcatggaccctgcagatgatggccagttccaggagcggcagagcctggtggtgacagaccccagctccatgaggaggagcttcagcaccatccgggacaagaggagcaacagctcctggctggaggagttctccatggagaggagcagcgagaacacctacaagagcagaagaagaagctaccacagcagcctgcggctgagcgcccaccggctgaacagcgacagcggccacaagagtgacacccacaggtctgggggccgggagcggggccgcagcaaggagaggaagcacctgctgagcccagatgtgagccgctgcaacagcgaggagcggggcacccaggccgactgggagagccctgagcggcggcagagccgcagccccagcgagggccgcagccagacccccaaccggcagggcaccggcagcctgtctgagagcagcatccccagcgtgtctgacaccagcaccccaagaagaagccggcggcagctgccccctgtgccccccaagccccggcccctgctgagctacagcagcctcatcagacatgctggcagcatcagccccccagcagatggcagcgaggagggcagccccctgaccagccaggccctggagagcaacaatgcctgcctgacagagagcagcaacagcccccacccccagcagagccagcacgccagcccccagcgctacatcagcgagccctacctggccctgcacgaggacagccacgccagtgactgtggggaggaggagaccctgacctttgaggccgctgtggccaccagcctgggccgcagcaacaccatcggcagcgccccacccctgcggcacagctggcagatgcccaacggccactacagaagaagaagaagaggaggccctggccctggcatgatgtgtggggctgtgaacaacctgctgagtgacacagaagaagatgacaagtgctag

SEQ ID NO: 145865 - DNA, 6813 bp, Artificial Sequence
  Description of Artificial Sequence: Synthetic coding sequence
atggccaggtttggagaggccgtggtggcccggcccggcagcggagatggagacagcgaccagagcaggaaccggcagggcacccctgtgcctgccagcggccaggccgccgcctacaagcagaccaaggcccagagggcccggaccatggccctgtacaaccccatccctgtgcggcagaactgcttcaccgtgaacagaagcctcttcatctttggagaggacaacatcgtgaggaaatatgccaagaagctgattgactggcccccatttgagtacatgatcctggccaccatcatcgccaactgcatcgtgctggccctggagcagcacctgcctgaagatgacaagacccccatgagccggcggctggagaagacagagccctacttcatcggcatcttctgctttgaagctggcatcaagatcgtggccctgggcttcatcttccacaagggcagctacctgagaaatggctggaatgtgatggacttcatcgtggtgctgagcggcatcctggccacagctggcacccacttcaacacccacgtggacctgcggaccctgcgggctgtgcgggtgctgcggcccctgaagctggtgtctggcatccccagcctgcagatcgtgctgaagagcatcatgaaggccatggtgcccctgctgcagatcggcctgctgctcttctttgccatcctgatgtttgccatcatcggcctggagttctacagcggcaagctgcaccgggcctgcttcatgaacaacagcggcatcctggagggctttgaccccccccacccctgtggggtgcagggctgcccagctggctatgagtgcaaggactggattggccccaatgatggcatcacccagtttgacaacatcctgtttgctgtgctgactgtgttccagtgcatcaccatggagggctggaccaccgtgctgtacaacaccaatgatgccctgggcgccacctggaactggctgtacttcatccccctcatcatcatcggcagcttctttgtgctgaacctggtgctgggcgtgctgtctggagaatttgccaaggagcgggagcgggtggagaacagaagagccttcatgaagctgcggcggcagcagcagatcgagcgggagctgaatggctaccgggcctggattgacaaggccgaggaggtgatgctggccgaggagaacaagaatgccggcaccagcgccctggaggtgctgcggcgggccaccatcaagaggagcaggacagaggccatgacccgggacagcagtgatgagcactgtgtggacatcagctctgtgggcacccccctggcccgggccagcatcaagagcgccaaggtggatggagtgtcctacttccgccacaaggagcggctgctgcgcatcagcatccgccacatggtgaagagccaggtgttctactggatcgtgctgagcctggtggccctgaacacagcctgtgtggccatcgtgcaccacaaccagccccagtggctgacccacctgctgtactatgcagagttcctgttcctgggcctcttcctgctggagatgagcctgaagatgtatggcatgggcccccggctgtacttccacagcagcttcaactgctttgattttggagtgacagtgggcagcatctttgaggtggtgtgggccatcttccggcccggcaccagctttggcatctctgtgctgcgggccctgcggctgctgcgcatcttcaagatcaccaagtactgggccagcctgaggaacctggtggtgtccctgatgagctccatgaagagcatcatcagcctgctcttcctgctcttcctgttcatcgtggtgtttgccctgctgggcatgcagctgtttggaggccgcttcaacttcaatgatggcaccccatctgccaactttgacaccttccctgctgccatcatgacagtgttccagatcctgactggagaggactggaatgaggtgatgtacaacggcatccgcagccagggcggcgtgagcagcggcatgtggagcgccatctacttcatcgtgctgaccctgtttggaaactacaccctgctgaatgtgttcctggccatcgctgtggacaacctggccaatgcccaggagctgaccaaggatgagcaggaggaggaggaggccttcaaccagaagcacgccctgcagaaggccaaggaggtgagccccatgtctgcccccaacatgcccagcattgaaagagacagaagaagaagacaccacatgtccatgtgggagcccaggagcagccacctgcgggagaggagaagaagacaccacatgtctgtgtgggagcagaggaccagccagctgaggaagcacatgcagatgagcagccaggaggccctgaaccgggaggaggcccccaccatgaaccccctgaaccccctgaaccccctgagcagcctgaaccccctgaatgcccaccccagcctgtaccgccggccccgggccatcgagggcctggccctgggcctggccctggagaagtttgaggaggagcgcatcagcagaggaggcagcctgaagggagatggaggagacaggagcagcgccctggacaaccagaggacccccctgagcctgggccagcgggagcccccctggctggcccggccctgccacggcaactgtgaccccacccagcaggaggccggcggcggggaggccgtggtgacctttgaagatcgggcccggcaccggcagagccagaggaggagccgccaccggcgggtgaggacagagggcaaggagagcagcagcgccagccgcagccgcagcgccagccaggagaggagcctggatgaggccatgcccacagaaggagagaaggaccacgagctgcggggcaaccacggggccaaggagcccaccatccaggaggagcgggcccaggacctgcggaggaccaacagcctgatggtgtcccggggcagcggcctggccggcggcctggatgaggccgacacccccctggtgctgccccaccctgagctggaggtgggcaagcacgtggtgctgacagagcaggagcctgagggcagcagcgagcaggccctgctgggcaatgtgcagctggacatgggccgggtcatcagccagagcgagccagacctgagctgcatcacagccaacacagacaaggccaccacagagagcacctctgtgacagtggccatcccagatgtggaccccctggtggacagcacagtggtgcacatcagcaacaagacagatggagaggccagccccctgaaggaggccgagatccgggaggatgaggaggaggtggagaagaagaagcagaagaaggagaagcgggagaccgggaaggccatggtgccccacagctccatgttcatcttcagcaccaccaaccccatcagaagagcctgccactacatcgtgaacctgcgctactttgagatgtgcatcctgctggtgattgctgccagcagcatcgccctggccgcagaagatcctgtgctgaccaacagcgagaggaacaaggtgctgcgctactttgattatgtgttcaccggggtcttcacctttgagatggtgatcaagatgattgaccagggcctcatcctgcaggacggcagctacttccgggacctgtggaacatcctggactttgtggtggtggtgggcgccctggtggcctttgccctggccaatgccctgggcaccaacaagggccgggacatcaagaccatcaagagcctgcgggtgctgcgggtgctgcggcccctgaagaccatcaagaggctgcccaagctgaaggctgtgtttgactgtgtggtgaccagcctgaagaatgtgttcaacatcctgattgtgtacaagctgttcatgttcatctttgctgtgattgctgtgcagctgttcaagggcaagttcttctactgcacagacagcagcaaggacacagagaaggagtgcatcggcaactacgtggaccacgagaagaacaagatggaggtgaagggccgggagtggaagagacatgagttccactatgacaacatcatctgggccctgctgaccctcttcaccgtgtccactggagagggctggccccaggtgctgcagcacagcgtggatgtgacagaagaagatcggggccccagccgcagcaacaggatggagatgagcatcttctacgtggtgtactttgtggtgttccccttcttctttgtgaacatctttgtggccctgatcatcatcaccttccaggagcagggcgacaagatgatggaggagtgcagcctggagaagaatgaaagagcctgcatcgactttgccatcagcgccaagcccctgacccgctacatgccccagaacagacacaccttccagtacagagtgtggcactttgtggtgagccccagctttgagtacaccatcatggccatgattgccctgaacacagtggtgctgatgatgaagtactacagcgccccctgcacctatgagctggccctgaagtacctgaacatcgccttcaccatggtgttcagcctggagtgtgtgctgaaggtgattgccttcggcttcctgaactacttccgggacacctggaacatctttgacttcatcaccgtgattggcagcatcacagagatcatcctgacagacagcaagctggtgaacaccagcggcttcaacatgtccttcctgaagctgttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaacatcaagctggatgaggagagccacatcaacagacacaacaacttccgctccttcttcggcagcctgatgctgctcttccgcagcgccactggagaggcctggcaggagatcatgctgagctgcctgggggagaagggctgtgagccagacaccacagcccccagcggccagaatgaaaatgaaagatgtggcacagacctggcctacgtgtactttgtgtccttcatcttcttctgcagcttcctgatgctgaacctgtttgtggccgtcatcatggacaactttgagtacctgacccgggacagcagcatcctgggcccccaccacctggatgaatttgtgcgggtgtgggccgagtatgaccgggccgcctgtggccgcatccactacacagagatgtatgagatgctgaccctgatgagcccccccctgggcctgggcaagcgctgccccagcaaggtggcctacaagaggctggtgctgatgaacatgcctgtggccgaggacatgacagtgcacttcaccagcaccctgatggccctgatcagaacagccctggacatcaagatcgccaagggcggcgctgaccggcagcagctggacagcgagctgcagaaggagaccctggccatctggccccacctgagccagaagatgctggacctgctggtgcccatgcccaaggccagtgacctgactgtgggcaagatctatgctgccatgatgatcatggactactacaagcagagcaaggtgaagaagcagaggcagcagctggaggagcagaagaatgcccccatgttccagaggatggagcccagcagcctgccccaggagatcatcgccaatgccaaggccctgccctacctgcagcaggaccctgtgtctggcctgagcggccgcagcggctaccccagcatgagccccctgagcccccaggacatcttccagctggcctgcatggaccctgcagatgatggccagttccaggagcggcagagcctggtggtgacagaccccagctccatgagaagaagcttcagcaccatccgggacaagaggagcaacagctcctggctggaggagttctccatggagaggagcagcgagaacacctacaagagcagaagaagaagctaccacagcagcctgcggctgagcgcccaccggctgaacagcgacagcggccacaagagtgacacccacaggtctgggggccgggagcggggccgcagcaaggagaggaagcacctgctgagcccagatgtgagccgctgcaacagcgaggagcggggcacccaggccgactgggagagccctgagcggcggcagagccgcagccccagcgagggccgcagccagacccccaaccggcagggcaccggcagcctgtctgagagcagcatccccagcgtgtctgacaccagcaccccccggcgcagccggcggcagctgccccctgtgccccccaagccccggcccctgctgagctacagcagcctcatcagacatgctggcagcatcagccccccagcagatggcagcgaggagggcagccccctgaccagccaggccctggagagcaacaatgcctgcctgacagagagcagcaacagcccccacccccagcagagccagcacgccagcccccagcgctacatcagcgagccctacctggccctgcacgaggacagccacgccagtgactgtggggaggaggagaccctgacctttgaagctgctgtggccaccagcctgggccgcagcaacaccatcggcagcgccccacccctgcggcacagctggcagatgcccaacggccactacagaagaagaagaagaggaggccctggccctggcatgatgtgtggggctgtgaacaacctgctgagtgacacagaggaggatgacaagtgctag

SEQ ID NO: 145866 - DNA, 6942 bp, Artificial Sequence
  Description of Artificial Sequence: Synthetic coding sequence
atggccaggtttggagaggccgtggtggcccggcccggcagcggagatggagacagcgaccagagcaggaaccggcagggcacccctgtgcctgccagcggccaggccgccgcctacaagcagaccaaggcccagagggcccggaccatggccctgtacaaccccatccctgtgcggcagaactgcttcaccgtgaacagaagcctcttcatctttggagaggacaacatcgtgaggaaatatgccaagaagctgattgactggcccccatttgagtacatgatcctggccaccatcatcgccaactgcatcgtgctggccctggagcagcacctgcctgaagatgacaagacccccatgagccggcggctggagaagacagagccctacttcatcggcatcttctgctttgaagctggcatcaagatcgtggccctgggcttcatcttccacaagggcagctacctgagaaatggctggaatgtgatggacttcatcgtggtgctgagcggcatcctggccacagctggcacccacttcaacacccacgtggacctgcggaccctgcgggctgtgcgggtgctgcggcccctgaagctggtgtctggcatccccagcctgcagatcgtgctgaagagcatcatgaaggccatggtgcccctgctgcagatcggcctgctgctcttctttgccatcctgatgtttgccatcatcggcctggagttctacagcggcaagctgcaccgggcctgcttcatgaacaacagcggcatcctggagggctttgaccccccccacccctgtggggtgcagggctgcccagctggctatgagtgcaaggactggattggccccaatgatggcatcacccagtttgacaacatcctgtttgctgtgctgactgtgttccagtgcatcaccatggagggctggaccaccgtgctgtacaacaccaatgatgccctgggcgccacctggaactggctgtacttcatccccctcatcatcatcggcagcttctttgtgctgaacctggtgctgggcgtgctgtctggagaatttgccaaggagcgggagcgggtggagaacagaagagccttcatgaagctgcggcggcagcagcagatcgagcgggagctgaatggctaccgggcctggattgacaaggccgaggaggtgatgctggccgaggagaacaagaatgccggcaccagcgccctggaggtgctgcggcgggccaccatcaagaggagcaggacagaggccatgacccgggacagcagtgatgagcactgtgtggacatcagctctgtgggcacccccctggcccgggccagcatcaagagcgccaaggtggatggagtgtcctacttccgccacaaggagcggctgctgcgcatcagcatccgccacatggtgaagagccaggtgttctactggatcgtgctgagcctggtggccctgaacacagcctgtgtggccatcgtgcaccacaaccagccccagtggctgacccacctgctgtactatgcagagttcctgttcctgggcctcttcctgctggagatgagcctgaagatgtatggcatgggcccccggctgtacttccacagcagcttcaactgctttgattttggagtgacagtgggcagcatctttgaggtggtgtgggccatcttccggcccggcaccagctttggcatctctgtgctgcgggccctgcggctgctgcgcatcttcaagatcaccaagtactgggccagcctgaggaacctggtggtgtccctgatgagctccatgaagagcatcatcagcctgctcttcctgctcttcctgttcatcgtggtgtttgccctgctgggcatgcagctgtttggaggccgcttcaacttcaatgatggcaccccatctgccaactttgacaccttccctgctgccatcatgacagtgttccagatcctgactggagaggactggaatgaggtgatgtacaacggcatccgcagccagggcggcgtgagcagcggcatgtggagcgccatctacttcatcgtgctgaccctgtttggaaactacaccctgctgaatgtgttcctggccatcgctgtggacaacctggccaatgcccaggagctgaccaaggatgagcaggaggaggaggaggccttcaaccagaagcacgccctgcagaaggccaaggaggtgagccccatgtctgcccccaacatgcccagcattgaaagagacagaagaagaagacaccacatgtccatgtgggagcccaggagcagccacctgcgggagaggagaagaagacaccacatgtctgtgtgggagcagaggaccagccagctgaggaagcacatgcagatgagcagccaggaggccctgaaccgggaggaggcccccaccatgaaccccctgaaccccctgaaccccctgagcagcctgaaccccctgaatgcccaccccagcctgtaccgccggccccgggccatcgagggcctggccctgggcctggccctggagaagtttgaggaggagcgcatcagcagaggaggcagcctgaagggagatggaggagacaggagcagcgccctggacaaccagaggacccccctgagcctgggccagcgggagcccccctggctggcccggccctgccacggcaactgtgaccccacccagcaggaggccggcggcggggaggccgtggtgacctttgaagatcgggcccggcaccggcagagccagaggaggagccgccaccggcgggtgaggacagagggcaaggagagcagcagcgccagccgcagccgcagcgccagccaggagaggagcctggatgaggccatgcccacagaaggagagaaggaccacgagctgcggggcaaccacggggccaaggagcccaccatccaggaggagcgggcccaggacctgcggaggaccaacagcctgatggtgtcccggggcagcggcctggccggcggcctggatgaggccgacacccccctggtgctgccccaccctgagctggaggtgggcaagcacgtggtgctgacagagcaggagcctgagggcagcagcgagcaggccctgctgggcaatgtgcagctggacatgggccgggtcatcagccagagcgagccagacctgagctgcatcacagccaacacagacaaggccaccacagagagcacctctgtgacagtggccatcccagatgtggaccccctggtggacagcacagtggtgcacatcagcaacaagacagatggagaggccagccccctgaaggaggccgagatccgggaggatgaggaggaggtggagaagaagaagcagaagaaggagaagcgggagaccgggaaggccatggtgccccacagctccatgttcatcttcagcaccaccaaccccatcagaagagcctgccactacatcgtgaacctgcgctactttgagatgtgcatcctgctggtgattgctgccagcagcatcgccctggccgcagaagatcctgtgctgaccaacagcgagaggaacaaggtgctgcgctactttgattatgtgttcaccggggtcttcacctttgagatggtgatcaagatgattgaccagggcctcatcctgcaggacggcagctacttccgggacctgtggaacatcctggactttgtggtggtggtgggcgccctggtggcctttgccctggccaatgccctgggcaccaacaagggccgggacatcaagaccatcaagagcctgcgggtgctgcgggtgctgcggcccctgaagaccatcaagaggctgcccaagctgaaggctgtgtttgactgtgtggtgaccagcctgaagaatgtgttcaacatcctgattgtgtacaagctgttcatgttcatctttgctgtgattgctgtgcagctgttcaagggcaagttcttctactgcacagacagcagcaaggacacagagaaggagtgcatcggcaactacgtggaccacgagaagaacaagatggaggtgaagggccgggagtggaagagacatgagttccactatgacaacatcatctgggccctgctgaccctcttcaccgtgtccactggagagggctggccccaggtgctgcagcacagcgtggatgtgacagaagaagatcggggccccagccgcagcaacaggatggagatgagcatcttctacgtggtgtactttgtggtgttccccttcttctttgtgaacatctttgtggccctgatcatcatcaccttccaggagcagggcgacaagatgatggaggagtgcagcctggagaagaatgaaagagcctgcatcgactttgccatcagcgccaagcccctgacccgctacatgccccagaacagacacaccttccagtacagagtgtggcactttgtggtgagccccagctttgagtacaccatcatggccatgattgccctgaacacagtggtgctgatgatgaagtactacagcgccccctgcacctatgagctggccctgaagtacctgaacatcgccttcaccatggtgttcagcctggagtgtgtgctgaaggtgattgccttcggcttcctgaactacttccgggacacctggaacatctttgacttcatcaccgtgattggcagcatcacagagatcatcctgacagacagcaagctggtgaacaccagcggcttcaacatgtccttcctgaagctgttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaacatcaagctggatgaggagagccacatcaacagacacaacaacttccgctccttcttcggcagcctgatgctgctcttccgcagcgccactggagaggcctggcaggagatcatgctgagctgcctgggggagaagggctgtgagccagacaccacagcccccagcggccagaatgaaaatgaaagatgtggcacagacctggcctacgtgtactttgtgtccttcatcttcttctgcagcttcctgatgctgaacctgtttgtggccgtcatcatggacaactttgagtacctgacccgggacagcagcatcctgggcccccaccacctggatgaatttgtgcgggtgtgggccgagtatgaccgggccgcctgtggccgcatccactacacagagatgtatgagatgctgaccctgatgagcccccccctgggcctgggcaagcgctgccccagcaaggtggcctacaagaggctggtgctgatgaacatgcctgtggccgaggacatgacagtgcacttcaccagcaccctgatggccctgatcagaacagccctggacatcaagatcgccaagggcggcgctgaccggcagcagctggacagcgagctgcagaaggagaccctggccatctggccccacctgagccagaagatgctggacctgctggtgcccatgcccaaggccagtgacctgactgtgggcaagatctatgctgccatgatgatcatggactactacaagcagagcaaggtgaagaagcagaggcagcagctggaggagcagaagaatgcccccatgttccagaggatggagcccagcagcctgccccaggagatcatcgccaatgccaaggccctgccctacctgcagcaggaccctgtgtctggcctgagcggccgcagcggctaccccagcatgagccccctgagcccccaggacatcttccagctggcctgcatggaccctgcagatgatggccagttccaggagcggcagagcctggagcctgaggtgtctgagctgaagtctgtgcagcccagcaaccacggcatctacctgcccagcgacacccaggagcacgccggcagcggccgggccagctccatgccccggctgactgtggacccccaggtggtgacagaccccagctccatgaggaggagcttcagcaccatccgggacaagaggagcaacagctcctggctggaggagttctccatggagaggagcagcgagaacacctacaagagcagaagaagaagctaccacagcagcctgcggctgagcgcccaccggctgaacagcgacagcggccacaagagtgacacccacaggtctgggggccgggagcggggccgcagcaaggagaggaagcacctgctgagcccagatgtgagccgctgcaacagcgaggagcggggcacccaggccgactgggagagccctgagcggcggcagagccgcagccccagcgagggccgcagccagacccccaaccggcagggcaccggcagcctgtctgagagcagcatccccagcgtgtctgacaccagcaccccaagaagaagccggcggcagctgccccctgtgccccccaagccccggcccctgctgagctacagcagcctcatcagacatgctggcagcatcagccccccagcagatggcagcgaggagggcagccccctgaccagccaggccctggagagcaacaatgcctgcctgacagagagcagcaacagcccccacccccagcagagccagcacgccagcccccagcgctacatcagcgagccctacctggccctgcacgaggacagccacgccagtgactgtggggaggaggagaccctgacctttgaggccgctgtggccaccagcctgggccgcagcaacaccatcggcagcgccccacccctgcggcacagctggcagatgcccaacggccactacagaagaagaagaagaggaggccctggccctggcatgatgtgtggggctgtgaacaacctgctgagtgacacagaagaagatgacaagtgctag

SEQ ID NO: 145867 - DNA, 1317 bp, Artificial Sequence
  Description of Artificial Sequence: Synthetic coding sequence
atggccaggtttggagaggccgtggtggcccggcccggcagcggagatggagacagcgaccagagcaggaaccggcagggcacccctgtgcctgccagcggccaggccgccgcctacaagcagaccaaggcccagagggcccggaccatggccctgtacaaccccatccctgtgcggcagaactgcttcaccgtgaacagaagcctcttcatctttggagaggacaacatcgtgaggaaatatgccaagaagctgattgactggcccccatttgagtacatgatcctggccaccatcatcgccaactgcatcgtgctggccctggagcagcacctgcctgaagatgacaagacccccatgagccggcggctggagaagacagagccctacttcatcggcatcttctgctttgaagctggcatcaagatcgtggccctgggcttcatcttccacaagggcagctacctgagaaatggctggaatgtgatggacttcatcgtggtgctgagcggcatcctggccacagctggcacccacttcaacacccacgtggacctgcggaccctgcgggctgtgcgggtgctgcggcccctgaagctggtgtctggcatccccagcctgcagatcgtgctgaagagcatcatgaaggccatggtgcccctgctgcagatcggcctgctgctcttctttgccatcctgatgtttgccatcatcggcctggagttctacagcggcaagctgcaccgggcctgcttcatgaacaacagcggcatcctggagggctttgaccccccccacccctgtggggtgcagggctgcccagctggctatgagtgcaaggactggattggccccaatgatggcatcacccagtttgacaacatcctgtttgctgtgctgactgtgttccagtgcatcaccatggagggctggaccaccgtgctgtacaacaccaatgatgccctgggcgccacctggaactggctgtacttcatccccctcatcatcatcggcagcttctttgtgctgaacctggtgctgggcgtgctgtctggagaatttgccaaggagcgggagcgggtggagaacagaagagccttcatgaagctgcggcggcagcagcagatcgagcgggagctgaatggctaccgggcctggattgacaaggccgaggaggtgatgctggccgaggagaacaagaatgccggcaccagcgccctggaggtgctgcggcgggccaccatcaagaggagcaggacagaggccatgacccgggacagcagtgatgagcactgtgtggacatcagctctgtgtag

SEQ ID NO: 145868 - DNA, 6756 bp, Artificial Sequence
  Description of Artificial Sequence: Synthetic coding sequence
atggccaggtttggagaggccgtggtggcccggcccggcagcggagatggagacagcgaccagagcaggaaccggcagggcacccctgtgcctgccagcggccaggccgccgcctacaagcagaccaaggcccagagggcccggaccatggccctgtacaaccccatccctgtgcggcagaactgcttcaccgtgaacagaagcctcttcatctttggagaggacaacatcgtgaggaaatatgccaagaagctgattgactggcccccatttgagtacatgatcctggccaccatcatcgccaactgcatcgtgctggccctggagcagcacctgcctgaagatgacaagacccccatgagccggcggctggagaagacagagccctacttcatcggcatcttctgctttgaagctggcatcaagatcgtggccctgggcttcatcttccacaagggcagctacctgagaaatggctggaatgtgatggacttcatcgtggtgctgagcggcatcctggccacagctggcacccacttcaacacccacgtggacctgcggaccctgcgggctgtgcgggtgctgcggcccctgaagctggtgtctggcatccccagcctgcagatcgtgctgaagagcatcatgaaggccatggtgcccctgctgcagatcggcctgctgctcttctttgccatcctgatgtttgccatcatcggcctggagttctacagcggcaagctgcaccgggcctgcttcatgaacaacagcggcatcctggagggctttgaccccccccacccctgtggggtgcagggctgcccagctggctatgagtgcaaggactggattggccccaatgatggcatcacccagtttgacaacatcctgtttgctgtgctgactgtgttccagtgcatcaccatggagggctggaccaccgtgctgtacaacaccaatgatgccctgggcgccacctggaactggctgtacttcatccccctcatcatcatcggcagcttctttgtgctgaacctggtgctgggcgtgctgtctggagaatttgccaaggagcgggagcgggtggagaacagaagagccttcatgaagctgcggcggcagcagcagatcgagcgggagctgaatggctaccgggcctggattgacaaggccgaggaggtgatgctggccgaggagaacaagaatgccggcaccagcgccctggaggtgctgcggcgggccaccatcaagaggagcaggacagaggccatgacccgggacagcagtgatgagcactgtgtggacatcagctctgtgggcacccccctggcccgggccagcatcaagagcgccaaggtggatggagtgtcctacttccgccacaaggagcggctgctgcgcatcagcatccgccacatggtgaagagccaggtgttctactggatcgtgctgagcctggtggccctgaacacagcctgtgtggccatcgtgcaccacaaccagccccagtggctgacccacctgctgtactatgcagagttcctgttcctgggcctcttcctgctggagatgagcctgaagatgtatggcatgggcccccggctgtacttccacagcagcttcaactgctttgattttggagtgacagtgggcagcatctttgaggtggtgtgggccatcttccggcccggcaccagctttggcatctctgtgctgcgggccctgcggctgctgcgcatcttcaagatcaccaagtactgggccagcctgaggaacctggtggtgtccctgatgagctccatgaagagcatcatcagcctgctcttcctgctcttcctgttcatcgtggtgtttgccctgctgggcatgcagctgtttggaggccgcttcaacttcaatgatggcaccccatctgccaactttgacaccttccctgctgccatcatgacagtgttccagatcctgactggagaggactggaatgaggtgatgtacaacggcatccgcagccagggcggcgtgagcagcggcatgtggagcgccatctacttcatcgtgctgaccctgtttggaaactacaccctgctgaatgtgttcctggccatcgctgtggacaacctggccaatgcccaggagctgaccaaggatgagcaggaggaggaggaggccttcaaccagaagcacgccctgcagaaggccaaggaggtgagccccatgtctgcccccaacatgcccagcattgaaagagagaggagaagaagacaccacatgtctgtgtgggagcagaggaccagccagctgaggaagcacatgcagatgagcagccaggaggccctgaaccgggaggaggcccccaccatgaaccccctgaaccccctgaaccccctgagcagcctgaaccccctgaatgcccaccccagcctgtacagaagaccccgggccatcgagggcctggccctgggcctggccctggagaagtttgaggaggagcgcatcagccggggcggcagcctgaagggagatggaggagacaggagcagcgccctggacaaccagaggacccccctgagcctgggccagcgggagcccccctggctggcccggccctgccacggcaactgtgaccccacccagcaggaggccggcggcggggaggccgtggtgacctttgaggaccgggcccggcaccggcagagccagaggaggagccgccacagaagagtgaggacagagggcaaggagagcagcagcgccagccgcagccgcagcgccagccaggagaggagcctggatgaggccatgcccacagaaggagagaaggaccacgagctgcggggcaaccacggggccaaggagcccaccatccaggaggagcgggcccaggacctgcggaggaccaacagcctgatggtgtcccggggcagcggcctggccggcggcctggatgaagctgacacccccctggtgctgccccaccctgagctggaggtgggcaagcacgtggtgctgacagagcaggagcctgagggcagcagcgagcaggccctgctgggcaatgtgcagctggacatgggccgggtcatcagccagagcgagccagacctgagctgcatcacagccaacacagacaaggccaccacagagagcacctctgtgacagtggccatcccagatgtggaccccctggtggacagcacagtggtgcacatcagcaacaagacagatggagaggccagccccctgaaggaggccgagatcagagaagatgaggaggaggtggagaagaagaagcagaagaaggagaagcgggagaccgggaaggccatggtgccccacagctccatgttcatcttcagcaccaccaaccccatccggcgggcctgccactacatcgtgaacctgcgctactttgagatgtgcatcctgctggtgattgctgccagcagcatcgccctggccgctgaggaccctgtgctgaccaacagcgagaggaacaaggtgctgcgctactttgattatgtgttcaccggggtcttcacctttgagatggtgatcaagatgattgaccagggcctcatcctgcaggacggcagctacttccgggacctgtggaacatcctggactttgtggtggtggtgggcgccctggtggcctttgccctggccaatgccctgggcaccaacaagggccgggacatcaagaccatcaagagcctgcgggtgctgcgggtgctgcggcccctgaagaccatcaagaggctgcccaagctgaaggctgtgtttgactgtgtggtgaccagcctgaagaatgtgttcaacatcctgattgtgtacaagctgttcatgttcatctttgctgtgattgctgtgcagctgttcaagggcaagttcttctactgcacagacagcagcaaggacacagagaaggaatgtattggcaactacgtggaccacgagaagaacaagatggaggtgaagggccgggagtggaagagacatgagttccactatgacaacatcatctgggccctgctgaccctcttcaccgtgtccactggagagggctggccccaggtgctgcagcacagcgtggatgtgacagaggaggaccggggccccagccgcagcaacaggatggagatgagcatcttctacgtggtgtactttgtggtgttccccttcttctttgtgaacatctttgtggccctgatcatcatcaccttccaggagcagggcgacaagatgatggaggagtgcagcctggagaagaatgaaagagcctgcatcgactttgccatcagcgccaagcccctgacccgctacatgccccagaacagacacaccttccagtacagagtgtggcactttgtggtgagccccagctttgagtacaccatcatggccatgattgccctgaacacagtggtgctgatgatgaagtactacagcgccccctgcacctatgagctggccctgaagtacctgaacatcgccttcaccatggtgttcagcctggagtgtgtgctgaaggtgattgccttcggcttcctgaactacttccgggacacctggaacatctttgacttcatcaccgtcatcggcagcatcacagagatcatcctgacagacagcaagctggtgaacaccagcggcttcaacatgtccttcctgaagctgttccgggccgcccggctcatcaagctgctgcggcagggctacaccatccgcatcctgctgtggacctttgtgcagagcttcaaggccctgccctacgtgtgcctgctgattgccatgctgttcttcatctatgccatcatcggcatgcaggtgtttggaaacatcaagctggatgaggagagccacatcaacagacacaacaacttccgctccttcttcggcagcctgatgctgctcttccgcagcgccaccggggaggcctggcaggagatcatgctgagctgcctgggggagaagggctgtgagccagacaccacagcccccagcggccagaatgaaaatgaaagatgtggcacagacctggcctacgtgtactttgtgtccttcatcttcttctgcagcttcctgatgctgaacctgtttgtggccgtcatcatggacaactttgagtacctgacccgggacagcagcatcctgggcccccaccacctggatgaatttgtgcgggtgtgggccgagtatgacagagctgcctgtggccgcatccactacacagagatgtatgagatgctgaccctgatgagcccccccctgggcctgggcaagcgctgccccagcaaggtggcctacaagaggctggtgctgatgaacatgcctgtggccgaggacatgacagtgcacttcaccagcaccctgatggccctgatcagaacagccctggacatcaagatcgccaagggcggcgctgaccggcagcagctggacagcgagctgcagaaggagaccctggccatctggccccacctgagccagaagatgctggacctgctggtgcccatgcccaaggccagtgacctgactgtgggcaagatctatgctgccatgatgatcatggactactacaagcagagcaaggtgaagaagcagaggcagcagctggaggagcagaagaatgcccccatgttccagaggatggagcccagcagcctgccccaggagatcatcgccaatgccaaggccctgccctacctgcagcaggaccctgtgtctggcctgagcggccgcagcggctaccccagcatgagccccctgagcccccaggacatcttccagctggcctgcatggaccctgcagatgatggccagttccaggagcggcagagcctggtggtgacagaccccagctccatgaggaggagcttcagcaccatccgggacaagaggagcaacagctcctggctggaggagttctccatggagaggagcagcgagaacacctacaagagcagaagaagaagctaccacagcagcctgcggctgagcgcccaccggctgaacagcgacagcggccacaagagtgacacccacaggtctgggggccgggagcggggccgcagcaaggagaggaagcacctgctgagcccagatgtgagccgctgcaacagcgaggagcggggcacccaggccgactgggagagccctgagcggcggcagagccgcagccccagcgagggccgcagccagacccccaaccggcagggcaccggcagcctgtctgagagcagcatccccagcgtgtctgacaccagcaccccaagaagaagccggcggcagctgccccctgtgccccccaagccccggcccctgctgagctacagcagcctcatcagacatgctggcagcatcagccccccagcagatggcagcgaggagggcagccccctgaccagccaggccctggagagcaacaatgcctgcctgacagagagcagcaacagcccccacccccagcagagccagcacgccagcccccagcgctacatcagcgagccctacctggccctgcacgaggacagccacgccagtgactgtggggaggaggagaccctgacctttgaggccgctgtggccaccagcctgggccgcagcaacaccatcggcagcgccccacccctgcggcacagctggcagatgcccaacggccactacagaagaagaagaagaggaggccctggccctggcatgatgtgtggggctgtgaacaacctgctgagtgacacagaagaagatgacaagtgctag

SEQ ID NO: 145869 - DNA, 7062 bp, Artificial Sequence
  Description of Artificial Sequence: Synthetic coding sequence
atgacagagggcgcccgggcagcagatgaggtgcgggtgcccctgggcgcccctcctcctggccctgctgccctggtgggcgccagccctgagagccctggggcccctggccgggaggccgagcggggcagcgagctgggcgtgagccccagcgagagccctgctgctgagagaggagctgagctgggcgcagatgaggagcagagggtgccctacccagccctggccgccaccgtcttcttctgcctgggccagaccacccggcccaggtcctggtgcctgcggctggtgtgcaacccctggtttgagcacgtgtccatgctggtgatcatgctgaactgtgtgaccctgggcatgttccggccctgtgaagatgtggagtgtggcagcgagcgctgcaacatcctggaggcctttgatgccttcatctttgccttctttgctgtggagatggtgatcaagatggtggccctgggcctgtttggccagaagtgctacctgggggacacctggaaccggctggacttcttcatcgtggtggccggcatgatggagtacagcctggatggccacaacgtgtccctgagcgccatcagaacagtgcgggtgctgcggcccctgcgggccatcaacagagtgcccagcatgaggatcctggtgaccctgctgctggacaccctgcccatgctgggcaatgtgctgctgctgtgcttctttgtgttcttcatcttcggcatcgtgggcgtgcagctgtgggccggcctgctgaggaaccgctgcttcctggacagcgcctttgtgaggaacaacaacctgaccttcctgcggccctactaccagacagaggagggggaggagaaccccttcatctgcagcagccggcgggacaatggcatgcagaagtgcagccacatccctggccggcgggagctgaggatgccctgcaccctgggctgggaggcctacacccagccccaggccgagggcgtgggcgccgccagaaatgcctgcatcaactggaaccagtactacaacgtgtgccgcagcggggacagcaacccccacaacggggccatcaactttgacaacatcggctacgcctggatcgccatcttccaggtgatcaccctggagggctgggtggacatcatgtactacgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggcccggcacctgagcaatgacagcaccctggccagcttcagcgagcccggcagctgctatgaggagctgctgaagtatgtgggccacatcttcaggaaggtgaagagaagaagcctgcggctgtatgcccgctggcagagccgctggaggaagaaggtggaccccagcgctgtgcagggccagggccctggccaccggcagaggagagctggccgccacacagcctctgtgcaccacctggtgtaccaccaccaccaccaccaccaccaccactaccacttcagccacggcagccccaggaggcctggccctgagcccggggcctgtgacacccggctggtgcgggccggggccccacccagcccccccagccctggccggggccccccagatgctgagagcgtgcacagcatctaccacgccgactgccacatcgagggcccccaggagcgggcccgggtggcccacgccgccgccacagctgctgccagcctgcggctggccaccggcctgggcaccatgaactaccccaccatcctgcccagcggcgtgggcagcggcaagggcagcaccagccctggccccaagggcaagtgggccggcggccccccaggcactggaggccacggccccctgagcctgaacagcccagacccctatgagaagatcccccacgtggtgggggagcacggcctgggccaggcccctggccacctgagcggcctgtctgtgccctgccccctgcccagccccccagctggcaccctgacctgtgagctgaagagctgcccctactgcacccgggccctggaggaccctgagggggagctgagcggcagcgagagcggggacagtgatggccggggcgtgtatgagttcacccaggatgtgcgccacggggaccgctgggaccccaccaggcctccccgggccacagacaccccaggccctggccctggcagcccccagaggcgggcccagcagagagctgcccctggagagcccggctggatgggccgcctgtgggtgaccttcagcggcaagctgcggagaattgtggacagcaagtacttcagccggggcatcatgatggccatcctggtgaacaccctgtccatgggcgtggagtaccacgagcagcctgaggagctgaccaatgccctggagatcagcaacatcgtgttcacctccatgtttgccctggagatgctgctgaagctgctggcctgtggccccctgggctacatccggaacccctacaacatctttgatggcatcatcgtggtgatctctgtgtgggagatcgtgggccaggctgatggcggcctgtctgtgctgcggaccttccggctgctgcgggtgctgaagctggtgcgcttcctgcctgccctgcggcggcagctggtggtgctggtgaagaccatggacaacgtggccaccttctgcaccctgctgatgctgttcatcttcatcttcagcatcctgggcatgcacctgtttggctgcaagttcagcctgaagacagacacaggagacacagtgcctgacaggaagaactttgacagcctgctgtgggccatcgtgaccgtcttccagatcctgacccaggaggactggaatgtggtgctgtacaacggcatggccagcaccagctcctgggccgccctgtactttgtggccctgatgacctttggaaactacgtgctcttcaacctgctggtggccatcctggtggagggcttccaggccgagggagatgccaacagaagtgacacagatgaggacaagacctctgtgcactttgaggaggacttccacaagctgcgggagctgcagaccacagagctgaagatgtgcagcctggccgtgaccccaaatggccacctggagggccggggcagcctgagccccccactcatcatgtgcacagctgccacccccatgcccacccccaagagcagccccttcctggatgctgcccccagcctgcctgacagccggcggggcagcagcagcagcggggacccccccctgggggaccagaagcccccagccagcctgcggagcagcccctgtgccccctggggccccagcggggcctggagcagcagaagaagctcctggagcagcctgggccgggcccccagcctgaagaggcggggccagtgtggggagcgggagagcctgctgagcggggagggcaagggcagcacagatgatgaagcagaagatggccgggccgcccctggcccccgggccacccccctgcggcgggcagagagcctggacccccggcccctgcggcctgctgccctgccccccaccaagtgccgggacagagatggccaggtggtggccctgcccagcgacttcttcctgagaattgacagccacagagaagatgctgctgagctggatgatgacagcgaggacagctgctgcctgcggctgcacaaggtgctggagccctacaagccccagtggtgccgcagccgggaggcctgggccctgtacctgttcagcccccagaaccgcttccgggtgtcctgccagaaggtgatcacccacaagatgtttgaccacgtggtgctggtgttcatcttcctgaactgtgtgaccatcgccctggagaggccagacatcgaccccggcagcacagagagggtcttcctgtctgtgagcaactacatcttcaccgccatctttgtggccgagatgatggtgaaggtggtggccctgggcctgctgagcggggagcacgcctacctgcagagctcctggaacctgctggatggcctgctggtgctggtgtccctggtggacatcgtggtggccatggccagcgctgggggcgccaagatcctgggcgtgctgcgggtgctgcggctgctgcggaccctgcggcccctgcgggtcatcagccgggcccctggcctgaagctggtggtggagaccctcatcagcagcctgcggcccatcggcaacatcgtgctgatctgctgtgccttcttcatcatcttcggcatcctgggcgtgcagctgttcaagggcaagttctactactgtgagggccctgacaccaggaacatcagcaccaaggcccagtgcagagctgcccactaccgctgggtgcggaggaagtacaactttgacaacctgggccaggccctgatgagcctgtttgtgctgagcagcaaggatggctgggtgaacatcatgtatgatggcctggatgctgtgggcgtggaccagcagcctgtgcagaaccacaacccctggatgctgctgtacttcatctccttcctgctgattgtgtccttctttgtgctgaacatgtttgtgggcgtggtggtggagaacttccacaagtgccggcagcaccaggaggccgaggaggcccggcggcgggaggagaagaggctgcggcggctggagaggagaagaagaagcaccttccccagccctgaggcccagaggcggccctactatgctgactacagccccaccaggaggagcatccacagcctgtgcaccagccactacctggacctcttcatcaccttcatcatctgtgtgaatgtcatcaccatgtccatggagcactacaaccagcccaagagcctggatgaggccctgaagtactgcaactacgtgttcaccatcgtgtttgtgtttgaggccgccctgaagctggtggccttcggcttccgccgcttcttcaaggaccgctggaaccagctggacctggccatcgtgctgctgagcctgatgggcatcaccctggaggagattgagatgtctgctgccctgcccatcaaccccaccatcatccgcatcatgagggtgctgcgcatcgcccgggtgctgaagctgctgaagatggccaccggcatgagggccctgctggacacagtggtgcaggccctgccccaggtgggcaacctgggcctgctcttcatgctgctcttcttcatctatgctgccctgggcgtggagctgtttggccgcctggagtgcagcgaggacaacccctgtgagggcctgagcagacatgccaccttcagcaactttggcatggccttcctgaccctcttccgggtgtccactggagacaactggaatggcatcatgaaggacaccctgcgggagtgcagccgggaggacaagcactgcctgagctacctgcctgccctgagccctgtgtactttgtgacctttgtgctggtggcccagtttgtgctggtgaatgtggtggtggccgtgctgatgaagcacctggaggagagcaacaaggaggcccgggaggatgctgagctggatgctgagattgagctggagatggcccagggccctggcagcgcccggcgggtggatgctgacaggcctcccctgccccaggagagccctggggccagagatgcccccaacctggtggccaggaaggtgtctgtgtccaggatgctgagcctgcccaatgacagctacatgttccggcctgtggtgcctgccagcgccccccacccccggcccctgcaggaggtggagatggagacctacggggccggcacccccctgggctctgtggcctctgtgcacagccccccagctgagagctgtgccagcctgcagatccccctggccgtgagcagccctgcccggtctggagagcccctgcacgccctgagcccccggggcacagcccggagccccagcctgagccggctgctgtgccggcaggaggccgtgcacacagacagcctggagggcaagattgacagcccccgggacaccctggaccctgctgagcccggggagaagacccctgtgcggcctgtgacccagggcggcagcctgcagagcccccccaggagccccaggcctgcctctgtgaggaccaggaagcacaccttcggccagagatgtgtgagcagcaggcctgctgcccctggaggagaggaggccgaggccagtgaccctgcagatgaggaggtgagccacatcaccagcagcgcctgcccctggcagcccacagctgagccccacggccctgaggccagccctgtggccggcggggagcgggacctgcggcggctgtacagcgtggatgcccagggcttcctggacaagccaggccgggcagatgagcagtggaggccttctgctgagctgggcagcggggagcctggagaggccaaggcctggggccctgaggccgagcccgccctgggcgcccggaggaagaagaagatgagccccccctgcatctctgtggagcccccagcagaagatgagggcagcgcccggcccagcgctgctgagggcggcagcaccaccctgcggcggaggacccccagctgtgaggccaccccccaccgggacagcctggagcccacagagggcagcggggccggcggggaccctgctgccaagggggagcgctggggccaggccagctgcagagctgagcacctgactgtgcccagctttgcctttgagcccctggacctgggcgtgcccagcggggaccccttcctggatggcagccacagcgtgaccccagagagccgggccagcagcagcggggccatcgtgcccctggagcccccagagagcgagccccccatgcctgtgggggaccccccagagaagagaagaggcctgtacctgactgtgccccagtgccccctggagaagccaggcagccccagcgccaccccagcccctgggggcggcgcagatgatcctgtgtag

SEQ ID NO: 145870 - DNA, 7044 bp, Artificial Sequence
  Description of Artificial Sequence: Synthetic coding sequence
atgacagagggcgcccgggcagcagatgaggtgcgggtgcccctgggcgcccctcctcctggccctgctgccctggtgggcgccagccctgagagccctggggcccctggccgggaggccgagcggggcagcgagctgggcgtgagccccagcgagagccctgctgctgagagaggagctgagctgggcgcagatgaggagcagagggtgccctacccagccctggccgccaccgtcttcttctgcctgggccagaccacccggcccaggtcctggtgcctgcggctggtgtgcaacccctggtttgagcacgtgtccatgctggtgatcatgctgaactgtgtgaccctgggcatgttccggccctgtgaagatgtggagtgtggcagcgagcgctgcaacatcctggaggcctttgatgccttcatctttgccttctttgctgtggagatggtgatcaagatggtggccctgggcctgtttggccagaagtgctacctgggggacacctggaaccggctggacttcttcatcgtggtggccggcatgatggagtacagcctggatggccacaacgtgtccctgagcgccatcagaacagtgcgggtgctgcggcccctgcgggccatcaacagagtgcccagcatgaggatcctggtgaccctgctgctggacaccctgcccatgctgggcaatgtgctgctgctgtgcttctttgtgttcttcatcttcggcatcgtgggcgtgcagctgtgggccggcctgctgaggaaccgctgcttcctggacagcgcctttgtgaggaacaacaacctgaccttcctgcggccctactaccagacagaggagggggaggagaaccccttcatctgcagcagccggcgggacaatggcatgcagaagtgcagccacatccctggccggcgggagctgaggatgccctgcaccctgggctgggaggcctacacccagccccaggccgagggcgtgggcgccgccagaaatgcctgcatcaactggaaccagtactacaacgtgtgccgcagcggggacagcaacccccacaacggggccatcaactttgacaacatcggctacgcctggatcgccatcttccaggtgatcaccctggagggctgggtggacatcatgtactacgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggcccggcacctgagcaatgacagcaccctggccagcttcagcgagcccggcagctgctatgaggagctgctgaagtatgtgggccacatcttcaggaaggtgaagagaagaagcctgcggctgtatgcccgctggcagagccgctggaggaagaaggtggaccccagcgctgtgcagggccagggccctggccaccggcagaggagagctggccgccacacagcctctgtgcaccacctggtgtaccaccaccaccaccaccaccaccaccactaccacttcagccacggcagccccaggaggcctggccctgagcccggggcctgtgacacccggctggtgcgggccggggccccacccagcccccccagccctggccggggccccccagatgctgagagcgtgcacagcatctaccacgccgactgccacatcgagggcccccaggagcgggcccgggtggcccacgccgccgccacagctgctgccagcctgcggctggccaccggcctgggcaccatgaactaccccaccatcctgcccagcggcgtgggcagcggcaagggcagcaccagccctggccccaagggcaagtgggccggcggccccccaggcactggaggccacggccccctgagcctgaacagcccagacccctatgagaagatcccccacgtggtgggggagcacggcctgggccaggcccctggccacctgagcggcctgtctgtgccctgccccctgcccagccccccagctggcaccctgacctgtgagctgaagagctgcccctactgcacccgggccctggaggaccctgagggggagctgagcggcagcgagagcggggacagtgatggccggggcgtgtatgagttcacccaggatgtgcgccacggggaccgctgggaccccaccaggcctccccgggccacagacaccccaggccctggccctggcagcccccagaggcgggcccagcagagagctgcccctggagagcccggctggatgggccgcctgtgggtgaccttcagcggcaagctgcggagaattgtggacagcaagtacttcagccggggcatcatgatggccatcctggtgaacaccctgtccatgggcgtggagtaccacgagcagcctgaggagctgaccaatgccctggagatcagcaacatcgtgttcacctccatgtttgccctggagatgctgctgaagctgctggcctgtggccccctgggctacatccggaacccctacaacatctttgatggcatcatcgtggtgatctctgtgtgggagatcgtgggccaggctgatggcggcctgtctgtgctgcggaccttccggctgctgcgggtgctgaagctggtgcgcttcctgcctgccctgcggcggcagctggtggtgctggtgaagaccatggacaacgtggccaccttctgcaccctgctgatgctgttcatcttcatcttcagcatcctgggcatgcacctgtttggctgcaagttcagcctgaagacagacacaggagacacagtgcctgacaggaagaactttgacagcctgctgtgggccatcgtgaccgtcttccagatcctgacccaggaggactggaatgtggtgctgtacaacggcatggccagcaccagctcctgggccgccctgtactttgtggccctgatgacctttggaaactacgtgctcttcaacctgctggtggccatcctggtggagggcttccaggccgagggagatgccaacagaagtgacacagatgaggacaagacctctgtgcactttgaggaggacttccacaagctgcgggagctgcagaccacagagctgaagatgtgcagcctggccgtgaccccaaatggccacctggagggccggggcagcctgagccccccactcatcatgtgcacagctgccacccccatgcccacccccaagagcagccccttcctggatgctgcccccagcctgcctgacagccggcggggcagcagcagcagcggggacccccccctgggggaccagaagcccccagccagcctgcggagcagcccctgtgccccctggggccccagcggggcctggagcagcagaagaagctcctggagcagcctgggccgggcccccagcctgaagaggcggggccagtgtggggagcgggagagcctgctgagcggggagggcaagggcagcacagatgatgaagcagaagatggccgggccgcccctggcccccgggccacccccctgcggcgggcagagagcctggacccccggcccctgcggcctgctgccctgccccccaccaagtgccgggacagagatggccaggtggtggccctgcccagcgacttcttcctgagaattgacagccacagagaagatgctgctgagctggatgatgacagcgaggacagctgctgcctgcggctgcacaaggtgctggagccctacaagccccagtggtgccgcagccgggaggcctgggccctgtacctgttcagcccccagaaccgcttccgggtgtcctgccagaaggtgatcacccacaagatgtttgaccacgtggtgctggtgttcatcttcctgaactgtgtgaccatcgccctggagaggccagacatcgaccccggcagcacagagagggtcttcctgtctgtgagcaactacatcttcaccgccatctttgtggccgagatgatggtgaaggtggtggccctgggcctgctgagcggggagcacgcctacctgcagagctcctggaacctgctggatggcctgctggtgctggtgtccctggtggacatcgtggtggccatggccagcgctgggggcgccaagatcctgggcgtgctgcgggtgctgcggctgctgcggaccctgcggcccctgcgggtcatcagccgggcccctggcctgaagctggtggtggagaccctcatcagcagcctgcggcccatcggcaacatcgtgctgatctgctgtgccttcttcatcatcttcggcatcctgggcgtgcagctgttcaagggcaagttctactactgtgagggccctgacaccaggaacatcagcaccaaggcccagtgcagagctgcccactaccgctgggtgcggaggaagtacaactttgacaacctgggccaggccctgatgagcctgtttgtgctgagcagcaaggatggctgggtgaacatcatgtatgatggcctggatgctgtgggcgtggaccagcagcctgtgcagaaccacaacccctggatgctgctgtacttcatctccttcctgctgattgtgtccttctttgtgctgaacatgtttgtgggcgtggtggtggagaacttccacaagtgccggcagcaccaggaggccgaggaggcccggcggcgggaggagaagaggctgcggcggctggagaggagaagaaggaaggcccagaggcggccctactatgctgactacagccccaccaggaggagcatccacagcctgtgcaccagccactacctggacctcttcatcaccttcatcatctgtgtgaatgtcatcaccatgtccatggagcactacaaccagcccaagagcctggatgaggccctgaagtactgcaactacgtgttcaccatcgtgtttgtgtttgaggccgccctgaagctggtggccttcggcttccgccgcttcttcaaggaccgctggaaccagctggacctggccatcgtgctgctgagcctgatgggcatcaccctggaggagattgagatgtctgctgccctgcccatcaaccccaccatcatccgcatcatgagggtgctgcgcatcgcccgggtgctgaagctgctgaagatggccaccggcatgagggccctgctggacacagtggtgcaggccctgccccaggtgggcaacctgggcctgctcttcatgctgctcttcttcatctatgctgccctgggcgtggagctgtttggccgcctggagtgcagcgaggacaacccctgtgagggcctgagcagacatgccaccttcagcaactttggcatggccttcctgaccctcttccgggtgtccactggagacaactggaatggcatcatgaaggacaccctgcgggagtgcagccgggaggacaagcactgcctgagctacctgcctgccctgagccctgtgtactttgtgacctttgtgctggtggcccagtttgtgctggtgaatgtggtggtggccgtgctgatgaagcacctggaggagagcaacaaggaggcccgggaggatgctgagctggatgctgagattgagctggagatggcccagggccctggcagcgcccggcgggtggatgctgacaggcctcccctgccccaggagagccctggggccagagatgcccccaacctggtggccaggaaggtgtctgtgtccaggatgctgagcctgcccaatgacagctacatgttccggcctgtggtgcctgccagcgccccccacccccggcccctgcaggaggtggagatggagacctacggggccggcacccccctgggctctgtggcctctgtgcacagccccccagctgagagctgtgccagcctgcagatccccctggccgtgagcagccctgcccggtctggagagcccctgcacgccctgagcccccggggcacagcccggagccccagcctgagccggctgctgtgccggcaggaggccgtgcacacagacagcctggagggcaagattgacagcccccgggacaccctggaccctgctgagcccggggagaagacccctgtgcggcctgtgacccagggcggcagcctgcagagcccccccaggagccccaggcctgcctctgtgaggaccaggaagcacaccttcggccagagatgtgtgagcagcaggcctgctgcccctggaggagaggaggccgaggccagtgaccctgcagatgaggaggtgagccacatcaccagcagcgcctgcccctggcagcccacagctgagccccacggccctgaggccagccctgtggccggcggggagcgggacctgcggcggctgtacagcgtggatgcccagggcttcctggacaagccaggccgggcagatgagcagtggaggccttctgctgagctgggcagcggggagcctggagaggccaaggcctggggccctgaggccgagcccgccctgggcgcccggaggaagaagaagatgagccccccctgcatctctgtggagcccccagcagaagatgagggcagcgcccggcccagcgctgctgagggcggcagcaccaccctgcggcggaggacccccagctgtgaggccaccccccaccgggacagcctggagcccacagagggcagcggggccggcggggaccctgctgccaagggggagcgctggggccaggccagctgcagagctgagcacctgactgtgcccagctttgcctttgagcccctggacctgggcgtgcccagcggggaccccttcctggatggcagccacagcgtgaccccagagagccgggccagcagcagcggggccatcgtgcccctggagcccccagagagcgagccccccatgcctgtgggggaccccccagagaagagaagaggcctgtacctgactgtgccccagtgccccctggagaagccaggcagccccagcgccaccccagcccctgggggcggcgcagatgatcctgtgtag

SEQ ID NO: 145871 - DNA, 6690 bp, Artificial Sequence
  Description of Artificial Sequence: Synthetic coding sequence
atggccgagagcgccagcccccccagcagcagcgctgctgccccagctgctgagcccggggtgaccacagagcagcccggccccaggagcccccccagcagccccccaggcctggaggagcccctggatggagctgacccccacgtgccccacccagacctggcccccatcgccttcttctgcctgcggcagaccaccagccccaggaactggtgcatcaagatggccaccggcccctggtggtggtgcctgtgcatgctggtgatcctgctgaactgtgtgaccctgggcatgtaccagccctgtgatgacatggactgcctgagtgaccgctgcaagatcctgcaggtgtttgatgacttcatcttcatcttctttgccatggagatggtgctgaagatggtggccctgggcatctttgggaagaagtgctacctgggggacacctggaaccggctggacttcttcatcgtgatggccggcatggtggagtacagcctggacctgcagaacatcaacctgagcgccatcagaacagtgcgggtgctgcggcccctgaaggccatcaacagagtgcccagcatgaggatcctggtgaacctgctgctggacaccctgcccatgctgggcaatgtgctgctgctgtgcttctttgtgttcttcatcttcggcatcatcggcgtgcagctgtgggccggcctgctgaggaaccgctgcttcctggaggagaacttcaccatccagggagatgtggccctgcccccctactaccagccagaagaagatgatgagatgcccttcatctgcagcctgagcggggacaatggcatcatgggctgccacgagatcccccccctgaaggagcagggccgggagtgctgcctgagcaaggatgatgtgtatgactttggagctggccggcaggacctgaatgccagcggcctgtgtgtgaactggaaccgctactacaacgtgtgcaggacaggcagcgccaacccccacaagggggccatcaactttgacaacatcggctacgcctggatcgtcatcttccaggtgatcaccctggagggctgggtggagatcatgtactacgtgatggatgcccacagcttctacaacttcatctacttcatcctgctgatcatcgtgggcagcttcttcatgatcaacctgtgcctggtggtgattgccacccagttcagcgagaccaagcagcgggagcaccggctgatgctggagcagaggcagcgctacctgagcagcagcacagtggccagctatgcagagcccggggactgctatgaggagatcttccagtatgtgtgccacatcctgaggaaggccaagagaagagccctgggcctgtaccaggccctgcagagccggcggcaggccctgggccctgaggccccagccccagccaagccaggcccccacgccaaggagcccaggcactaccacggcaagaccaagggccagggagatgagggccgccacctgggcagccgccactgccagaccctgcacggccctgccagccctggaaatgaccacagcggccggggcaagccaggcccccgggagctgtgcccccagcacagccccctggatgccaccccccacaccctggtgcagcccatcccagccaccctggccagtgaccctgccagctgcccctgctgccagcatgaagatggccggcggcccagcggcctgggcagcacagacagcggccaggagggcagcggcagcggcagcagcgctggaggagaagatgaagcagatggagatggagcccggagcagtgaagatggagccagcagcgagctgggcaaggaggaggaggaggaggagcaggctgatggagctgtgtggctgtgtggagatgtgtggagggagacccgggccaagctgcggggcatcgtggacagcaagtacttcaacagaggcatcatgatggccatcctggtgaacacagtgtccatgggcatcgagcaccacgagcaggccaatgagctgaccaacatcctggagatctgcaatgtggtgttcacctccatgtttgccctggagatgatcctgaagctggccgccttcggcctgtttgactacctgaggaacccctacaacatctttgacagcatcatcgtcatcatcagcatctgggagatcgtgggccaggctgatggcggcctgtctgtgctgcggaccttccggctgctgcgggtgctgaagctggtgcgcttcatgcctgccctgcggcggcagctggtggtgctgatgaagaccatggacaacgtggccaccttctgcatgctgctgatgctgttcatcttcatcttcagcatcctgggcatgcacatcttcggctgcaagttcagcctgaggacagacaccggggacacagtgcctgacaggaagaactttgacagcctgctgtgggccatcgtgacagtgttccagatcctgacccaggaggactggaatgtggtgctgtacaacggcatggccagcaccagcccctgggccagcctgtactttgtggccctgatgaccttcggcaactacgtgctcttcaacctgctggtggccatcctggtggagggcttccaggccgagggagatgccaacagaagctacagtgatgaggaccagagcagcagcaacatcgaggagtttgacaagctgcaggagggcctggacagcagcggggaccccaagctgtgccccatccccatgaccccaaatggccacctggaccccagcctgcccctgggcggccacctgggccctgctggagctgctggccctgccccccggctgagcctgcagcctgaccccatgctggtggccctgggcagcaggaagagctctgtgatgagcctgggccgcatgtcctatgaccagaggagcctgagcagcagccgcagcagctactacggcccctggggccgctctgctgcctgggccagcagaagaagctcctggaacagcctgaagcacaagccacccagcgctgagcacgagagcctgctgtctgctgagcggggcggcggggcccgggtgtgtgaggtggccgcagatgagggcccccccagggctgcccccctgcacaccccccacgcccaccacatccaccacggcccccacctggcccaccgccaccgccaccacaggaggaccctgagcctggacaacagagacagcgtggacctggccgagctggtgcctgctgtgggcgcccacccccgggccgcctggagggctgctggccctgcccctggccacgaggactgcaatggaaggatgcccagcatcgccaaggatgtgttcaccaagatgggagacagaggagacagaggagaagatgaggaggagattgactacaccctgtgcttccgggtgaggaagatgattgatgtgtacaagccagactggtgtgaggtgcgggaggactggagcgtgtacctgttcagccctgagaaccgcttccgggtgctgtgccagaccatcatcgcccacaagctgtttgattatgtggtgctggccttcatcttcctgaactgcatcaccatcgccctggagcggccccagatcgaggccggcagcacagagcgcatcttcctgactgtgagcaactacatcttcaccgccatctttgtgggggagatgaccctgaaggtggtgtccctgggcctgtactttggagagcaggcctacctgcggagctcctggaatgtgctggatggcttcctggtgtttgtgtccatcattgatattgtggtgtccctggccagcgctgggggcgccaagatcctgggcgtgctgcgggtgctgcggctgctgcggaccctgcggcccctgcgggtcatcagccgggcccctggcctgaagctggtggtggagaccctcatcagcagcctgaagcccatcggcaacatcgtgctgatctgctgtgccttcttcatcatcttcggcatcctgggcgtgcagctgttcaagggcaagttctaccactgcctgggcgtggacaccaggaacatcaccaacagaagtgactgcatggccgccaactaccgctgggtgcaccacaagtacaactttgacaacctgggccaggccctgatgagcctgtttgtgctggccagcaaggatggctgggtgaacatcatgtacaacggcctggatgctgtggccgtggaccagcagcctgtgaccaaccacaacccctggatgctgctgtacttcatctccttcctgctgattgtgtccttctttgtgctgaacatgtttgtgggcgtggtggtggagaacttccacaagtgccggcagcaccaggaggccgaggaggcccggcggcgggaggagaagaggctgcggcggctggagaagaagaggaggaaggcccagaggctgccctactatgccacctactgccacacccggctgctgatccacagcatgtgcaccagccactacctggacatcttcatcaccttcatcatctgcctgaatgtggtgaccatgagcctggagcactacaaccagcccaccagcctggagacagccctgaagtactgcaactacatgttcaccaccgtgtttgtgctggaggccgtgctgaagctggtggccttcggcctgcggcgcttcttcaaggaccgctggaaccagctggacctggccatcgtgctgctgtctgtgatgggcatcaccctggaggagattgagatcaatgctgccctgcccatcaaccccaccatcatccgcatcatgagggtgctgcgcatcgcccgggtgctgaagctgctgaagatggccaccggcatgagggccctgctggacacagtggtgcaggccctgccccaggtgggcaacctgggcctgctcttcatgctgctcttcttcatctatgctgccctgggcgtggagctgtttgggaagctggtgtgcaatgatgagaacccctgtgagggcatgagcagacatgccacctttgagaactttggcatggccttcctgaccctcttccaggtgtccactggagacaactggaatggcatcatgaaggacaccctgcgggactgcacccatgatgagaggagctgcctgagcagcctgcagtttgtgagccccctgtactttgtgtcctttgtgctgacagcccagtttgtgctgatcaacgtggtggtggccgtgctgatgaagcacctggatgacagcaacaaggaggcccaggaggatgctgagatggatgctgagctggagctggagatggcccacggcctgggccctggcccccggctgcccaccggcagccctggggcccctggccggggccctgggggcgccggcggcggcggggacacagaaggaggcctgtgccgccgctgctacagccctgcccaggagaacctgtggctggacagcgtgtccctcatcatcaaggacagcctggagggggagctgaccatcatcgacaacctgagcggcagcatcttccaccactacagcagccctgctggctgcaagaagtgccaccacgacaagcaggaggtgcagctggccgagacagaggccttcagcctgaacagcgacaggagcagcagcatcctgctgggagatgacctgagcctggaggaccccacagcctgccccccaggcaggaaggacagcaagggggagctggaccccccagagcccatgagggtgggggacctgggggagtgcttcttccccctgagcagcacagctgtgtccccagaccctgagaacttcctgtgtgagatggaggagatccccttcaaccctgtgcgctcctggctgaagcatgacagcagccaggccccacccagccccttctccccagatgccagcagccccctgctgcccatgcctgctgagttcttccaccctgctgtgtctgccagccagaagggccctgagaagggcaccggcaccggcaccctgcccaagatcgccctgcagggctcctgggccagcctgcggagcccccgggtgaactgcaccctgctgcggcaggccactggaagtgacaccagcctggatgccagccccagcagcagcgctggcagcctgcagaccaccctggaggacagcctgaccctgagtgacagcccccggcgggccctgggccccccagccccagcccctggccccagggctggcctgagccctgctgcccggcggcggctgagcctgcggggccggggcctcttcagcctgcggggcctgcgggcccaccagaggagccacagcagcggcggcagcaccagccctggctgcacccaccacgacagcatggaccccagtgatgaggagggccggggcggggccggcggcggcggggccggcagcgagcacagcgagaccctgagcagcctgagcctgaccagcctcttctgccccccacctcctcctccagcccctggcctgaccccagccaggaagttcagcagcaccagcagcctggccgcccctggccggccccatgctgctgccctggcccacggcctggcccggagccccagctgggccgctgacaggagcaaggaccccccaggccgggcccccctgcccatgggcctgggccccctggcccccccaccccagcccctgcctggagagctggagcctggagatgctgccagcaagaggaagaggtag

SEQ ID NO: 145872 - DNA, 6567 bp, Artificial Sequence
  Description of Artificial Sequence: Synthetic coding sequence
atggccgagagcgccagcccccccagcagcagcgctgctgccccagctgctgagcccggggtgaccacagagcagcccggccccaggagcccccccagcagccccccaggcctggaggagcccctggatggagctgacccccacgtgccccacccagacctggcccccatcgccttcttctgcctgcggcagaccaccagccccaggaactggtgcatcaagatggccaccggcccctggtggtggtgcctgtgcatgctggtgatcctgctgaactgtgtgaccctgggcatgtaccagccctgtgatgacatggactgcctgagtgaccgctgcaagatcctgcaggtgtttgatgacttcatcttcatcttctttgccatggagatggtgctgaagatggtggccctgggcatctttgggaagaagtgctacctgggggacacctggaaccggctggacttcttcatcgtgatggccggcatggtggagtacagcctggacctgcagaacatcaacctgagcgccatcagaacagtgcgggtgctgcggcccctgaaggccatcaacagagtgcccagcatgaggatcctggtgaacctgctgctggacaccctgcccatgctgggcaatgtgctgctgctgtgcttctttgtgttcttcatcttcggcatcatcggcgtgcagctgtgggccggcctgctgaggaaccgctgcttcctggaggagaacttcaccatccagggagatgtggccctgcccccctactaccagccagaagaagatgatgagatgcccttcatctgcagcctgagcggggacaatggcatcatgggctgccacgagatcccccccctgaaggagcagggccgggagtgctgcctgagcaaggatgatgtgtatgactttggagctggccggcaggacctgaatgccagcggcctgtgtgtgaactggaaccgctactacaacgtgtgcaggacaggcagcgccaacccccacaagggggccatcaactttgacaacatcggctacgcctggatcgtcatcttccaggtgatcaccctggagggctgggtggagatcatgtactacgtgatggatgcccacagcttctacaacttcatctacttcatcctgctgatcatcgtgggcagcttcttcatgatcaacctgtgcctggtggtgattgccacccagttcagcgagaccaagcagcgggagcaccggctgatgctggagcagaggcagcgctacctgagcagcagcacagtggccagctatgcagagcccggggactgctatgaggagatcttccagtatgtgtgccacatcctgaggaaggccaagagaagagccctgggcctgtaccaggccctgcagagccggcggcaggccctgggccctgaggccccagccccagccaagccaggcccccacgccaaggagcccaggcactaccagctgtgcccccagcacagccccctggatgccaccccccacaccctggtgcagcccatcccagccaccctggccagtgaccctgccagctgcccctgctgccagcatgaagatggaagaagacccagcggcctgggcagcacagattctggccaggagggcagcggcagcggcagcagcgctggaggagaagatgaagcagatggagatggagcccggagcagtgaagatggagccagcagcgagctgggcaaggaggaggaggaggaggagcaggctgatggagctgtgtggctgtgtggagatgtgtggagggagacccgggccaagctgcggggcatcgtggacagcaagtacttcaacagaggcatcatgatggccatcctggtgaacacagtgtccatgggcatcgagcaccacgagcaggccacagagctgaccaacatcctggagatctgcaatgtggtgttcacctccatgtttgccctggagatgatcctgaagctggccgccttcggcctgtttgactacctgaggaacccctacaacatctttgacagcatcatcgtcatcatcagcatctgggagatcgtgggccaggctgatggcggcctgtctgtgctgcggaccttccggctgctgcgggtgctgaagctggtgcgcttcatgcctgccctgcggcggcagctggtggtgctgatgaagaccatggacaacgtggccaccttctgcatgctgctgatgctgttcatcttcatcttcagcatcctgggcatgcacatcttcggctgcaagttcagcctgaggacagacacaggagacacagtgcctgacaggaagaactttgacagcctgctgtgggccatcgtgaccgtcttccagatcctgacccaggaggactggaatgtggtgctgtacaacggcatggccagcaccagcccctgggccagcctgtactttgtggccctgatgacctttggaaactacgtgctcttcaacctgctggtggccatcctggtggagggcttccaggccgagggagatgccaacagaagctacagtgatgaggaccagagcagcagcaacatcgaggagtttgacaagctgcaggagggcctggacagcagcggggaccccaagctgtgccccatccccatgacccccaacggccacctggaccccagcctgcccctgggcggccacctgggccctgctggagctgctggccctgccccccggctgagcctgcagcctgaccccatgctggtggccctgggcagcaggaagagctctgtgatgagcctgggccgcatgtcctatgaccagaggagcctgagcagcagccgcagcagctactacggcccctggggccgctctgctgcctgggccagccgccgcagctcctggaacagcctgaagcacaagcccccatctgctgagcacgagagcctgctgtctgctgagcggggcggcggggcccgggtgtgtgaggtggccgcagatgagggccccccccgggccgcccccctgcacacccctcatgcccaccacatccaccacggcccccacctggcccaccgccaccgccaccacaggaggaccctgagcctggacaacagagattctgtggacctggccgagctggtgcctgctgtgggcgcccaccccagggctgcctggagggctgctggccctgcccctggccacgaggactgcaatggccgcatgcccagcatcgccaaggatgtgttcaccaagatgggagacagaggagacagaggagaagatgaggaggagattgactacaccctgtgcttccgggtgaggaagatgattgatgtgtacaagccagactggtgtgaggtgcgggaggactggagcgtgtacctgttctccccagaaaatcgcttccgggtgctgtgccagaccatcatcgcccacaagctgtttgattatgtggtgctggccttcatcttcctgaactgcatcaccatcgccctggagcggccccagattgaagctggcagcacagagcgcatcttcctgactgtgagcaactacatcttcaccgccatctttgtgggggagatgaccctgaaggtggtgtccctgggcctgtactttggagagcaggcctacctgcggagctcctggaatgtgctggatggcttcctggtgtttgtgtccatcatcgacatcgtggtgtccctggccagcgctggaggagccaagatcctgggcgtgctgcgggtgctgcggctgctgcggaccctgcggcccctgcgggtcatcagccgggcccctggcctgaagctggtggtggagaccctcatcagcagcctgaagcccatcggcaacatcgtgctgatctgctgtgccttcttcatcatcttcggcatcctgggcgtgcagctgttcaagggcaagttctaccactgcctgggcgtggacaccaggaacatcaccaacagaagtgactgcatggccgccaactaccgctgggtgcaccacaagtacaactttgacaacctgggccaggccctgatgagcctgtttgtgctggccagcaaggatggctgggtgaacatcatgtacaacggcctggatgctgtggccgtggaccagcagcctgtgaccaaccacaacccctggatgctgctgtacttcatctccttcctgctgattgtgtccttctttgtgctgaacatgtttgtgggcgtggtggtggagaacttccacaagtgccggcagcaccaggaggccgaggaggccaggagaagagaggagaagaggctgcggcggctggagaagaagaggaggaaggcccagaggctgccctactatgccacctactgccacacccggctgctgatccacagcatgtgcaccagccactacctggacatcttcatcaccttcatcatctgcctgaatgtggtgaccatgagcctggagcactacaaccagcccaccagcctggagacagccctgaagtactgcaactacatgttcaccaccgtgtttgtgctggaggccgtgctgaagctggtggccttcggcctgcggcgcttcttcaaggaccgctggaaccagctggacctggccatcgtgctgctgtctgtgatgggcatcaccctggaggagattgagatcaatgctgccctgcccatcaaccccaccatcatccgcatcatgagggtgctgagaattgcccgggtgctgaagctgctgaagatggccaccggcatgagggccctgctggacacagtggtgcaggccctgccccaggtgggcaacctgggcctgctcttcatgctgctcttcttcatctatgctgccctgggcgtggagctgtttgggaagctggtgtgcaatgatgagaacccctgtgagggcatgagcagacatgccacctttgaaaattttggcatggccttcctgaccctcttccaggtgtccactggagacaactggaatggcatcatgaaggacaccctgcgggactgcacccatgatgagaggagctgcctgagcagcctgcagtttgtgagccccctgtactttgtgtcctttgtgctgacagcccagtttgtgctgatcaacgtggtggtggccgtgctgatgaagcacctggatgacagcaacaaggaggcccaggaggatgctgagatggatgctgagctggagctggagatggcccacggcctgggccctggcccccggctgcccaccggcagccctggggcccctggccggggccctggaggagctgggggcggcggggacacagagggcggcctgtgccgccgctgctacagccctgcccaggagaacctgtggctggacagcgtgtccctcatcatcaaggacagcctggagggggagctgaccatcatcgacaacctgagcggcagcatcttccaccactacagcagccctgctggctgcaagaagtgccaccacgacaagcaggaggtgcagctggccgagacagaggccttcagcctgaacagcgacaggagcagcagcatcctgctgggagatgacctgagcctggaggaccccacagcctgccccccaggcaggaaggacagcaaaggagagctggaccccccagagcccatgagggtgggggacctgggggagtgcttcttccccctgagcagcacagctgtgtccccagaccctgagaacttcctgtgtgagatggaggagatccccttcaaccctgtgcgctcctggctgaagcatgacagcagccaggccccacccagccccttctccccagatgccagcagccccctgctgcccatgcctgctgagttcttccaccctgctgtgtctgccagccagaagggccctgagaagggcactggaacaggcaccctgcccaagatcgccctgcagggctcctgggccagcctgcggagcccccgggtgaactgcaccctgctgcggcaggccaccggcagtgacaccagcctggatgccagccccagcagcagcgctggcagcctgcagaccaccctggaggacagcctgaccctgagtgacagcccccggcgggccctgggccccccagccccagcccctggcccccgggccggcctgagccctgctgcccggcggcggctgagcctgcggggccggggcctcttcagcctgcggggcctgcgggcccaccagaggagccacagcagcggcggcagcaccagccctggctgcacccaccacgacagcatggaccccagtgatgaggagggccggggcggggccggcggcggcggggccggcagcgagcacagcgagaccctgagcagcctgagcctgaccagcctcttctgccccccacctcctcctccagcccctggcctgaccccagccaggaagttcagcagcaccagcagcctggccgcccctggccggccccacgccgccgccctggcccacggcctggcccggagccccagctgggccgctgacaggagcaaggaccccccaggccgggcccccctgcccatgggcctgggccccctggcccccccaccccagcccctgcccggggagctggagcctggagatgctgccagcaagaggaagaggtag

SEQ ID NO: 145873 - DNA, 6051 bp, Artificial Sequence
  Description of Artificial Sequence: Synthetic coding sequence
atggccgagagcgccagcccccccagcagcagcgctgctgccccagctgctgagcccggggtgaccacagagcagcccggccccaggagcccccccagcagccccccaggcctggaggagcccctggatggagctgacccccacgtgccccacccagacctggcccccatcgccttcttctgcctgcggcagaccaccagccccaggaactggtgcatcaagatggtgtgcaacccctggtttgaatgtgtgtccatgctggtgatcctgctgaactgtgtgaccctgggcatgtaccagccctgtgatgacatggactgcctgagtgaccgctgcaagatcctgcaggtgtttgatgacttcatcttcatcttctttgccatggagatggtgctgaagatggtggccctgggcatctttgggaagaagtgctacctgggggacacctggaaccggctggacttcttcatcgtgatggccggcatggtggagtacagcctggacctgcagaacatcaacctgagcgccatcagaacagtgcgggtgctgcggcccctgaaggccatcaacagagtgcccagcatgaggatcctggtgaacctgctgctggacaccctgcccatgctgggcaatgtgctgctgctgtgcttctttgtgttcttcatcttcggcatcatcggcgtgcagctgtgggccggcctgctgaggaaccgctgcttcctggaggagaacttcaccatccagggagatgtggccctgcccccctactaccagccagaagaagatgatgagatgcccttcatctgcagcctgagcggggacaatggcatcatgggctgccacgagatcccccccctgaaggagcagggccgggagtgctgcctgagcaaggatgatgtgtatgactttggagctggccggcaggacctgaatgccagcggcctgtgtgtgaactggaaccgctactacaacgtgtgcaggacaggcagcgccaacccccacaagggggccatcaactttgacaacatcggctacgcctggatcgtcatcttccaggtgatcaccctggagggctgggtggagatcatgtactacgtgatggatgcccacagcttctacaacttcatctacttcatcctgctgatcatcgtgggcagcttcttcatgatcaacctgtgcctggtggtgattgccacccagttcagcgagaccaagcagcgggagcaccggctgatgctggagcagaggcagcgctacctgagcagcagcacagtggccagctatgcagagcccggggactgctatgaggagatcttccagtatgtgtgccacatcctgaggaaggccaagagaagagccctgggcctgtaccaggccctgcagagccggcggcaggccctgggccctgaggccccagccccagccaagccaggcccccacgccaaggagcccaggcactaccacggcaagaccaagggccagggagatgagggccgccacctgggcagccgccactgccagaccctgcacggccctgccagccctggaaatgaccacagcggccgggagctgtgcccccagcacagccccctggatgccaccccccacaccctggtgcagcccatcccagccaccctggccagtgaccctgccagctgcccctgctgccagcatgaagatggccggcggcccagcggcctgggcagcacagacagcggccaggagggcagcggcagcggcagcagcgctggaggagaagatgaagcagatggagatggagcccggagcagtgaagatggagccagcagcgagctgggcaaggaggaggaggaggaggagcaggctgatggagctgtgtggctgtgtggagatgtgtggagggagacccgggccaagctgcggggcatcgtggacagcaagtacttcaacagaggcatcatgatggccatcctggtgaacacagtgtccatgggcatcgagcaccacgagcagcctgaggagctgaccaacatcctggagatctgcaatgtggtgttcacctccatgtttgccctggagatgatcctgaagctggccgccttcggcctgtttgactacctgaggaacccctacaacatctttgacagcatcatcgtcatcatcagcatctgggagatcgtgggccaggctgatggcggcctgtctgtgctgcggaccttccggctgctgcgggtgctgaagctggtgcgcttcatgcctgccctgcggcggcagctggtggtgctgatgaagaccatggacaacgtggccaccttctgcatgctgctgatgctgttcatcttcatcttcagcatcctgggcatgcacatcttcggctgcaagttcagcctgaggacagacaccggggacacagtgcctgacaggaagaactttgacagcctgctgtgggccatcgtgacagtgttccagatcctgacccaggaggactggaatgtggtgctgtacaacggcatggccagcaccagcccctgggccagcctgtactttgtggccctgatgaccttcggcaactacgtgctcttcaacctgctggtggccatcctggtggagggcttccaggccgagggagatgccaacagaagctacagtgatgaggaccagagcagcagcaacatcgaggagtttgacaagctgcaggagggcctggacagcagcggggaccccaagctgtgccccatccccatgaccccaaatggccacctggaccccagcctgcccctgggcggccacctgggccctgctggagctgctggccctgccccccggctgagcctgcagcctgaccccatgctggtggccctgggcagcaggaagagctctgtgatgagcctgggccgcatgtcctatgaccagaggagcctgagcagcagccgcagcagctactacggcccctggggccgctctgctgcctgggccagcagaagaagctcctggaacagcctgaagcacaagccacccagcgctgagcacgagagcctgctgtctgctgagcggggcggcggggcccgggtgtgtgaggtggccgcagatgagggcccccccagggctgcccccctgcacaccccccacgcccaccacatccaccacggcccccacctggcccaccgccaccgccaccacaggaggaccctgagcctggacaacagagacagcgtggacctggccgagctggtgcctgctgtgggcgcccacccccgggccgcctggagggctgctggccctgcccctggccacgaggactgcaatggaaggatgcccagcatcgccaaggatgtgttcaccaagatgggagacagaggagacagaggagaagatgaggaggagattgactacaccctgtgcttccgggtgaggaagatgattgatgtgtacaagccagactggtgtgaggtgcgggaggactggagcgtgtacctgttcagccctgagaaccgcttccgggtgctgtgccagaccatcatcgcccacaagctgtttgattatgtggtgctggccttcatcttcctgaactgcatcaccatcgccctggagcggccccagatcgaggccggcagcacagagcgcatcttcctgactgtgagcaactacatcttcaccgccatctttgtgggggagatgaccctgaaggtggtgtccctgggcctgtactttggagagcaggcctacctgcggagctcctggaatgtgctggatggcttcctggtgtttgtgtccatcattgatattgtggtgtccctggccagcgctgggggcgccaagatcctgggcgtgctgcgggtgctgcggctgctgcggaccctgcggcccctgcgggtcatcagccgggcccctggcctgaagctggtggtggagaccctcatcagcagcctgaagcccatcggcaacatcgtgctgatctgctgtgccttcttcatcatcttcggcatcctgggcgtgcagctgttcaagggcaagttctaccactgcctgggcgtggacaccaggaacatcaccaacagaagtgactgcatggccgccaactaccgctgggtgcaccacaagtacaactttgacaacctgggccaggccctgatgagcctgtttgtgctggccagcaaggatggctgggtgaacatcatgtacaacggcctggatgctgtggccgtggaccagcagcctgtgaccaaccacaacccctggatgctgctgtacttcatctccttcctgctgattgtgtccttctttgtgctgaacatgtttgtgggcgtggtggtggagaacttccacaagtgccggcagcaccaggaggccgaggaggcccggcggcgggaggagaagaggctgcggcggctggagaagaagaggaggaaggcccagaggctgccctactatgccacctactgccacacccggctgctgatccacagcatgtgcaccagccactacctggacatcttcatcaccttcatcatctgcctgaatgtggtgaccatgagcctggagcactacaaccagcccaccagcctggagacagccctgaagtactgcaactacatgttcaccaccgtgtttgtgctggaggccgtgctgaagctggtggccttcggcctgcggcgcttcttcaaggaccgctggaaccagctggacctggccatcgtgctgctgtctgtgatgggcatcaccctggaggagattgagatcaatgctgccctgcccatcaaccccaccatcatccgcatcatgagggtgctgcgcatcgcccgggtgctgaagctgctgaagatggccaccggcatgagggccctgctggacacagtggtgcaggccctgccccaggtgggcaacctgggcctgctcttcatgctgctcttcttcatctatgctgccctgggcgtggagctgtttgggaagctggtgtgcaatgatgagaacccctgtgagggcatgagcagacatgccacctttgagaactttggcatggccttcctgaccctcttccaggtgtccactggagacaactggaatggcatcatgaaggacaccctgcgggactgcacccatgatgagaggagctgcctgagcagcctgcagtttgtgagccccctgtactttgtgtcctttgtgctgacagcccagtttgtgctgatcaacgtggtggtggccgtgctgatgaagcacctggatgacagcaacaaggaggcccaggaggatgctgagatggatgctgagctggagctggagatggcccacggcctgggccctggcccccggctgcccaccggcagccctggggcccctggccggggccctgggggcgccggcggcggcggggacacagaaggaggcctgtgccgccgctgctacagccctgcccaggagaacctgtggctggacagcgtgtccctcatcatcaaggacagcctggagggggagctgaccatcatcgacaacctgagcggcagcatcttccaccactacagcagccctgctggctgcaagaagtgccaccacgacaagcaggaggtgcagctggccgagacagaggccttcagcctgaacagcgacaggagcagcagcatcctgctgggagatgacctgagcctggaggaccccacagcctgccccccaggcaggaaggacagcaagggggagctggaccccccagagcccatgagggtgggggacctgggggagtgcttcttccccctgagcagcacagctgtgtccccagaccctgagaacttcctgtgtgagatggaggagatccccttcaaccctgtgcgctcctggctgaagcatgacagcagccaggccccacccagccccttctccccagatgccagcagccccctgctgcccatgcctgctgagttcttccaccctgctgtgtctgccagccagaagggccctgagaagggcaccggcaccggcaccctgcccaagatcgccctgcagggctcctgggccagcctgcggagcccccgggtgaactgcaccctgctgcggcaggtgcccaccccaccccggccctag

SEQ ID NO: 145874 - DNA, 6672 bp, Artificial Sequence
  Description of Artificial Sequence: Synthetic coding sequence
atggccgagagcgccagcccccccagcagcagcgctgctgccccagctgctgagcccggggtgaccacagagcagcccggccccaggagcccccccagcagccccccaggcctggaggagcccctggatggagctgacccccacgtgccccacccagacctggcccccatcgccttcttctgcctgcggcagaccaccagccccaggaactggtgcatcaagatggtgtgcaacccctggtttgaatgtgtgtccatgctggtgatcctgctgaactgtgtgaccctgggcatgtaccagccctgtgatgacatggactgcctgagtgaccgctgcaagatcctgcaggtgtttgatgacttcatcttcatcttctttgccatggagatggtgctgaagatggtggccctgggcatctttgggaagaagtgctacctgggggacacctggaaccggctggacttcttcatcgtgatggccggcatggtggagtacagcctggacctgcagaacatcaacctgagcgccatcagaacagtgcgggtgctgcggcccctgaaggccatcaacagagtgcccagcatgaggatcctggtgaacctgctgctggacaccctgcccatgctgggcaatgtgctgctgctgtgcttctttgtgttcttcatcttcggcatcatcggcgtgcagctgtgggccggcctgctgaggaaccgctgcttcctggaggagaacttcaccatccagggagatgtggccctgcccccctactaccagccagaagaagatgatgagatgcccttcatctgcagcctgagcggggacaatggcatcatgggctgccacgagatcccccccctgaaggagcagggccgggagtgctgcctgagcaaggatgatgtgtatgactttggagctggccggcaggacctgaatgccagcggcctgtgtgtgaactggaaccgctactacaacgtgtgcaggacaggcagcgccaacccccacaagggggccatcaactttgacaacatcggctacgcctggatcgtcatcttccaggtgatcaccctggagggctgggtggagatcatgtactacgtgatggatgcccacagcttctacaacttcatctacttcatcctgctgatcatcgtgggcagcttcttcatgatcaacctgtgcctggtggtgattgccacccagttcagcgagaccaagcagcgggagcaccggctgatgctggagcagaggcagcgctacctgagcagcagcacagtggccagctatgcagagcccggggactgctatgaggagatcttccagtatgtgtgccacatcctgaggaaggccaagagaagagccctgggcctgtaccaggccctgcagagccggcggcaggccctgggccctgaggccccagccccagccaagccaggcccccacgccaaggagcccaggcactaccacggcaagaccaagggccagggagatgagggccgccacctgggcagccgccactgccagaccctgcacggccctgccagccctggaaatgaccacagcggccgggagctgtgcccccagcacagccccctggatgccaccccccacaccctggtgcagcccatcccagccaccctggccagtgaccctgccagctgcccctgctgccagcatgaagatggccggcggcccagcggcctgggcagcacagacagcggccaggagggcagcggcagcggcagcagcgctggaggagaagatgaagcagatggagatggagcccggagcagtgaagatggagccagcagcgagctgggcaaggaggaggaggaggaggagcaggctgatggagctgtgtggctgtgtggagatgtgtggagggagacccgggccaagctgcggggcatcgtggacagcaagtacttcaacagaggcatcatgatggccatcctggtgaacacagtgtccatgggcatcgagcaccacgagcagcctgaggagctgaccaacatcctggagatctgcaatgtggtgttcacctccatgtttgccctggagatgatcctgaagctggccgccttcggcctgtttgactacctgaggaacccctacaacatctttgacagcatcatcgtcatcatcagcatctgggagatcgtgggccaggctgatggcggcctgtctgtgctgcggaccttccggctgctgcgggtgctgaagctggtgcgcttcatgcctgccctgcggcggcagctggtggtgctgatgaagaccatggacaacgtggccaccttctgcatgctgctgatgctgttcatcttcatcttcagcatcctgggcatgcacatcttcggctgcaagttcagcctgaggacagacaccggggacacagtgcctgacaggaagaactttgacagcctgctgtgggccatcgtgacagtgttccagatcctgacccaggaggactggaatgtggtgctgtacaacggcatggccagcaccagcccctgggccagcctgtactttgtggccctgatgaccttcggcaactacgtgctcttcaacctgctggtggccatcctggtggagggcttccaggccgagggagatgccaacagaagctacagtgatgaggaccagagcagcagcaacatcgaggagtttgacaagctgcaggagggcctggacagcagcggggaccccaagctgtgccccatccccatgaccccaaatggccacctggaccccagcctgcccctgggcggccacctgggccctgctggagctgctggccctgccccccggctgagcctgcagcctgaccccatgctggtggccctgggcagcaggaagagctctgtgatgagcctgggccgcatgtcctatgaccagaggagcctgagcagcagccgcagcagctactacggcccctggggccgctctgctgcctgggccagcagaagaagctcctggaacagcctgaagcacaagccacccagcgctgagcacgagagcctgctgtctgctgagcggggcggcggggcccgggtgtgtgaggtggccgcagatgagggcccccccagggctgcccccctgcacaccccccacgcccaccacatccaccacggcccccacctggcccaccgccaccgccaccacaggaggaccctgagcctggacaacagagacagcgtggacctggccgagctggtgcctgctgtgggcgcccacccccgggccgcctggagggctgctggccctgcccctggccacgaggactgcaatggaaggatgcccagcatcgccaaggatgtgttcaccaagatgggagacagaggagacagaggagaagatgaggaggagattgactacaccctgtgcttccgggtgaggaagatgattgatgtgtacaagccagactggtgtgaggtgcgggaggactggagcgtgtacctgttcagccctgagaaccgcttccgggtgctgtgccagaccatcatcgcccacaagctgtttgattatgtggtgctggccttcatcttcctgaactgcatcaccatcgccctggagcggccccagatcgaggccggcagcacagagcgcatcttcctgactgtgagcaactacatcttcaccgccatctttgtgggggagatgaccctgaaggtggtgtccctgggcctgtactttggagagcaggcctacctgcggagctcctggaatgtgctggatggcttcctggtgtttgtgtccatcattgatattgtggtgtccctggccagcgctgggggcgccaagatcctgggcgtgctgcgggtgctgcggctgctgcggaccctgcggcccctgcgggtcatcagccgggcccctggcctgaagctggtggtggagaccctcatcagcagcctgaagcccatcggcaacatcgtgctgatctgctgtgccttcttcatcatcttcggcatcctgggcgtgcagctgttcaagggcaagttctaccactgcctgggcgtggacaccaggaacatcaccaacagaagtgactgcatggccgccaactaccgctgggtgcaccacaagtacaactttgacaacctgggccaggccctgatgagcctgtttgtgctggccagcaaggatggctgggtgaacatcatgtacaacggcctggatgctgtggccgtggaccagcagcctgtgaccaaccacaacccctggatgctgctgtacttcatctccttcctgctgattgtgtccttctttgtgctgaacatgtttgtgggcgtggtggtggagaacttccacaagtgccggcagcaccaggaggccgaggaggcccggcggcgggaggagaagaggctgcggcggctggagaagaagaggaggaaggcccagaggctgccctactatgccacctactgccacacccggctgctgatccacagcatgtgcaccagccactacctggacatcttcatcaccttcatcatctgcctgaatgtggtgaccatgagcctggagcactacaaccagcccaccagcctggagacagccctgaagtactgcaactacatgttcaccaccgtgtttgtgctggaggccgtgctgaagctggtggccttcggcctgcggcgcttcttcaaggaccgctggaaccagctggacctggccatcgtgctgctgtctgtgatgggcatcaccctggaggagattgagatcaatgctgccctgcccatcaaccccaccatcatccgcatcatgagggtgctgcgcatcgcccgggtgctgaagctgctgaagatggccaccggcatgagggccctgctggacacagtggtgcaggccctgccccaggtgggcaacctgggcctgctcttcatgctgctcttcttcatctatgctgccctgggcgtggagctgtttgggaagctggtgtgcaatgatgagaacccctgtgagggcatgagcagacatgccacctttgagaactttggcatggccttcctgaccctcttccaggtgtccactggagacaactggaatggcatcatgaaggacaccctgcgggactgcacccatgatgagaggagctgcctgagcagcctgcagtttgtgagccccctgtactttgtgtcctttgtgctgacagcccagtttgtgctgatcaacgtggtggtggccgtgctgatgaagcacctggatgacagcaacaaggaggcccaggaggatgctgagatggatgctgagctggagctggagatggcccacggcctgggccctggcccccggctgcccaccggcagccctggggcccctggccggggccctgggggcgccggcggcggcggggacacagaaggaggcctgtgccgccgctgctacagccctgcccaggagaacctgtggctggacagcgtgtccctcatcatcaaggacagcctggagggggagctgaccatcatcgacaacctgagcggcagcatcttccaccactacagcagccctgctggctgcaagaagtgccaccacgacaagcaggaggtgcagctggccgagacagaggccttcagcctgaacagcgacaggagcagcagcatcctgctgggagatgacctgagcctggaggaccccacagcctgccccccaggcaggaaggacagcaagggggagctggaccccccagagcccatgagggtgggggacctgggggagtgcttcttccccctgagcagcacagctgtgtccccagaccctgagaacttcctgtgtgagatggaggagatccccttcaaccctgtgcgctcctggctgaagcatgacagcagccaggccccacccagccccttctccccagatgccagcagccccctgctgcccatgcctgctgagttcttccaccctgctgtgtctgccagccagaagggccctgagaagggcaccggcaccggcaccctgcccaagatcgccctgcagggctcctgggccagcctgcggagcccccgggtgaactgcaccctgctgcggcaggccactggaagtgacaccagcctggatgccagccccagcagcagcgctggcagcctgcagaccaccctggaggacagcctgaccctgagtgacagcccccggcgggccctgggccccccagccccagcccctggccccagggctggcctgagccctgctgcccggcggcggctgagcctgcggggccggggcctcttcagcctgcggggcctgcgggcccaccagaggagccacagcagcggcggcagcaccagccctggctgcacccaccacgacagcatggaccccagtgatgaggagggccggggcggggccggcggcggcggggccggcagcgagcacagcgagaccctgagcagcctgagcctgaccagcctcttctgccccccacctcctcctccagcccctggcctgaccccagccaggaagttcagcagcaccagcagcctggccgcccctggccggccccatgctgctgccctggcccacggcctggcccggagccccagctgggccgctgacaggagcaaggaccccccaggccgggcccccctgcccatgggcctgggccccctggcccccccaccccagcccctgcctggagagctggagcctggagatgctgccagcaagaggaagaggtag

SEQ ID NO: 145875 - DNA, 6567 bp, Artificial Sequence
  Description of Artificial Sequence: Synthetic coding sequence
atggccgagagcgccagcccccccagcagcagcgctgctgccccagctgctgagcccggggtgaccacagagcagcccggccccaggagcccccccagcagccccccaggcctggaggagcccctggatggagctgacccccacgtgccccacccagacctggcccccatcgccttcttctgcctgcggcagaccaccagccccaggaactggtgcatcaagatggtgtgcaacccctggtttgaatgtgtgtccatgctggtgatcctgctgaactgtgtgaccctgggcatgtaccagccctgtgatgacatggactgcctgagtgaccgctgcaagatcctgcaggtgtttgatgacttcatcttcatcttctttgccatggagatggtgctgaagatggtggccctgggcatctttgggaagaagtgctacctgggggacacctggaaccggctggacttcttcatcgtgatggccggcatggtggagtacagcctggacctgcagaacatcaacctgagcgccatcagaacagtgcgggtgctgcggcccctgaaggccatcaacagagtgcccagcatgaggatcctggtgaacctgctgctggacaccctgcccatgctgggcaatgtgctgctgctgtgcttctttgtgttcttcatcttcggcatcatcggcgtgcagctgtgggccggcctgctgaggaaccgctgcttcctggaggagaacttcaccatccagggagatgtggccctgcccccctactaccagccagaagaagatgatgagatgcccttcatctgcagcctgagcggggacaatggcatcatgggctgccacgagatcccccccctgaaggagcagggccgggagtgctgcctgagcaaggatgatgtgtatgactttggagctggccggcaggacctgaatgccagcggcctgtgtgtgaactggaaccgctactacaacgtgtgcaggacaggcagcgccaacccccacaagggggccatcaactttgacaacatcggctacgcctggatcgtcatcttccaggtgatcaccctggagggctgggtggagatcatgtactacgtgatggatgcccacagcttctacaacttcatctacttcatcctgctgatcatcgtgggcagcttcttcatgatcaacctgtgcctggtggtgattgccacccagttcagcgagaccaagcagcgggagcaccggctgatgctggagcagaggcagcgctacctgagcagcagcacagtggccagctatgcagagcccggggactgctatgaggagatcttccagtatgtgtgccacatcctgaggaaggccaagagaagagccctgggcctgtaccaggccctgcagagccggcggcaggccctgggccctgaggccccagccccagccaagccaggcccccacgccaaggagcccaggcactaccagctgtgcccccagcacagccccctggatgccaccccccacaccctggtgcagcccatcccagccaccctggccagtgaccctgccagctgcccctgctgccagcatgaagatggaagaagacccagcggcctgggcagcacagattctggccaggagggcagcggcagcggcagcagcgctggaggagaagatgaagcagatggagatggagcccggagcagtgaagatggagccagcagcgagctgggcaaggaggaggaggaggaggagcaggctgatggagctgtgtggctgtgtggagatgtgtggagggagacccgggccaagctgcggggcatcgtggacagcaagtacttcaacagaggcatcatgatggccatcctggtgaacacagtgtccatgggcatcgagcaccacgagcagcctgaggagctgaccaacatcctggagatctgcaatgtggtgttcacctccatgtttgccctggagatgatcctgaagctggccgccttcggcctgtttgactacctgaggaacccctacaacatctttgacagcatcatcgtcatcatcagcatctgggagatcgtgggccaggctgatggcggcctgtctgtgctgcggaccttccggctgctgcgggtgctgaagctggtgcgcttcatgcctgccctgcggcggcagctggtggtgctgatgaagaccatggacaacgtggccaccttctgcatgctgctgatgctgttcatcttcatcttcagcatcctgggcatgcacatcttcggctgcaagttcagcctgaggacagacacaggagacacagtgcctgacaggaagaactttgacagcctgctgtgggccatcgtgaccgtcttccagatcctgacccaggaggactggaatgtggtgctgtacaacggcatggccagcaccagcccctgggccagcctgtactttgtggccctgatgacctttggaaactacgtgctcttcaacctgctggtggccatcctggtggagggcttccaggccgagggagatgccaacagaagctacagtgatgaggaccagagcagcagcaacatcgaggagtttgacaagctgcaggagggcctggacagcagcggggaccccaagctgtgccccatccccatgacccccaacggccacctggaccccagcctgcccctgggcggccacctgggccctgctggagctgctggccctgccccccggctgagcctgcagcctgaccccatgctggtggccctgggcagcaggaagagctctgtgatgagcctgggccgcatgtcctatgaccagaggagcctgagcagcagccgcagcagctactacggcccctggggccgctctgctgcctgggccagccgccgcagctcctggaacagcctgaagcacaagcccccatctgctgagcacgagagcctgctgtctgctgagcggggcggcggggcccgggtgtgtgaggtggccgcagatgagggccccccccgggccgcccccctgcacacccctcatgcccaccacatccaccacggcccccacctggcccaccgccaccgccaccacaggaggaccctgagcctggacaacagagattctgtggacctggccgagctggtgcctgctgtgggcgcccaccccagggctgcctggagggctgctggccctgcccctggccacgaggactgcaatggccgcatgcccagcatcgccaaggatgtgttcaccaagatgggagacagaggagacagaggagaagatgaggaggagattgactacaccctgtgcttccgggtgaggaagatgattgatgtgtacaagccagactggtgtgaggtgcgggaggactggagcgtgtacctgttctccccagaaaatcgcttccgggtgctgtgccagaccatcatcgcccacaagctgtttgattatgtggtgctggccttcatcttcctgaactgcatcaccatcgccctggagcggccccagattgaagctggcagcacagagcgcatcttcctgactgtgagcaactacatcttcaccgccatctttgtgggggagatgaccctgaaggtggtgtccctgggcctgtactttggagagcaggcctacctgcggagctcctggaatgtgctggatggcttcctggtgtttgtgtccatcatcgacatcgtggtgtccctggccagcgctggaggagccaagatcctgggcgtgctgcgggtgctgcggctgctgcggaccctgcggcccctgcgggtcatcagccgggcccctggcctgaagctggtggtggagaccctcatcagcagcctgaagcccatcggcaacatcgtgctgatctgctgtgccttcttcatcatcttcggcatcctgggcgtgcagctgttcaagggcaagttctaccactgcctgggcgtggacaccaggaacatcaccaacagaagtgactgcatggccgccaactaccgctgggtgcaccacaagtacaactttgacaacctgggccaggccctgatgagcctgtttgtgctggccagcaaggatggctgggtgaacatcatgtacaacggcctggatgctgtggccgtggaccagcagcctgtgaccaaccacaacccctggatgctgctgtacttcatctccttcctgctgattgtgtccttctttgtgctgaacatgtttgtgggcgtggtggtggagaacttccacaagtgccggcagcaccaggaggccgaggaggccaggagaagagaggagaagaggctgcggcggctggagaagaagaggaggaaggcccagaggctgccctactatgccacctactgccacacccggctgctgatccacagcatgtgcaccagccactacctggacatcttcatcaccttcatcatctgcctgaatgtggtgaccatgagcctggagcactacaaccagcccaccagcctggagacagccctgaagtactgcaactacatgttcaccaccgtgtttgtgctggaggccgtgctgaagctggtggccttcggcctgcggcgcttcttcaaggaccgctggaaccagctggacctggccatcgtgctgctgtctgtgatgggcatcaccctggaggagattgagatcaatgctgccctgcccatcaaccccaccatcatccgcatcatgagggtgctgagaattgcccgggtgctgaagctgctgaagatggccaccggcatgagggccctgctggacacagtggtgcaggccctgccccaggtgggcaacctgggcctgctcttcatgctgctcttcttcatctatgctgccctgggcgtggagctgtttgggaagctggtgtgcaatgatgagaacccctgtgagggcatgagcagacatgccacctttgaaaattttggcatggccttcctgaccctcttccaggtgtccactggagacaactggaatggcatcatgaaggacaccctgcgggactgcacccatgatgagaggagctgcctgagcagcctgcagtttgtgagccccctgtactttgtgtcctttgtgctgacagcccagtttgtgctgatcaacgtggtggtggccgtgctgatgaagcacctggatgacagcaacaaggaggcccaggaggatgctgagatggatgctgagctggagctggagatggcccacggcctgggccctggcccccggctgcccaccggcagccctggggcccctggccggggccctggaggagctgggggcggcggggacacagagggcggcctgtgccgccgctgctacagccctgcccaggagaacctgtggctggacagcgtgtccctcatcatcaaggacagcctggagggggagctgaccatcatcgacaacctgagcggcagcatcttccaccactacagcagccctgctggctgcaagaagtgccaccacgacaagcaggaggtgcagctggccgagacagaggccttcagcctgaacagcgacaggagcagcagcatcctgctgggagatgacctgagcctggaggaccccacagcctgccccccaggcaggaaggacagcaaaggagagctggaccccccagagcccatgagggtgggggacctgggggagtgcttcttccccctgagcagcacagctgtgtccccagaccctgagaacttcctgtgtgagatggaggagatccccttcaaccctgtgcgctcctggctgaagcatgacagcagccaggccccacccagccccttctccccagatgccagcagccccctgctgcccatgcctgctgagttcttccaccctgctgtgtctgccagccagaagggccctgagaagggcactggaacaggcaccctgcccaagatcgccctgcagggctcctgggccagcctgcggagcccccgggtgaactgcaccctgctgcggcaggccaccggcagtgacaccagcctggatgccagccccagcagcagcgctggcagcctgcagaccaccctggaggacagcctgaccctgagtgacagcccccggcgggccctgggccccccagccccagcccctggcccccgggccggcctgagccctgctgcccggcggcggctgagcctgcggggccggggcctcttcagcctgcggggcctgcgggcccaccagaggagccacagcagcggcggcagcaccagccctggctgcacccaccacgacagcatggaccccagtgatgaggagggccggggcggggccggcggcggcggggccggcagcgagcacagcgagaccctgagcagcctgagcctgaccagcctcttctgccccccacctcctcctccagcccctggcctgaccccagccaggaagttcagcagcaccagcagcctggccgcccctggccggccccacgccgccgccctggcccacggcctggcccggagccccagctgggccgctgacaggagcaaggaccccccaggccgggcccccctgcccatgggcctgggccccctggcccccccaccccagcccctgcccggggagctggagcctggagatgctgccagcaagaggaagaggtag

SEQ ID NO: 145876 - DNA, 5946 bp, Artificial Sequence
  Description of Artificial Sequence: Synthetic coding sequence
atggccgagagcgccagcccccccagcagcagcgctgctgccccagctgctgagcccggggtgaccacagagcagcccggccccaggagcccccccagcagccccccaggcctggaggagcccctggatggagctgacccccacgtgccccacccagacctggcccccatcgccttcttctgcctgcggcagaccaccagccccaggaactggtgcatcaagatggtgtgcaacccctggtttgaatgtgtgtccatgctggtgatcctgctgaactgtgtgaccctgggcatgtaccagccctgtgatgacatggactgcctgagtgaccgctgcaagatcctgcaggtgtttgatgacttcatcttcatcttctttgccatggagatggtgctgaagatggtggccctgggcatctttgggaagaagtgctacctgggggacacctggaaccggctggacttcttcatcgtgatggccggcatggtggagtacagcctggacctgcagaacatcaacctgagcgccatcagaacagtgcgggtgctgcggcccctgaaggccatcaacagagtgcccagcatgaggatcctggtgaacctgctgctggacaccctgcccatgctgggcaatgtgctgctgctgtgcttctttgtgttcttcatcttcggcatcatcggcgtgcagctgtgggccggcctgctgaggaaccgctgcttcctggaggagaacttcaccatccagggagatgtggccctgcccccctactaccagccagaagaagatgatgagatgcccttcatctgcagcctgagcggggacaatggcatcatgggctgccacgagatcccccccctgaaggagcagggccgggagtgctgcctgagcaaggatgatgtgtatgactttggagctggccggcaggacctgaatgccagcggcctgtgtgtgaactggaaccgctactacaacgtgtgcaggacaggcagcgccaacccccacaagggggccatcaactttgacaacatcggctacgcctggatcgtcatcttccaggtgatcaccctggagggctgggtggagatcatgtactacgtgatggatgcccacagcttctacaacttcatctacttcatcctgctgatcatcgtgggcagcttcttcatgatcaacctgtgcctggtggtgattgccacccagttcagcgagaccaagcagcgggagcaccggctgatgctggagcagaggcagcgctacctgagcagcagcacagtggccagctatgcagagcccggggactgctatgaggagatcttccagtatgtgtgccacatcctgaggaaggccaagagaagagccctgggcctgtaccaggccctgcagagccggcggcaggccctgggccctgaggccccagccccagccaagccaggcccccacgccaaggagcccaggcactaccagctgtgcccccagcacagccccctggatgccaccccccacaccctggtgcagcccatcccagccaccctggccagtgaccctgccagctgcccctgctgccagcatgaagatggaagaagacccagcggcctgggcagcacagattctggccaggagggcagcggcagcggcagcagcgctggaggagaagatgaagcagatggagatggagcccggagcagtgaagatggagccagcagcgagctgggcaaggaggaggaggaggaggagcaggctgatggagctgtgtggctgtgtggagatgtgtggagggagacccgggccaagctgcggggcatcgtggacagcaagtacttcaacagaggcatcatgatggccatcctggtgaacacagtgtccatgggcatcgagcaccacgagcagcctgaggagctgaccaacatcctggagatctgcaatgtggtgttcacctccatgtttgccctggagatgatcctgaagctggccgccttcggcctgtttgactacctgaggaacccctacaacatctttgacagcatcatcgtcatcatcagcatctgggagatcgtgggccaggctgatggcggcctgtctgtgctgcggaccttccggctgctgcgggtgctgaagctggtgcgcttcatgcctgccctgcggcggcagctggtggtgctgatgaagaccatggacaacgtggccaccttctgcatgctgctgatgctgttcatcttcatcttcagcatcctgggcatgcacatcttcggctgcaagttcagcctgaggacagacacaggagacacagtgcctgacaggaagaactttgacagcctgctgtgggccatcgtgaccgtcttccagatcctgacccaggaggactggaatgtggtgctgtacaacggcatggccagcaccagcccctgggccagcctgtactttgtggccctgatgacctttggaaactacgtgctcttcaacctgctggtggccatcctggtggagggcttccaggccgagggagatgccaacagaagctacagtgatgaggaccagagcagcagcaacatcgaggagtttgacaagctgcaggagggcctggacagcagcggggaccccaagctgtgccccatccccatgacccccaacggccacctggaccccagcctgcccctgggcggccacctgggccctgctggagctgctggccctgccccccggctgagcctgcagcctgaccccatgctggtggccctgggcagcaggaagagctctgtgatgagcctgggccgcatgtcctatgaccagaggagcctgagcagcagccgcagcagctactacggcccctggggccgctctgctgcctgggccagccgccgcagctcctggaacagcctgaagcacaagcccccatctgctgagcacgagagcctgctgtctgctgagcggggcggcggggcccgggtgtgtgaggtggccgcagatgagggccccccccgggccgcccccctgcacacccctcatgcccaccacatccaccacggcccccacctggcccaccgccaccgccaccacaggaggaccctgagcctggacaacagagattctgtggacctggccgagctggtgcctgctgtgggcgcccaccccagggctgcctggagggctgctggccctgcccctggccacgaggactgcaatggccgcatgcccagcatcgccaaggatgtgttcaccaagatgggagacagaggagacagaggagaagatgaggaggagattgactacaccctgtgcttccgggtgaggaagatgattgatgtgtacaagccagactggtgtgaggtgcgggaggactggagcgtgtacctgttctccccagaaaatcgcttccgggtgctgtgccagaccatcatcgcccacaagctgtttgattatgtggtgctggccttcatcttcctgaactgcatcaccatcgccctggagcggccccagattgaagctggcagcacagagcgcatcttcctgactgtgagcaactacatcttcaccgccatctttgtgggggagatgaccctgaaggtggtgtccctgggcctgtactttggagagcaggcctacctgcggagctcctggaatgtgctggatggcttcctggtgtttgtgtccatcatcgacatcgtggtgtccctggccagcgctggaggagccaagatcctgggcgtgctgcgggtgctgcggctgctgcggaccctgcggcccctgcgggtcatcagccgggcccctggcctgaagctggtggtggagaccctcatcagcagcctgaagcccatcggcaacatcgtgctgatctgctgtgccttcttcatcatcttcggcatcctgggcgtgcagctgttcaagggcaagttctaccactgcctgggcgtggacaccaggaacatcaccaacagaagtgactgcatggccgccaactaccgctgggtgcaccacaagtacaactttgacaacctgggccaggccctgatgagcctgtttgtgctggccagcaaggatggctgggtgaacatcatgtacaacggcctggatgctgtggccgtggaccagcagcctgtgaccaaccacaacccctggatgctgctgtacttcatctccttcctgctgattgtgtccttctttgtgctgaacatgtttgtgggcgtggtggtggagaacttccacaagtgccggcagcaccaggaggccgaggaggccaggagaagagaggagaagaggctgcggcggctggagaagaagaggaggaaggcccagaggctgccctactatgccacctactgccacacccggctgctgatccacagcatgtgcaccagccactacctggacatcttcatcaccttcatcatctgcctgaatgtggtgaccatgagcctggagcactacaaccagcccaccagcctggagacagccctgaagtactgcaactacatgttcaccaccgtgtttgtgctggaggccgtgctgaagctggtggccttcggcctgcggcgcttcttcaaggaccgctggaaccagctggacctggccatcgtgctgctgtctgtgatgggcatcaccctggaggagattgagatcaatgctgccctgcccatcaaccccaccatcatccgcatcatgagggtgctgagaattgcccgggtgctgaagctgctgaagatggccaccggcatgagggccctgctggacacagtggtgcaggccctgccccaggtgggcaacctgggcctgctcttcatgctgctcttcttcatctatgctgccctgggcgtggagctgtttgggaagctggtgtgcaatgatgagaacccctgtgagggcatgagcagacatgccacctttgaaaattttggcatggccttcctgaccctcttccaggtgtccactggagacaactggaatggcatcatgaaggacaccctgcgggactgcacccatgatgagaggagctgcctgagcagcctgcagtttgtgagccccctgtactttgtgtcctttgtgctgacagcccagtttgtgctgatcaacgtggtggtggccgtgctgatgaagcacctggatgacagcaacaaggaggcccaggaggatgctgagatggatgctgagctggagctggagatggcccacggcctgggccctggcccccggctgcccaccggcagccctggggcccctggccggggccctggaggagctgggggcggcggggacacagagggcggcctgtgccgccgctgctacagccctgcccaggagaacctgtggctggacagcgtgtccctcatcatcaaggacagcctggagggggagctgaccatcatcgacaacctgagcggcagcatcttccaccactacagcagccctgctggctgcaagaagtgccaccacgacaagcaggaggtgcagctggccgagacagaggccttcagcctgaacagcgacaggagcagcagcatcctgctgggagatgacctgagcctggaggaccccacagcctgccccccaggcaggaaggacagcaaaggagagctggaccccccagagcccatgagggtgggggacctgggggagtgcttcttccccctgagcagcacagctgtgtccccagaccctgagaacttcctgtgtgagatggaggagatccccttcaaccctgtgcgctcctggctgaagcatgacagcagccaggccccacccagccccttctccccagatgccagcagccccctgctgcccatgcctgctgagttcttccaccctgctgtgtctgccagccagaagggccctgagaagggcactggaacaggcaccctgcccaagatcgccctgcagggctcctgggccagcctgcggagcccccgggtgaactgcaccctgctgcggcaggtgcccaccccaccccggccctag

SEQ ID NO: 145877 - DNA, 1041 bp, Artificial Sequence
  Description of Artificial Sequence: Synthetic coding sequence
atgatggacaagttcaggatgatcttccagttcctgcagagcaaccaggagagcttcatgaatggcatctgtggcatcatggccctggccagcgcccagatgtacagcgcctttgacttcaactgcccctgcctgcccggctacaatgctgcctacagcgctggcatcctgctggccccacccctggtgctcttcctgctgggcctggtgatgaacaacaacgtgtccatgctggccgaggagtggaagaggcccctgggccggcgggccaaggaccctgctgtgctgcgctacatgttctgcagcatggcccagagggccctgattgcccctgtggtgtgggtggccgtgaccctgctggatggcaagtgcttcctgtgtgccttctgcacagctgtgcctgtgtctgccctgggcaatggcagcctggcccctggcctgcctgcccctgagctggcccggctgctggcccgggtgccctgcccagagatctatgatggagactggctgctggcccgggaggtggccgtgcgctacctgcgctgcatcagccaggccctgggctggagctttgtgctgctgaccaccctgctggcctttgtggtgcgctctgtgcggccctgcttcacccaggccgccttcctgaagagcaagtactggagccactacatcgacatcgagaggaagctgtttgatgagacctgcacagagcacgccaaggcctttgccaaggtgtgcatccagcagttctttgaggccatgaaccacgacctggagctgggccacacccacggcaccctggccacagccccagccagcgctgctgcccccaccaccccagatggagctgaggaggagcgggagaagctgcggggcatcacagaccagggcaccatgaaccggctgctgacctcctggcacaagtgcaagccacccctgcggctgggccaggaggagccccccctgatgggaaatggctgggccggcggcggcccccggccccccaggaaggaggtggccacctacttcagcaaggtgtag

SEQ ID NO: 145878 - DNA, 972 bp, Artificial Sequence
  Description of Artificial Sequence: Synthetic coding sequence
atggccgccctgattgctgagaacttccgcttcctgagcctcttcttcaagagcaaggatgtgatgatcttcaacggcctggtggccctgggcaccgtgggcagccaggagctgttctctgtggtggccttccactgcccctgcagccctgccaggaactacctgtatggcctggccgccatcggcgtgcctgccctggtgctcttcatcatcggcatcatcctgaacaaccacacctggaacctggtggccgagtgccagcacaggaggaccaagaactgcagcgctgcccccaccttcctgctgctgagcagcatcctgggccgggctgctgtggcccctgtgacctggagcgtcatcagcctgctgcggggggaggcctacgtgtgtgccctgtctgaatttgtggaccccagcagcctgacagcccgggaggagcacttccccagcgcccacgccacagagatcctggcccgcttcccctgcaaggagaacccagacaacctgagtgacttccgggaggaggtgtcccggcggctgcgctatgagagccagctgtttggctggctgctgattggagtggtggccatcctggtgttcctgaccaagtgcctgaagcactactgcagccccctgagctaccggcaggaggcctactgggcccagtaccgggccaatgaagaccagctgttccagaggacagctgaggtgcacagccgggtgctggccgccaacaacgtgcggcgcttctttggatttgtggccctgaacaaggatgatgaggagctgattgccaacttccctgtggagggcacccagccccggccccagtggaatgccatcaccggggtgtacctgtaccgggagaaccagggcctgcccctgtacagccggctgcacaagtgggcccagggcctggccggaaatggagctgccccagacaacgtggagatggccctgctgcccagctag

SEQ ID NO: 145879 - DNA, 972 bp, Artificial Sequence; identical to SEQ ID NO: 145878
  Description of Artificial Sequence: Synthetic coding sequence

SEQ ID NO: 145880 - DNA, 657 bp, Artificial Sequence
  Description of Artificial Sequence: Synthetic coding sequence
atggccgccctgattgctgagaacttccgcttcctgagcctcttcttcaagagcaaggatgtgatgatcttcaacggcctggtggccctgggcaccgtgggcagccaggagctgttctctgtggtggccttccactgcccctgcagccctgccaggaactacctgtatggcctggccgccatcggcgtgcctgccctggtgctcttcatcatcggcatcatcctgaacaaccacacctggaacctggtggccgagtgccagcacaggaggaccaagaactgcagcgctgcccccaccttcctgctgctgagcagcatcctgggccgggctgctgtggcccctgtgacctggagcgtcatcagcctgctgcggggggaggcctacgtgtgtgccctgtctgaatttgtggaccccagcagcctgacagcccgggaggagcacttccccagcgcccacgccacagagatcctggcccgcttcccctgcaaggagaacccagacaacctgagtgacttccgggaggaggtgtcccggcggctgcgctatgagagccaggtgcgcagctgtgccaagggcagcagcagcagcctggtggtggccggggagaggtctggagatggcctggtgctgaagctgggcctggtgctgcggggctag

SEQ ID NO: 145881 - DNA, 891 bp, Artificial Sequence
  Description of Artificial Sequence: Synthetic coding sequence
atggagagcatggctgtggccacagatggaggagagaggcctggggtgcctgctggcagcggcctgagcgccagccagaggagagctgagctgcggcggaggaagctgctgatgaacagcgagcagaggatcaaccgcatcatgggcttccacaggcctggcagcggggctgaggaggagagccagaccaagagcaagcagcaggacagcgacaagctgaacagcctgtctgtgcccagcgtgtccaagagggtggtgctgggggacagcgtgtccacaggcaccacagaccagcagggcggcgtggccgaggtgaagggcacccagctgggggacaagctggacagcttcatcaagcccccagagtgcagcagtgatgtgaacctggagctgcggcagaggaacagaggagacctgacagctgacagcgtgcagaggggcagccgccacggcctggagcagtacctgagcagatttgaggaggccatgaagctgaggaagcagctgatcagcgagaagcccagccaggaggatggcaacaccacagaggagtttgacagcttccgcatcttccggctggtgggctgtgccctgctggccctgggcgtgcgggcctttgtgtgcaagtacctgagcatctttgcccccttcctgaccctgcagctggcctacatgggcctgtacaagtacttccccaagtctgagaagaagatcaagaccaccgtgctgacagctgccctgctgctgagcggcatcccagctgaggtgatcaacagatccatggacacctacagcaagatgggagaggtgttcacagacctgtgtgtgtacttcttcaccttcatcttctgccacgagctgctggactactggggcagcgaggtgccctag

SEQ ID NO: 145882 - DNA, 1113 bp, Artificial Sequence
  Description of Artificial Sequence: Synthetic coding sequence
atgctgggcgctgtggagggcccccgctggaagcaggccgaggacatccgggacatctatgacttcagagatgtgctgggcaccggggccttcagcgaggtgatcctggccgaggacaagaggacccagaagctggtggccatcaagtgcatcgccaaggaggccctggagggcaaggagggctccatggagaatgaaattgctgtgctgcacaagatcaagcaccccaacatcgtggccctggatgacatctatgaaagtggcggccacctgtacctgatcatgcagctggtgtctggaggagagctgtttgacagaattgtggagaagggcttctacacagaaagagatgccagccgcctcatcttccaggtgctggatgctgtgaagtacctgcatgacctgggcatcgtgcaccgggacctgaagccagagaacctgctgtactacagcctggatgaggacagcaagatcatgatcagtgactttggcctgagcaagatggaggaccccggctctgtgctgagcacagcctgtggcaccccaggctacgtggcccctgaggtgctggcccagaagccctacagcaaggctgtggactgctggagcattggagtgattgcctacatcctgctgtgtggctacccacccttctatgatgaaaatgatgccaagctgtttgagcagatcctgaaggccgagtatgaatttgacagcccctactgggatgacatcagtgacagcgccaaggacttcatccgccacctgatggagaaggaccctgagaagcgcttcacctgtgagcaggccctgcagcacccctggattgctggggacacagccctggacaagaacatccaccagagcgtgtctgagcagatcaagaagaactttgccaagagcaagtggaagcaggccttcaatgccacagctgtggtgcgccacatgaggaagctgcagctgggcaccagccaggagggccagggccagacagccagccacggggagctgctgacccctgtggccggcggccctgctgctggctgctgctgccgggactgctgcgtggagcccggcacagagctgagccccaccctgccccaccagctgtag

SEQ ID NO: 145883 - DNA, 1437 bp, Artificial Sequence
  Description of Artificial Sequence: Synthetic coding sequence
atggccaccatcacctgcacccgcttcacagaggagtaccagctgtttgaggagctgggcaaaggagccttctctgtggtgcggcgctgtgtgaaggtgctggccggccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggccaccactacctgatctttgacctggtgactggaggagagctgtttgaagatattgtggcccgggagtactacagcgaggctgatgccagccactgcatccagcagatcctggaggccgtgctgcactgccaccagatgggcgtggtgcaccgggacctgaagccagagaacctgctgctggccagcaagctgaagggagctgctgtgaagctggccgactttggcctggccatcgaggtggagggggagcagcaggcctggtttggatttgctggcaccccaggctacctgagccctgaggtgctgaggaaggacccctacggcaagcctgtggacctgtgggcctgtggggtcatcctgtacatcctgctggtgggctacccacccttctgggatgaggaccagcaccggctgtaccagcagatcaaggccggggcctatgacttccccagccctgagtgggacacagtgaccccagaggccaaggacctgatcaacaagatgctgaccatcaaccccagcaagaggatcacagctgctgaggccctgaagcacccctggatcagccacaggagcacagtggccagctgcatgcaccggcaggagaccgtggactgcctgaagaagttcaatgcccggaggaagctgaagggggccatcctgaccaccatgctggccaccaggaacttcagcggcggcaagagcggcggcaacaagaagagtgatggagtgaaggagagcagcgagagcaccaacaccaccattgaagatgaggacaccaaggtgaggaagcaggagatcatcaaggtgacagagcagctgattgaggccatcagcaatggagactttgagagctacaccaagatgtgtgaccccggcatgacagcctttgagcctgaggccctgggcaacctggtggagggcctggacttccaccgcttctactttgagaacctgtggagcaggaacagcaagcctgtgcacaccaccatcctgaacccccacatccacctgatgggagatgagagcgcctgcatcgcctacatccgcatcacccagtacctggatgctgggggcatccccaggacagcccagagcgaggagaccagggtgtggcacagaagagatggcaagtggcagatcgtgcacttccacaggtctggggcccccagcgtgctgccccactag

SEQ ID NO: 145884 - DNA, 1470 bp, Artificial Sequence
  Description of Artificial Sequence: Synthetic coding sequence
atggccaccatcacctgcacccgcttcacagaggagtaccagctgtttgaggagctgggcaaaggagccttctctgtggtgcggcgctgtgtgaaggtgctggccggccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggccaccactacctgatctttgacctggtgactggaggagagctgtttgaagatattgtggcccgggagtactacagcgaggctgatgccagccactgcatccagcagatcctggaggccgtgctgcactgccaccagatgggcgtggtgcaccgggacctgaagccagagaacctgctgctggccagcaagctgaagggagctgctgtgaagctggccgactttggcctggccatcgaggtggagggggagcagcaggcctggtttggatttgctggcaccccaggctacctgagccctgaggtgctgaggaaggacccctacggcaagcctgtggacctgtgggcctgtggggtcatcctgtacatcctgctggtgggctacccacccttctgggatgaggaccagcaccggctgtaccagcagatcaaggccggggcctatgacttccccagccctgagtgggacacagtgaccccagaggccaaggacctgatcaacaagatgctgaccatcaaccccagcaagaggatcacagctgctgaggccctgaagcacccctggatcagccacaggagcacagtggccagctgcatgcaccggcaggagaccgtggactgcctgaagaagttcaatgcccggaggaagctgaagggggccatcctgaccaccatgctggccaccaggaacttcagcggcggcaagagcggcggcaacaagaagagtgatggagtgaagaagaggaagagcagcagctctgtgcagctgatggagagcagcgagagcaccaacaccaccattgaagatgaggacaccaaggtgaggaagcaggagatcatcaaggtgacagagcagctgattgaggccatcagcaatggagactttgagagctacaccaagatgtgtgaccccggcatgacagcctttgagcctgaggccctgggcaacctggtggagggcctggacttccaccgcttctactttgagaacctgtggagcaggaacagcaagcctgtgcacaccaccatcctgaacccccacatccacctgatgggagatgaaagtgcctgcatcgcctacatccgcatcacccagtacctggatgctgggggcatccccaggacagcccagagcgaggagaccagggtgtggcacagaagagatggcaagtggcagatcgtgcacttccacaggtctggggcccccagcgtgctgccccactag

SEQ ID NO: 145885 - DNA, 276 bp, Artificial Sequence
  Description of Artificial Sequence: Synthetic coding sequence
atggccaccatcacctgcacccgcttcacagaggagtaccagctgtttgaggagctgggcaaaggagccttctctgtggtgcggcgctgtgtgaaggtgctggccggccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggccaccactacctgatctttgacctgtag

SEQ ID NO: 145886 - DNA, 1554 bp, Artificial Sequence
  Description of Artificial Sequence: Synthetic coding sequence
atggccaccaccgtgacctgcacccgcttcacagatgagtaccagctgtatgaggacatcggcaagggggccttctctgtggtgagaagatgtgtgaagctgtgcaccggccacgagtatgctgccaagatcatcaacaccaagaagctgagcgcccgggaccaccagaagctggagcgggaggcccgcatctgccgcctgctgaagcacagcaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggaggccgtgctgcactgccaccagatgggcgtggtgcaccgggacctgaagccagagaacctgctgctggccagcaaatgtaaaggagctgctgtgaagctggccgactttggcctggccatcgaggtgcagggcgaccagcaggcctggtttggatttgctggcaccccaggctacctgagccctgaggtgctgaggaaggaggcctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagcccacgaggccctgaagcacccctgggtgtgccagaggagcacagtggcctccatgatgcaccggcaggagaccgtggagtgcctgaagaagttcaatgcccggaggaagctgaagggggccatcctgaccaccatgctggccaccaggaacttcagcgccaagagcctgctgaacaagaaggcagatggagtgaagccccagaccaacagcaccaagaacagcgctgctgccaccagccccaagggcaccctgcccccagctgccctggagccccagaccaccgtcatccacaaccctgtggatggcatcaaggagagcagtgacagcgccaacaccaccattgaagatgaagatgccaaggccaggaagcaggagatcatcaagaccacagagcagctgattgaagctgtgaacaacggggactttgaggcctatgccaagatctgtgaccccggcctgaccagctttgagcctgaggccctgggcaacctggtggagggcatggacttccaccgcttctactttgagaacctgctggccaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggcagaatgtgcacttccactgcagcggggcccctgtggcccccctgcagtag

SEQ ID NO: 145887 - DNA, 1350 bp, Artificial Sequence
  Description of Artificial Sequence: Synthetic coding sequence
atggccaccaccgtgacctgcacccgcttcacagatgagtaccagctgtatgaggacatcggcaagggggccttctctgtggtgagaagatgtgtgaagctgtgcaccggccacgagtatgctgccaagatcatcaacaccaagaagctgagcgcccgggaccaccagaagctggagcgggaggcccgcatctgccgcctgctgaagcacagcaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggaggccgtgctgcactgccaccagatgggcgtggtgcaccgggacctgaagccagagaacctgctgctggccagcaaatgtaaaggagctgctgtgaagctggccgactttggcctggccatcgaggtgcagggcgaccagcaggcctggtttggatttgctggcaccccaggctacctgagccctgaggtgctgaggaaggaggcctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagcccacgaggccctgaagcacccctgggtgtgccagaggagcacagtggcctccatgatgcaccggcaggagaccgtggagtgcctgaagaagttcaatgcccggaggaagctgaagggggccatcctgaccaccatgctggccaccaggaacttcagcgccaggaagcaggagatcatcaagaccacagagcagctgattgaagctgtgaacaacggggactttgaggcctatgccaagatctgtgaccccggcctgaccagctttgagcctgaggccctgggcaacctggtggagggcatggacttccaccgcttctactttgagaacctgctggccaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggcagaatgtgcacttccactgcagcggggcccctgtggcccccctgcagtag

SEQ ID NO: 145888 - DNA, 1479 bp, Artificial Sequence
  Description of Artificial Sequence: Synthetic coding sequence
atggccaccaccgtgacctgcacccgcttcacagatgagtaccagctgtatgaggacatcggcaagggggccttctctgtggtgagaagatgtgtgaagctgtgcaccggccacgagtatgctgccaagatcatcaacaccaagaagctgagcgcccgggaccaccagaagctggagcgggaggcccgcatctgccgcctgctgaagcacagcaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggaggccgtgctgcactgccaccagatgggcgtggtgcaccgggacctgaagccagagaacctgctgctggccagcaaatgtaaaggagctgctgtgaagctggccgactttggcctggccatcgaggtgcagggcgaccagcaggcctggtttggatttgctggcaccccaggctacctgagccctgaggtgctgaggaaggaggcctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagcccacgaggccctgaagcacccctgggtgtgccagaggagcacagtggcctccatgatgcaccggcaggagaccgtggagtgcctgaagaagttcaatgcccggaggaagctgaagggggccatcctgaccaccatgctggccaccaggaacttctctgtgggccggcagaccacagccccagccaccatgagcacagctgccagcggcaccaccatgggcctggtggagcaggccaagagcctgctgaacaagaaggcagatggagtgaaggagccccagaccaccgtcatccacaaccctgtggatggcatcaaggagagcagtgacagcgccaacaccaccattgaagatgaagatgccaaggccaggaagcaggagatcatcaagaccacagagcagctgattgaggccgtgaacaatggagactttgaggcctatgccttctactttgagaacctgctggccaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggcagaatgtgcacttccactgcagcggggcccctgtggcccccctgcagtag

SEQ ID NO: 145889 - DNA, 1629 bp, Artificial Sequence
  Description of Artificial Sequence: Synthetic coding sequence
atggccaccaccgtgacctgcacccgcttcacagatgagtaccagctgtatgaggacatcggcaagggggccttctctgtggtgagaagatgtgtgaagctgtgcaccggccacgagtatgctgccaagatcatcaacaccaagaagctgagcgcccgggaccaccagaagctggagcgggaggcccgcatctgccgcctgctgaagcacagcaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggaggccgtgctgcactgccaccagatgggcgtggtgcaccgggacctgaagccagagaacctgctgctggccagcaaatgtaaaggagctgctgtgaagctggccgactttggcctggccatcgaggtgcagggcgaccagcaggcctggtttggatttgctggcaccccaggctacctgagccctgaggtgctgaggaaggaggcctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagcccacgaggccctgaagcacccctgggtgtgccagaggagcacagtggcctccatgatgcaccggcaggagaccgtggagtgcctgaagaagttcaatgcccggaggaagctgaagggggccatcctgaccaccatgctggccaccaggaacttctctgtgggccggcagaccacagccccagccaccatgagcacagctgccagcggcaccaccatgggcctggtggagcaggccaagagcctgctgaacaagaaggcagatggagtgaagccccagaccaacagcaccaagaacagcgctgctgccaccagccccaagggcaccctgcccccagctgccctggagccccagaccaccgtcatccacaaccctgtggatggcatcaaggagagcagtgacagcgccaacaccaccattgaagatgaagatgccaaggccaggaagcaggagatcatcaagaccacagagcagctgattgaggccgtgaacaatggagactttgaggcctatgccaagatctgtgaccccggcctgaccagctttgagcctgaggccctgggcaacctggtggagggcatggacttccaccgcttctactttgagaacctgctggccaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggcagaatgtgcacttccactgcagcggggcccctgtggcccccctgcagtag

SEQ ID NO: 145890 - DNA, 1440 bp, Artificial Sequence
  Description of Artificial Sequence: Synthetic coding sequence
atggccaccaccgtgacctgcacccgcttcacagatgagtaccagctgtatgaggacatcggcaagggggccttctctgtggtgagaagatgtgtgaagctgtgcaccggccacgagtatgctgccaagatcatcaacaccaagaagctgagcgcccgggaccaccagaagctggagcgggaggcccgcatctgccgcctgctgaagcacagcaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggaggccgtgctgcactgccaccagatgggcgtggtgcaccgggacctgaagccagagaacctgctgctggccagcaaatgtaaaggagctgctgtgaagctggccgactttggcctggccatcgaggtgcagggcgaccagcaggcctggtttggatttgctggcaccccaggctacctgagccctgaggtgctgaggaaggaggcctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagcccacgaggccctgaagcacccctgggtgtgccagaggagcacagtggcctccatgatgcaccggcaggagaccgtggagtgcctgaagaagttcaatgcccggaggaagctgaagggggccatcctgaccaccatgctggccaccaggaacttctctgctgccaagagcctgctgaacaagaaggcagatggagtgaaggagagcagtgacagcgccaacaccaccattgaagatgaagatgccaaggccaggaagcaggagatcatcaagaccacagagcagctgattgaagctgtgaacaacggggactttgaggcctatgccaagatctgtgaccccggcctgaccagctttgagcctgaggccctgggcaacctggtggagggcatggacttccaccgcttctactttgagaacctgctggccaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggcagaatgtgcacttccactgcagcggggcccctgtggcccccctgcagtag

SEQ ID NO: 145891 - DNA, 1512 bp, Artificial Sequence
  Description of Artificial Sequence: Synthetic coding sequence
atggccaccaccgtgacctgcacccgcttcacagatgagtaccagctgtatgaggacatcggcaagggggccttctctgtggtgagaagatgtgtgaagctgtgcaccggccacgagtatgctgccaagatcatcaacaccaagaagctgagcgcccgggaccaccagaagctggagcgggaggcccgcatctgccgcctgctgaagcacagcaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggaggccgtgctgcactgccaccagatgggcgtggtgcaccgggacctgaagccagagaacctgctgctggccagcaaatgtaaaggagctgctgtgaagctggccgactttggcctggccatcgaggtgcagggcgaccagcaggcctggtttggatttgctggcaccccaggctacctgagccctgaggtgctgaggaaggaggcctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagcccacgaggccctgaagcacccctgggtgtgccagaggagcacagtggcctccatgatgcaccggcaggagaccgtggagtgcctgaagaagttcaatgcccggaggaagctgaagggggccatcctgaccaccatgctggccaccaggaacttctctgctgccaagagcctgctgaacaagaaggcagatggagtgaagccccagaccaacagcaccaagaacagcgctgctgccaccagccccaagggcaccctgcccccagctgccctggagagcagtgacagcgccaacaccaccattgaagatgaagatgccaaggccaggaagcaggagatcatcaagaccacagagcagctgattgaagctgtgaacaacggggactttgaggcctatgccaagatctgtgaccccggcctgaccagctttgagcctgaggccctgggcaacctggtggagggcatggacttccaccgcttctactttgagaacctgctggccaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggcagaatgtgcacttccactgcagcggggcccctgtggcccccctgcagtag

SEQ ID NO: 145892 - DNA, 1557 bp, Artificial Sequence
  Description of Artificial Sequence: Synthetic coding sequence
atggccaccaccgtgacctgcacccgcttcacagatgagtaccagctgtatgaggacatcggcaagggggccttctctgtggtgagaagatgtgtgaagctgtgcaccggccacgagtatgctgccaagatcatcaacaccaagaagctgagcgcccgggaccaccagaagctggagcgggaggcccgcatctgccgcctgctgaagcacagcaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggaggccgtgctgcactgccaccagatgggcgtggtgcaccgggacctgaagccagagaacctgctgctggccagcaaatgtaaaggagctgctgtgaagctggccgactttggcctggccatcgaggtgcagggcgaccagcaggcctggtttggatttgctggcaccccaggctacctgagccctgaggtgctgaggaaggaggcctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagcccacgaggccctgaagcacccctgggtgtgccagaggagcacagtggcctccatgatgcaccggcaggagaccgtggagtgcctgaagaagttcaatgcccggaggaagctgaagggggccatcctgaccaccatgctggccaccaggaacttctctgctgccaagagcctgctgaacaagaaggcagatggagtgaagccccagaccaacagcaccaagaacagcgctgctgccaccagccccaagggcaccctgcccccagctgccctggagccccagaccaccgtcatccacaaccctgtggatggcatcaaggagagcagtgacagcgccaacaccaccattgaagatgaagatgccaaggccaggaagcaggagatcatcaagaccacagagcagctgattgaggccgtgaacaatggagactttgaggcctatgccaagatctgtgaccccggcctgaccagctttgagcctgaggccctgggcaacctggtggagggcatggacttccaccgcttctactttgagaacctgctggccaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggcagaatgtgcacttccactgcagcggggcccctgtggcccccctgcagtag

SEQ ID NO: 145893 - DNA, 2001 bp, Artificial Sequence
  Description of Artificial Sequence: Synthetic coding sequence
atggccaccaccgtgacctgcacccgcttcacagatgagtaccagctgtatgaggacatcggcaagggggccttctctgtggtgagaagatgtgtgaagctgtgcaccggccacgagtatgctgccaagatcatcaacaccaagaagctgagcgcccgggaccaccagaagctggagcgggaggcccgcatctgccgcctgctgaagcacagcaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggaggccgtgctgcactgccaccagatgggcgtggtgcaccgggacctgaagccagagaacctgctgctggccagcaaatgtaaaggagctgctgtgaagctggccgactttggcctggccatcgaggtgcagggcgaccagcaggcctggtttggatttgctggcaccccaggctacctgagccctgaggtgctgaggaaggaggcctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagcccacgaggccctgaagcacccctgggtgtgccagaggagcacagtggcctccatgatgcaccggcaggagaccgtggagtgcctgaagaagttcaatgcccggaggaagctgaagggggccatcctgaccaccatgctggccaccaggaacttctctgtgggccggcagaccacagccccagccaccatgagcacagctgccagcggcaccaccatgggcctggtggagcaggccaagagcctgctgaacaagaaggcagatggagtgaagccccagaccaacagcaccaagaacagcgctgctgccaccagccccaagggcaccctgcccccagctgccctggagccccagaccaccgtcatccacaaccctgtggatggcatcaaggagagcagtgacagcgccaacaccaccattgaagatgaagatgccaaggccccccgggtgcctgacatcctgagctctgtgcggcggggcagcggggcccctgaggccgagggccccctgccctgccccagccctgcccccttcagccccctgcctgcccccagcccccgcatcagtgacatcctgaacagcgtgcggcggggcagcggcaccccagaggccgagggccccctgtctgctggccccccaccctgcctgagccctgccctgctgggccccctgagcagccccagcccccgcatcagtgacatcctgaacagcgtgagaagaggcagcggcaccccagaggccgagggccccagccctgtgggccccccaccctgccccagccccaccatccctggccccctgcccacccccagcaggaagcaggagatcatcaagaccacagagcagctgattgaggccgtgaacaatggagactttgaggcctatgccaagatctgtgaccccggcctgaccagctttgagcctgaggccctgggcaacctggtggagggcatggacttccaccgcttctactttgagaacctgctggccaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggcagaatgtgcacttccactgcagcggggcccctgtggcccccctgcagtag

SEQ ID NO: 145894 - DNA, 1629 bp, Artificial Sequence; identical to SEQ ID NO: 145889
  Description of Artificial Sequence: Synthetic coding sequence

SEQ ID NO: 145895 - DNA, 1557 bp, Artificial Sequence; identical to SEQ ID NO: 145892
  Description of Artificial Sequence: Synthetic coding sequence

SEQ ID NO: 145896 - DNA, 918 bp, Artificial Sequence
  Description of Artificial Sequence: Synthetic coding sequence
atgggcgtggtgcaccgggacctgaagccagagaacctgctgctggccagcaagtgcaagggagctgctgtgaagctggccgactttggcctggccatcgaggtgcagggcgaccagcaggcctggtttggatttgctggcaccccaggctacctgagccctgaggtgctgaggaaggaggcctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagcccacgaggccctgaagcacccctgggtgtgccagaggagcacagtggcctccatgatgcaccggcaggagaccgtggagtgcctgaagaagttcaatgcccggaggaagctgaagggggccatcctgaccaccatgctggccaccaggaacttctctgtgggccggcagaccacagccccagccaccatgagcacagctgccagcggcaccaccatgggcctggtggagcaggccaagagcctgctgaacaagaaggcagatggagtgaagccccagaccaacagcaccaagaacagcgctgctgccaccagccccaagggcaccctgcccccagctgccctggagccccagaccaccgtcatccacaaccctgtggatggcatcaaggagagcagtgacagcgccaacaccaccattgaagatgaagatgccaaggccaggaagcaggagatcatcaagaccacagagcagctgattgaagctgtgaacaacggggactttgaggcctatgcctag

SEQ ID NO: 145897 - DNA, 1437 bp, Artificial Sequence
  Description of Artificial Sequence: Synthetic coding sequence
atggccagcaccaccacctgcacccgcttcacagatgagtaccagctgtttgaggagctgggcaagggggccttctctgtggtgcggcgctgcatgaagatccccaccggccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggagagcgtgaaccactgccacctgaatggcatcgtgcaccgggacctgaagccagagaacctgctgctggccagcaagagcaaaggagctgctgtgaagctggccgactttggcctggccatcgaggtgcagggcgaccagcaggcctggtttggatttgctggcaccccaggctacctgagccctgaggtgctgaggaaggacccctacggcaagcctgtggacatgtgggcctgtggggtcatcctgtacatcctgctggtgggctacccacccttctgggatgaggaccagcaccggctgtaccagcagatcaaggccggggcctatgacttccccagccctgagtgggacacagtgaccccagaggccaaggacctgatcaacaagatgctgaccatcaacccagccaagaggatcacagccagcgaggccctgaagcacccctggatctgccagaggagcacagtggcctccatgatgcaccggcaggagaccgtggactgcctgaagaagttcaatgcccggaggaagctgaagggggccatcctgaccaccatgctggccaccaggaacttctctgctgccaagagcctgctgaagaagccagatggagtgaaggagagcacagagagcagcaacaccaccattgaagatgaagatgtgaaggccaggaagcaggagatcatcaaggtgacagagcagctgattgaggccatcaacaatggagactttgaggcctacaccaagatctgtgaccccggcctgacagcctttgagcctgaggccctgggcaacctggtggagggcatggacttccaccgcttctactttgaaaatgccctgagcaagagcaacaagcccatccacaccatcatcctgaacccccacgtgcacctggtgggagatgatgctgcctgcatcgcctacatccggctgacccagtacatggatggcagcggcatgcccaagaccatgcagagcgaggagaccagggtgtggcacagaagagatggcaagtggcagaatgtgcacttccacaggagcggcagccccaccgtgcccatcaagtag

SEQ ID NO: 145898 - DNA, 1500 bp, Artificial Sequence
  Description of Artificial Sequence: Synthetic coding sequence
atggccagcaccaccacctgcacccgcttcacagatgagtaccagctgtttgaggagctgggcaagggggccttctctgtggtgcggcgctgcatgaagatccccaccggccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggagagcgtgaaccactgccacctgaatggcatcgtgcaccgggacctgaagccagagaacctgctgctggccagcaagagcaaaggagctgctgtgaagctggccgactttggcctggccatcgaggtgcagggcgaccagcaggcctggtttggatttgctggcaccccaggctacctgagccctgaggtgctgaggaaggacccctacggcaagcctgtggacatgtgggcctgtggggtcatcctgtacatcctgctggtgggctacccacccttctgggatgaggaccagcaccggctgtaccagcagatcaaggccggggcctatgacttccccagccctgagtgggacacagtgaccccagaggccaaggacctgatcaacaagatgctgaccatcaacccagccaagaggatcacagccagcgaggccctgaagcacccctggatctgccagaggagcacagtggcctccatgatgcaccggcaggagaccgtggactgcctgaagaagttcaatgcccggaggaagctgaagggggccatcctgaccaccatgctggccaccaggaacttctctgctgccaagagcctgctgaagaagccagatggagtgaaggagagcacagagagcagcaacaccaccattgaagatgaagatgtgaaggccaggaagcaggagatcatcaaggtgacagagcagctgattgaggccatcaacaatggagactttgaggcctacaccaagatctgtgaccccggcctgacagcctttgagcctgaggccctgggcaacctggtggagggcatggacttccaccgcttctactttgaaaatgccctgagcaagagcaacaagcccatccacaccatcatcctgaacccccacgtgcacctggtgggagatgatgctgcctgcatcgcctacatccggctgacccagtacatggatggcagcggcatgcccaagaccatgcagagcgaggagaccagggtgtggcacagaagagatggcaagtggcagaatgtgcacttccacaggagcggcagccccaccgtgcccatcaagccaccctgcatccccaacgggaaggagaacttcagcggcggcaccagcctgtggcagaacatctag

SEQ ID NO: 145899 - DNA, 1437 bp, Artificial Sequence; identical to SEQ ID NO: 145897
  Description of Artificial Sequence: Synthetic coding sequence

SEQ ID NO: 145900 - DNA, 1479 bp, Artificial Sequence
  Description of Artificial Sequence: Synthetic coding sequence
atggccagcaccaccacctgcacccgcttcacagatgagtaccagctgtttgaggagctgggcaagggggccttctctgtggtgcggcgctgcatgaagatccccaccggccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggagagcgtgaaccactgccacctgaatggcatcgtgcaccgggacctgaagccagagaacctgctgctggccagcaagagcaaaggagctgctgtgaagctggccgactttggcctggccatcgaggtgcagggcgaccagcaggcctggtttggatttgctggcaccccaggctacctgagccctgaggtgctgaggaaggacccctacggcaagcctgtggacatgtgggcctgtggggtcatcctgtacatcctgctggtgggctacccacccttctgggatgaggaccagcaccggctgtaccagcagatcaaggccggggcctatgacttccccagccctgagtgggacacagtgaccccagaggccaaggacctgatcaacaagatgctgaccatcaacccagccaagaggatcacagccagcgaggccctgaagcacccctggatctgccagaggagcacagtggcctccatgatgcaccggcaggagaccgtggactgcctgaagaagttcaatgcccggaggaagctgaagggggccatcctgaccaccatgctggccaccaggaacttctctgctgccaagagcctgctgaagaagccagatggagtgaaggagccccagaccaccgtcatccacaacccagatggcaacaaggagagcacagagagcagcaacaccaccattgaagatgaagatgtgaaggccaggaagcaggagatcatcaaggtgacagagcagctgattgaggccatcaacaatggagactttgaggcctacaccaagatctgtgaccccggcctgacagcctttgagcctgaggccctgggcaacctggtggagggcatggacttccaccgcttctactttgaaaatgccctgagcaagagcaacaagcccatccacaccatcatcctgaacccccacgtgcacctggtgggagatgatgctgcctgcatcgcctacatccggctgacccagtacatggatggcagcggcatgcccaagaccatgcagagcgaggagaccagggtgtggcacagaagagatggcaagtggcagaatgtgcacttccacaggagcggcagccccaccgtgcccatcaagtag

SEQ ID NO: 145901 - DNA, 1533 bp, Artificial Sequence
  Description of Artificial Sequence: Synthetic coding sequence
atggccagcaccaccacctgcacccgcttcacagatgagtaccagctgtttgaggagctgggcaagggggccttctctgtggtgcggcgctgcatgaagatccccaccggccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggagagcgtgaaccactgccacctgaatggcatcgtgcaccgggacctgaagccagagaacctgctgctggccagcaagagcaaaggagctgctgtgaagctggccgactttggcctggccatcgaggtgcagggcgaccagcaggcctggtttggatttgctggcaccccaggctacctgagccctgaggtgctgaggaaggacccctacggcaagcctgtggacatgtgggcctgtggggtcatcctgtacatcctgctggtgggctacccacccttctgggatgaggaccagcaccggctgtaccagcagatcaaggccggggcctatgacttccccagccctgagtgggacacagtgaccccagaggccaaggacctgatcaacaagatgctgaccatcaacccagccaagaggatcacagccagcgaggccctgaagcacccctggatctgccagaggagcacagtggcctccatgatgcaccggcaggagaccgtggactgcctgaagaagttcaatgcccggaggaagctgaagggggccatcctgaccaccatgctggccaccaggaacttctctgctgccaagagcctgctgaagaagccagatggagtgaagaagaggaagagcagcagctctgtgcagatgatggagagcacagagagcagcaacaccaccattgaagatgaagatgtgaaggccaggaagcaggagatcatcaaggtgacagagcagctgattgaggccatcaacaacggggactttgaggcctacaccaagatctgtgaccccggcctgacagcctttgagcctgaggccctgggcaacctggtggagggcatggacttccaccgcttctactttgaaaatgccctgagcaagagcaacaagcccatccacaccatcatcctgaacccccacgtgcacctggtgggagatgatgctgcctgcatcgcctacatccggctgacccagtacatggatggcagcggcatgcccaagaccatgcagagcgaggagaccagggtgtggcacagaagagatggcaagtggcagaatgtgcacttccacaggagcggcagccccaccgtgcccatcaagccaccctgcatccccaacgggaaggagaacttcagcggcggcaccagcctgtggcagaacatctag

SEQ ID NO: 145902 - DNA, 1542 bp, Artificial Sequence
  Description of Artificial Sequence: Synthetic coding sequence
atggccagcaccaccacctgcacccgcttcacagatgagtaccagctgtttgaggagctgggcaagggggccttctctgtggtgcggcgctgcatgaagatccccaccggccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggagagcgtgaaccactgccacctgaatggcatcgtgcaccgggacctgaagccagagaacctgctgctggccagcaagagcaaaggagctgctgtgaagctggccgactttggcctggccatcgaggtgcagggcgaccagcaggcctggtttggatttgctggcaccccaggctacctgagccctgaggtgctgaggaaggacccctacggcaagcctgtggacatgtgggcctgtggggtcatcctgtacatcctgctggtgggctacccacccttctgggatgaggaccagcaccggctgtaccagcagatcaaggccggggcctatgacttccccagccctgagtgggacacagtgaccccagaggccaaggacctgatcaacaagatgctgaccatcaacccagccaagaggatcacagccagcgaggccctgaagcacccctggatctgccagaggagcacagtggcctccatgatgcaccggcaggagaccgtggactgcctgaagaagttcaatgcccggaggaagctgaagggggccatcctgaccaccatgctggccaccaggaacttctctgctgccaagagcctgctgaagaagccagatggagtgaaggagccccagaccaccgtcatccacaacccagatggcaacaaggagagcacagagagcagcaacaccaccattgaagatgaagatgtgaaggccaggaagcaggagatcatcaaggtgacagagcagctgattgaggccatcaacaatggagactttgaggcctacaccaagatctgtgaccccggcctgacagcctttgagcctgaggccctgggcaacctggtggagggcatggacttccaccgcttctactttgaaaatgccctgagcaagagcaacaagcccatccacaccatcatcctgaacccccacgtgcacctggtgggagatgatgctgcctgcatcgcctacatccggctgacccagtacatggatggcagcggcatgcccaagaccatgcagagcgaggagaccagggtgtggcacagaagagatggcaagtggcagaatgtgcacttccacaggagcggcagccccaccgtgcccatcaagccaccctgcatccccaacgggaaggagaacttcagcggcggcaccagcctgtggcagaacatctag

SEQ ID NO: 145903 - DNA, 1560 bp, Artificial Sequence
  Description of Artificial Sequence: Synthetic coding sequence
atggccagcaccaccacctgcacccgcttcacagatgagtaccagctgtttgaggagctgggcaagggggccttctctgtggtgcggcgctgcatgaagatccccaccggccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggagagcgtgaaccactgccacctgaatggcatcgtgcaccgggacctgaagccagagaacctgctgctggccagcaagagcaaaggagctgctgtgaagctggccgactttggcctggccatcgaggtgcagggcgaccagcaggcctggtttggatttgctggcaccccaggctacctgagccctgaggtgctgaggaaggacccctacggcaagcctgtggacatgtgggcctgtggggtcatcctgtacatcctgctggtgggctacccacccttctgggatgaggaccagcaccggctgtaccagcagatcaaggccggggcctatgacttccccagccctgagtgggacacagtgaccccagaggccaaggacctgatcaacaagatgctgaccatcaacccagccaagaggatcacagccagcgaggccctgaagcacccctggatctgccagaggagcacagtggcctccatgatgcaccggcaggagaccgtggactgcctgaagaagttcaatgcccggaggaagctgaagggggccatcctgaccaccatgctggccaccaggaacttctctgctgccaagagcctgctgaagaagccagatggagtgaagatcaacaacaaggccaacgtggtgaccagccccaaggagaacatccccaccccagccctggagagcacagagagcagcaacaccaccattgaagatgaagatgtgaaggccaggaagcaggagatcatcaaggtgacagagcagctgattgaggccatcaacaatggagactttgaggcctacaccaagatctgtgaccccggcctgacagcctttgagcctgaggccctgggcaacctggtggagggcatggacttccaccgcttctactttgaaaatgccctgagcaagagcaacaagcccatccacaccatcatcctgaacccccacgtgcacctggtgggagatgatgctgcctgcatcgcctacatccggctgacccagtacatggatggcagcggcatgcccaagaccatgcagagcgaggagaccagggtgtggcacagaagagatggcaagtggcagaatgtgcacttccacaggagcggcagccccaccgtgcccatcaagccaccctgcatccccaacgggaaggagaacttcagcggcggcaccagcctgtggcagaacatctag

SEQ ID NO: 145904 - DNA, 1575 bp, Artificial Sequence
  Description of Artificial Sequence: Synthetic coding sequence
atggccagcaccaccacctgcacccgcttcacagatgagtaccagctgtttgaggagctgggcaagggggccttctctgtggtgcggcgctgcatgaagatccccaccggccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggagagcgtgaaccactgccacctgaatggcatcgtgcaccgggacctgaagccagagaacctgctgctggccagcaagagcaaaggagctgctgtgaagctggccgactttggcctggccatcgaggtgcagggcgaccagcaggcctggtttggatttgctggcaccccaggctacctgagccctgaggtgctgaggaaggacccctacggcaagcctgtggacatgtgggcctgtggggtcatcctgtacatcctgctggtgggctacccacccttctgggatgaggaccagcaccggctgtaccagcagatcaaggccggggcctatgacttccccagccctgagtgggacacagtgaccccagaggccaaggacctgatcaacaagatgctgaccatcaacccagccaagaggatcacagccagcgaggccctgaagcacccctggatctgccagaggagcacagtggcctccatgatgcaccggcaggagaccgtggactgcctgaagaagttcaatgcccggaggaagctgaagggggccatcctgaccaccatgctggccaccaggaacttctctgctgccaagagcctgctgaagaagccagatggagtgaagaagaggaagagcagcagctctgtgcagatgatggagccccagaccaccgtcatccacaacccagatggcaacaaggagagcacagagagcagcaacaccaccattgaagatgaagatgtgaaggccaggaagcaggagatcatcaaggtgacagagcagctgattgaggccatcaacaacggggactttgaggcctacaccaagatctgtgaccccggcctgacagcctttgagcctgaggccctgggcaacctggtggagggcatggacttccaccgcttctactttgaaaatgccctgagcaagagcaacaagcccatccacaccatcatcctgaacccccacgtgcacctggtgggagatgatgctgcctgcatcgcctacatccggctgacccagtacatggatggcagcggcatgcccaagaccatgcagagcgaggagaccagggtgtggcacagaagagatggcaagtggcagaatgtgcacttccacaggagcggcagccccaccgtgcccatcaagccaccctgcatccccaacgggaaggagaacttcagcggcggcaccagcctgtggcagaacatctag

SEQ ID NO: 145905 - DNA, 1470 bp, Artificial Sequence
  Description of Artificial Sequence: Synthetic coding sequence
atggccagcaccaccacctgcacccgcttcacagatgagtaccagctgtttgaggagctgggcaagggggccttctctgtggtgcggcgctgcatgaagatccccaccggccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggagagcgtgaaccactgccacctgaatggcatcgtgcaccgggacctgaagccagagaacctgctgctggccagcaagagcaaaggagctgctgtgaagctggccgactttggcctggccatcgaggtgcagggcgaccagcaggcctggtttggatttgctggcaccccaggctacctgagccctgaggtgctgaggaaggacccctacggcaagcctgtggacatgtgggcctgtggggtcatcctgtacatcctgctggtgggctacccacccttctgggatgaggaccagcaccggctgtaccagcagatcaaggccggggcctatgacttccccagccctgagtgggacacagtgaccccagaggccaaggacctgatcaacaagatgctgaccatcaacccagccaagaggatcacagccagcgaggccctgaagcacccctggatctgccagaggagcacagtggcctccatgatgcaccggcaggagaccgtggactgcctgaagaagttcaatgcccggaggaagctgaagggggccatcctgaccaccatgctggccaccaggaacttctctgctgccaagagcctgctgaagaagccagatggagtgaagaagaggaagagcagcagctctgtgcagatgatggagagcacagagagcagcaacaccaccattgaagatgaagatgtgaaggccaggaagcaggagatcatcaaggtgacagagcagctgattgaggccatcaacaacggggactttgaggcctacaccaagatctgtgaccccggcctgacagcctttgagcctgaggccctgggcaacctggtggagggcatggacttccaccgcttctactttgaaaatgccctgagcaagagcaacaagcccatccacaccatcatcctgaacccccacgtgcacctggtgggagatgatgctgcctgcatcgcctacatccggctgacccagtacatggatggcagcggcatgcccaagaccatgcagagcgaggagaccagggtgtggcacagaagagatggcaagtggcagaatgtgcacttccacaggagcggcagccccaccgtgcccatcaagtag

SEQ ID NO: 145906 - DNA, 549 bp, Artificial Sequence
  Description of Artificial Sequence: Synthetic coding sequence
tgaagaaagctgaagggggccatcctgaccaccatgctggccaccaggaacttctctgctgccaagagcctgctgaagaagccagatggagtgaaggagagcacagagagcagcaacaccaccattgaagatgaagatgtgaaggccaggaagcaggagatcatcaaggtgacagagcagctgattgaggccatcaacaatggagactttgaggcctacaccaagatctgtgaccccggcctgacagcctttgagcctgaggccctgggcaacctggtggagggcatggacttccaccgcttctactttgaaaatgccctgagcaagagcaacaagcccatccacaccatcatcctgaacccccacgtgcacctggtgggagatgatgctgcctgcatcgcctacatccggctgacccagtacatggatggcagcggcatgcccaagaccatgcagagcgaggagaccagggtgtggcacagaagagatggcaagtggcagaatgtgcacttccacaggagcggcagccccaccgtgcccatcaagtag

SEQ ID NO: 145907 - DNA, 1437 bp, Artificial Sequence
  Description of Artificial Sequence: Synthetic coding sequence
atggccagcaccaccacctgcacccgcttcacagatgagtaccagctgtttgaggagctgggcaagggggccttctctgtggtgcggcgctgcatgaagatccccaccggccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccagcagatcctggagagcgtgaaccactgccacctgaatggcatcgtgcaccgggacctgaagccagagaacctgctgctggccagcaagagcaaaggagctgctgtgaagctggccgactttggcctggccatcgaggtgcagggcgaccagcaggcctggtttggatttgctggcaccccaggctacctgagccctgaggtgctgaggaaggacccctacggcaagcctgtggacatgtgggcctgtggggtcatcctgtacatcctgctggtgggctacccacccttctgggatgaggaccagcaccggctgtaccagcagatcaaggccggggcctatgacttccccagccctgagtgggacacagtgaccccagaggccaaggacctgatcaacaagatgctgaccatcaacccagccaagaggatcacagccagcgaggccctgaagcacccctggatctgccagaggagcacagtggcctccatgatgcaccggcaggagaccgtggactgcctgaagaagttcaatgcccggaggaagctgaagggggccatcctgaccaccatgctggccaccaggaacttctctgctgccaagagcctgctgaagaagccagatggagtgaaggagagcacagagagcagcaacaccaccattgaagatgaagatgtgaaggccaggaagcaggagatcatcaaggtgacagagcagctgattgaggccatcaacaatggagactttgaggcctacaccaagatctgtgaccccggcctgacagcctttgagcctgaggccctgggcaacctggtggagggcatggacttccaccgcttctactttgaaaatgccctgagcaagagcaacaagcccatccacaccatcatcctgaacccccacgtgcacctggtgggagatgatgctgcctgcatcgcctacatccggctgacccagtacatggatggcagcggcatgcccaagaccatgcagagcgaggagaccagggtgtggcacagaagagatggcaagtggcagaatgtgcacttccacaggagcggcagccccaccgtgcccatcaactag

SEQ ID NO: 145908 - DNA, 1590 bp, Artificial Sequence
  Description of Artificial Sequence: Synthetic coding sequence
atggccaccacagccacctgcacccgcttcacagatgactaccagctgtttgaggagctgggcaagggggccttctctgtggtgagaagatgtgtgaagaagaccagcacccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccaccagatcctggagagcgtgaaccacatccaccagcacgacatcgtgcaccgggacctgaagccagagaacctgctgctggccagcaaatgtaaaggagctgctgtgaagctggccgactttggcctggccatcgaggtgcagggcgagcagcaggcctggtttggatttgctggcaccccaggctacctgagccctgaggtgctgaggaaggacccctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagctgaccaggccctgaagcacccctgggtgtgccagaggagcacagtggcctccatgatgcaccggcaggagaccgtggagtgcctgaggaagttcaatgcccggaggaagctgaagggggccatcctgaccaccatgctggtgtccaggaacttctctgctgccaagagcctgctgaacaagaagagtgatggcggcgtgaagaagaggaagagcagcagctctgtgcacctgatgccccagagcaacaacaagaacagcctggtgtccccagcccaggagcccgcccccctgcagacagccatggagccccagaccaccgtggtgcacaatgccacagatggcatcaagggcagcacagagagctgcaacaccaccacagaagatgaggacctgaaggtgaggaagcaggagatcatcaagatcacagagcagctgattgaggccatcaacaacggggactttgaggcctacaccaagatctgtgaccccggcctgaccagctttgagcctgaggccctgggcaacctggtggagggcatggacttccacaagttctactttgagaacctgctgagcaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggctgaatgtgcactaccactgcagcggggccccagctgcccccctgcagtag

SEQ ID NO: 145909 - DNA, 1584 bp, Artificial Sequence
  Description of Artificial Sequence: Synthetic coding sequence
atggccaccacagccacctgcacccgcttcacagatgactaccagctgtttgaggagctgggcaagggggccttctctgtggtgagaagatgtgtgaagaagaccagcacccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccaccagatcctggagagcgtgaaccacatccaccagcacgacatcgtgcaccgggacctgaagccagagaacctgctgctggccagcaaatgtaaaggagctgctgtgaagctggccgactttggcctggccatcgaggtgcagggcgagcagcaggcctggtttggatttgctggcaccccaggctacctgagccctgaggtgctgaggaaggacccctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagctgaccaggccctgaagcacccctgggtgtgccagaggagcacagtggcctccatgatgcaccggcaggagaccgtggagtgcctgaggaagttcaatgcccggaggaagctgaagggggccatcctgaccaccatgctggtgtccaggaacttctctgtgggccggcagagcagcgccccagccagccctgctgccagcgctgctggcctggccggccaggccgccaagagcctgctgaacaagaagagtgatggaggagtgaagaagaggaagagcagcagctctgtgcacctgatggagccccagaccaccgtggtgcacaatgccacagatggcatcaagggcagcacagagagctgcaacaccaccacagaagatgaggacctgaaggtgaggaagcaggagatcatcaagatcacagagcagctgattgaggccatcaacaacggggactttgaggcctacaccaagatctgtgaccccggcctgaccagctttgagcctgaggccctgggcaacctggtggagggcatggacttccacaagttctactttgagaacctgctgagcaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggctgaatgtgcactaccactgcagcggggccccagctgcccccctgcagtag

SEQ ID NO: 145910 - DNA, 1671 bp, Artificial Sequence
  Description of Artificial Sequence: Synthetic coding sequence
atggccaccacagccacctgcacccgcttcacagatgactaccagctgtttgaggagctgggcaagggggccttctctgtggtgagaagatgtgtgaagaagaccagcacccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccaccagatcctggagagcgtgaaccacatccaccagcacgacatcgtgcaccgggacctgaagccagagaacctgctgctggccagcaaatgtaaaggagctgctgtgaagctggccgactttggcctggccatcgaggtgcagggcgagcagcaggcctggtttggatttgctggcaccccaggctacctgagccctgaggtgctgaggaaggacccctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagctgaccaggccctgaagcacccctgggtgtgccagaggagcacagtggcctccatgatgcaccggcaggagaccgtggagtgcctgaggaagttcaatgcccggaggaagctgaagggggccatcctgaccaccatgctggtgtccaggaacttctctgctgccaagagcctgctgaacaagaagagtgatggcggcgtgaagccccagagcaacaacaagaacagcctggtgtccccagcccaggagcccgcccccctgcagacagccatggagccccagaccaccgtggtgcacaatgccacagatggcatcaagggcagcacagagagctgcaacaccaccacagaagatgaggacctgaaggccgcccccctgaggactggaaatggcagctctgtgcctgagggccgcagcagccgggacagaacagcccccagcgctggcatgcagccccagcccagcctgtgcagcagcgccatgaggaagcaggagatcatcaagatcacagagcagctgattgaggccatcaacaatggagactttgaggcctacaccaagatctgtgaccccggcctgaccagctttgagcctgaggccctgggcaacctggtggagggcatggacttccacaagttctactttgagaacctgctgagcaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggctgaatgtgcactaccactgcagcggggccccagctgcccccctgcagtag

SEQ ID NO: 145911 - DNA, 1488 bp, Artificial Sequence
  Description of Artificial Sequence: Synthetic coding sequence
atggccaccacagccacctgcacccgcttcacagatgactaccagctgtttgaggagctgggcaagggggccttctctgtggtgagaagatgtgtgaagaagaccagcacccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccaccagatcctggagagcgtgaaccacatccaccagcacgacatcgtgcaccgggacctgaagccagagaacctgctgctggccagcaaatgtaaaggagctgctgtgaagctggccgactttggcctggccatcgaggtgcagggcgagcagcaggcctggtttggatttgctggcaccccaggctacctgagccctgaggtgctgaggaaggacccctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagctgaccaggccctgaagcacccctgggtgtgccagaggagcacagtggcctccatgatgcaccggcaggagaccgtggagtgcctgaggaagttcaatgcccggaggaagctgaagggggccatcctgaccaccatgctggtgtccaggaacttctctgctgccaagagcctgctgaacaagaagagtgatggcggcgtgaaggagccccagaccaccgtggtgcacaatgccacagatggcatcaagggcagcacagagagctgcaacaccaccacagaagatgaggacctgaaggtgaggaagcaggagatcatcaagatcacagagcagctgattgaggccatcaacaacggggactttgaggcctacaccaagatctgtgaccccggcctgaccagctttgagcctgaggccctgggcaacctggtggagggcatggacttccacaagttctactttgagaacctgctgagcaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggctgaatgtgcactaccactgcagcggggccccagctgcccccctgcagtag

SEQ ID NO: 145912 - DNA, 1551 bp, Artificial Sequence
  Description of Artificial Sequence: Synthetic coding sequence
atggccaccacagccacctgcacccgcttcacagatgactaccagctgtttgaggagctgggcaagggggccttctctgtggtgagaagatgtgtgaagaagaccagcacccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccaccagatcctggagagcgtgaaccacatccaccagcacgacatcgtgcaccgggacctgaagccagagaacctgctgctggccagcaaatgtaaaggagctgctgtgaagctggccgactttggcctggccatcgaggtgcagggcgagcagcaggcctggtttggatttgctggcaccccaggctacctgagccctgaggtgctgaggaaggacccctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagctgaccaggccctgaagcacccctgggtgtgccagaggagcacagtggcctccatgatgcaccggcaggagaccgtggagtgcctgaggaagttcaatgcccggaggaagctgaagggggccatcctgaccaccatgctggtgtccaggaacttctctgtgggccggcagagcagcgccccagccagccctgctgccagcgctgctggcctggccggccaggccgccaagagcctgctgaacaagaagagtgatggaggagtgaaggagccccagaccaccgtggtgcacaatgccacagatggcatcaagggcagcacagagagctgcaacaccaccacagaagatgaggacctgaaggtgaggaagcaggagatcatcaagatcacagagcagctgattgaggccatcaacaatggagactttgaggcctacaccaagatctgtgaccccggcctgaccagctttgagcctgaggccctgggcaacctggtggagggcatggacttccacaagttctactttgagaacctgctgagcaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggctgaatgtgcactaccactgcagcggggccccagctgcccccctgcagtag

SEQ ID NO: 145913 - DNA, 1602 bp, Artificial Sequence
  Description of Artificial Sequence: Synthetic coding sequence
atggccaccacagccacctgcacccgcttcacagatgactaccagctgtttgaggagctgggcaagggggccttctctgtggtgagaagatgtgtgaagaagaccagcacccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccaccagatcctggagagcgtgaaccacatccaccagcacgacatcgtgcaccgggacctgaagccagagaacctgctgctggccagcaaatgtaaaggagctgctgtgaagctggccgactttggcctggccatcgaggtgcagggcgagcagcaggcctggtttggatttgctggcaccccaggctacctgagccctgaggtgctgaggaaggacccctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagctgaccaggccctgaagcacccctgggtgtgccagaggagcacagtggcctccatgatgcaccggcaggagaccgtggagtgcctgaggaagttcaatgcccggaggaagctgaagggggccatcctgaccaccatgctggtgtccaggaacttctctgctgccaagagcctgctgaacaagaagagtgatggcggcgtgaaggagccccagaccaccgtggtgcacaatgccacagatggcatcaagggcagcacagagagctgcaacaccaccacagaagatgaggacctgaaggccgcccccctgaggactggaaatggcagctctgtgcctgagggccgcagcagccgggacagaacagcccccagcgctggcatgcagccccagcccagcctgtgcagcagcgccatgaggaagcaggagatcatcaagatcacagagcagctgattgaggccatcaacaacggggactttgaggcctacaccaagatctgtgaccccggcctgaccagctttgagcctgaggccctgggcaacctggtggagggcatggacttccacaagttctactttgagaacctgctgagcaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggctgaatgtgcactaccactgcagcggggccccagctgcccccctgcagtag

SEQ ID NO: 145914 - DNA, 1677 bp, Artificial Sequence
  Description of Artificial Sequence: Synthetic coding sequence
atggccaccacagccacctgcacccgcttcacagatgactaccagctgtttgaggagctgggcaagggggccttctctgtggtgagaagatgtgtgaagaagaccagcacccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccaccagatcctggagagcgtgaaccacatccaccagcacgacatcgtgcaccgggacctgaagccagagaacctgctgctggccagcaaatgtaaaggagctgctgtgaagctggccgactttggcctggccatcgaggtgcagggcgagcagcaggcctggtttggatttgctggcaccccaggctacctgagccctgaggtgctgaggaaggacccctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagctgaccaggccctgaagcacccctgggtgtgccagaggagcacagtggcctccatgatgcaccggcaggagaccgtggagtgcctgaggaagttcaatgcccggaggaagctgaagggggccatcctgaccaccatgctggtgtccaggaacttctctgctgccaagagcctgctgaacaagaagagtgatggcggcgtgaagaagaggaagagcagcagctctgtgcacctgatgccccagagcaacaacaagaacagcctggtgtccccagcccaggagcccgcccccctgcagacagccatggagccccagaccaccgtggtgcacaatgccacagatggcatcaagggcagcacagagagctgcaacaccaccacagaagatgaggacctgaagggctctgtgcctgagggccgcagcagccgggacagaacagcccccagcgctggcatgcagccccagcccagcctgtgcagcagcgccatgaggaagcaggagatcatcaagatcacagagcagctgattgaggccatcaacaatggagactttgaggcctacaccaagatctgtgaccccggcctgaccagctttgagcctgaggccctgggcaacctggtggagggcatggacttccacaagttctactttgagaacctgctgagcaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggctgaatgtgcactaccactgcagcggggccccagctgcccccctgcagtag

SEQ ID NO: 145915 - DNA, 1767 bp, Artificial Sequence
  Description of Artificial Sequence: Synthetic coding sequence
atggccaccacagccacctgcacccgcttcacagatgactaccagctgtttgaggagctgggcaagggggccttctctgtggtgagaagatgtgtgaagaagaccagcacccaggagtatgctgccaagatcatcaacaccaagaagctgagcgcccgggaccaccagaagctggagcgggaggcccgcatctgccgcctgctgaagcaccccaacatcgtgcggctgcatgacagcatcagcgaggagggcttccactacctggtgtttgacctggtgactggaggagagctgtttgaggacatcgtggcccgggagtactacagcgaggctgatgccagccactgcatccaccagatcctggagagcgtgaaccacatccaccagcacgacatcgtgcaccgggacctgaagccagagaacctgctgctggccagcaaatgtaaaggagctgctgtgaagctggccgactttggcctggccatcgaggtgcagggcgagcagcaggcctggtttggatttgctggcaccccaggctacctgagccctgaggtgctgaggaaggacccctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagctgaccaggccctgaagcacccctgggtgtgccagaggagcacagtggcctccatgatgcaccggcaggagaccgtggagtgcctgaggaagttcaatgcccggaggaagctgaagggggccatcctgaccaccatgctggtgtccaggaacttctctgtgggccggcagagcagcgccccagccagccctgctgccagcgctgctggcctggccggccaggccgccaagagcctgctgaacaagaagagtgatggaggagtgaagaagaggaagagcagcagctctgtgcacctgatgccccagagcaacaacaagaacagcctggtgtccccagcccaggagcccgcccccctgcagacagccatggagccccagaccaccgtggtgcacaatgccacagatggcatcaagggcagcacagagagctgcaacaccaccacagaagatgaggacctgaaggccgcccccctgaggactggaaatggcagctctgtgcctgagggccgcagcagccgggacagaacagcccccagcgctggcatgcagccccagcccagcctgtgcagcagcgccatgaggaagcaggagatcatcaagatcacagagcagctgattgaggccatcaacaatggagactttgaggcctacaccaagatctgtgaccccggcctgaccagctttgagcctgaggccctgggcaacctggtggagggcatggacttccacaagttctactttgagaacctgctgagcaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggctgaatgtgcactaccactgcagcggggccccagctgcccccctgcagtag

SEQ ID NO: 145916 - DNA, 1362 bp, Artificial Sequence
  Description of Artificial Sequence: Synthetic coding sequence
cggctgctgaagcaccccaacatcgtgcggctgcatgacagcatcagcgaggagggcttccactacctggtgtttgacctggtgactggaggagagctgtttgaagatattgtggcccgggagtactacagcgaggctgatgccagccactgcatccaccagatcctggagagcgtgaaccacatccaccagcacgacatcgtgcaccgggacctgaagccagagaacctgctgctggccagcaagtgcaagggagctgctgtgaagctggccgactttggcctggccatcgaggtgcagggcgagcagcaggcctggtttggatttgctggcaccccaggctacctgagccctgaggtgctgaggaaggacccctacggcaagcctgtggacatctgggcctgtggggtcatcctgtacatcctgctggtgggctacccacccttctgggatgaggaccagcacaagctgtaccagcagatcaaggccggggcctatgacttccccagccctgagtgggacacagtgaccccagaggccaagaacctgatcaaccagatgctgaccatcaacccagccaagaggatcacagctgaccaggccctgaagcacccctgggtgtgccagaggagcacagtggcctccatgatgcaccggcaggagaccgtggagtgcctgaggaagttcaatgcccggaggaagctgaagggggccatcctgaccaccatgctggtgtccaggaacttctctgctgccaagagcctgctgaacaagaagagtgatggaggagtgaagccccagagcaacaacaagaacagcctggtgtccccagcccaggagcccgcccccctgcagacagccatggagccccagaccaccgtggtgcacaatgccacagatggcatcaagggcagcacagagagctgcaacaccaccacagaagatgaggacctgaaggtgaggaagcaggagatcatcaagatcacagagcagctgattgaggccatcaacaacggggactttgaggcctacaccaagatctgtgaccccggcctgaccagctttgagcctgaggccctgggcaacctggtggagggcatggacttccacaagttctactttgagaacctgctgagcaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggctgaatgtgcactaccactgcagcggggccccagctgcccccctgcagtag

SEQ ID NO: 145917 - DNA, 1008 bp, Artificial Sequence
  Description of Artificial Sequence: Synthetic coding sequence
tgataccagcagatcaaggccggggcctatgacttccccagccctgagtgggacacagtgaccccagaggccaagaacctgatcaaccagatgctgaccatcaacccagccaagaggatcacagctgaccaggccctgaagcacccctgggtgtgccagaggagcacagtggcctccatgatgcaccggcaggagaccgtggagtgcctgaggaagttcaatgcccggaggaagctgaagggggccatcctgaccaccatgctggtgtccaggaacttctctgctgccaagagcctgctgaacaagaagagtgatggaggagtgaagccccagagcaacaacaagaacagcctggtgtccccagcccaggagcccgcccccctgcagacagccatggagccccagaccaccgtggtgcacaatgccacagatggcatcaagggcagcacagagagctgcaacaccaccacagaagatgaggacctgaaggccgcccccctgaggactggaaatggcagctctgtgcctgagggccgcagcagccgggacagaacagcccccagcgctggcatgcagccccagcccagcctgtgcagcagcgccatgaggaagcaggagatcatcaagatcacagagcagctgattgaggccatcaacaacggggactttgaggcctacaccaagatctgtgaccccggcctgaccagctttgagcctgaggccctgggcaacctggtggagggcatggacttccacaagttctactttgagaacctgctgagcaagaacagcaagcccatccacaccaccatcctgaacccccacgtgcacgtgattggagaagatgctgcctgcatcgcctacatccggctgacccagtacattgatggccagggccggcccaggaccagccagagcgaggagaccagggtgtggcacagaagagatggcaagtggctgaatgtgcactaccactgcagcggggccccagctgcccccctgcagtag

SEQ ID NO: 145918 - DNA, 543 bp, Artificial Sequence
  Description of Artificial Sequence: Synthetic coding sequence
atggccaccacagccacctgcacccgcttcacagatgactaccagctgtttgaggagctgggcaagggggccttctctgtggtgagaagatgtgtgaagaagaccagcacccaggagtatgctgccaagatcatcaacaccaagaagctgagcgcccgggaccaccagaagctggagcgggaggcccgcatctgccgcctgctgaagcaccccaacatcgccaccatccatggaggcatccatgatgccagcagcggggactgtggggtgtttgcccaggtgcagtgcccagagaagacagagggctgccacccccatgaccacgcctgcctgcaggagctgctgagctgccagaagcccatcgagcaggaggtgggctggcgctgccaggccacagagcagcagcagaagcagagcaggaagcccagcccccgggcccgggccctggctgatggccatggagccaccaaccactgcggcacccagcgctaccgctgggaccagggcctgcaccgggagctgcagcaccaccacagaagatag

SEQ ID NO: 145919 - DNA, 240 bp, Artificial Sequence
  Description of Artificial Sequence: Synthetic coding sequence
atgtctgagatcctgccctacagcgaggacaagatgggccgctttggagctgaccctgagggcagtgacctgtccttcagctgccgcctgcaggacaccaacagcttctttgctggcaaccaggccaagaggcctcccaagctgggccagatcggccgggccaagagggtggtgattgaagatgacagaattgatgatgtgctgaagggcatgggagagaagcccccatctggagtgtag

SEQ ID NO: 145920 - DNA, 1422 bp, Artificial Sequence
  Description of Artificial Sequence: Synthetic coding sequence
atgctgaaggtgacagtgcccagctgcagcgccagcagctgcagctctgtgacagccagcgctgcccctggaacagccagcctggtgcctgactactggattgatggcagcaacagagatgccctgagtgacttctttgaggtggagagcgagctgggccgcggggccaccagcatcgtgtaccgctgcaagcagaagggcacccagaagccctatgccctgaaggtgctgaagaagacagtggacaagaagatcgtgaggacagaaattggagtgctgctgcggctgagccaccccaacatcatcaagctgaaggagatctttgagacccccacagagatcagcctggtgctggagctggtgactggaggagagctgtttgaccgcatcgtggagaagggctactacagcgagagagatgctgctgatgctgtgaagcagatcctggaggccgtggcctacctgcatgaaaatggcatcgtgcaccgggacctgaagccagagaacctgctgtatgccaccccagccccagatgcccccctgaagattgctgactttggcctgagcaagatcgtggagcaccaggtgctgatgaagacagtgtgtggcaccccaggctactgtgcccctgagatcctgcggggctgtgcctacggccctgaggtggacatgtggagcgtgggcatcatcacctacatcctgctgtgtggctttgagcccttctatgatgagcggggggaccagttcatgttccgccgcatcctgaactgtgagtactacttcatcagcccctggtgggatgaggtgtccctgaatgccaaggacctggtgaggaagctgattgtgctggaccccaagaagaggctgaccaccttccaggccctgcagcacccctgggtgacaggcaaggccgccaactttgtgcacatggacacagcccagaagaagctgcaggagttcaatgcccggaggaagctgaaggctgctgtgaaggctgtggtggccagcagccggctgggcagcgccagcagcagccacggcagcatccaggagagccacaaggccagccgggaccccagccccatccaggatggaaatgaagacatgaaggccatccctgagggggagaagatccagggagatggagcccaggccgctgtgaagggggcccaggccgagctgatgaaggtgcaggccctggagaaggtgaagggagctgacatcaatgctgaggaggcccccaagatggtgcccaaggctgtggaggatggcatcaaggtggccgacctggagctggaggagggcctggccgaggagaagctgaagacagtggaggaggccgccgccccccgggagggccagggcagcagcgctgtgggctttgaggtgccccagcaggatgtgatcctgcctgagtactag

SEQ ID NO: 145921 - DNA, 429 bp, Artificial Sequence
  Description of Artificial Sequence: Synthetic coding sequence
atgctgaaggtgacagtgcccagctgcagcgccagcagctgcagctctgtgacagccagcgctgcccctggaacagccagcctggtgcctgactactggattgatggcagcaacagagatgccctgagtgacttctttgaggtggagagcgagctgggccgcggggccaccagcatcgtgtaccgctgcaagcagaagggcacccagaagccctatgccctgaaggtgctgaagaagacagtggacaagaagatcgtgaggacagaaattggagtgctgctgcggctgagccaccccaacatcatcaagctgaaggagatctttgagacccccacagagatcagcctggtgctggagctggtgactggaggagagctgtttgaccgcatcgtggagaagggctactacagcgagagagatgctgcctag

SEQ ID NO: 145922 - DNA, 1422 bp, Artificial Sequence; identical to SEQ ID NO: 145920
  Description of Artificial Sequence: Synthetic coding sequence

SEQ ID NO: 145923 - DNA, 2766 bp, Artificial Sequence
  Description of Artificial Sequence: Synthetic coding sequence
atggctgatgatgatgtgctgtttgaagatgtgtatgagctgtgtgaggtgattggcaagggccccttctctgtggtgcggcgctgcatcaaccgggagaccggccagcagtttgctgtgaagatcgtggatgtggccaagttcaccagcagccctggcctgagcacagaggacctgaagcgggaggccagcatctgccacatgctgaagcacccccacatcgtggagctgctggagacctacagcagtgatggcatgctgtacatggtgtttgagttcatggatggagctgacctgtgctttgaaattgtgaagagagcagatgctggctttgtgtacagcgaggccgtggccagccactacatgaggcagatcctggaggccctgcgctactgccacgacaacaacatcatccacagagatgtgaagccccactgtgtgctgctggccagcaaagaaaattctgcccctgtgaagctgggcggctttggagtggccatccagctgggggagagcggcctggtggccggcggccgggtgggcaccccccacttcatggcccctgaggtggtgaagcgggagccctacggcaagcctgtggatgtgtggggctgtggggtcatcctcttcatcctgctgagcggctgcctgcccttctacggcaccaaggagcggctgtttgagggcatcatcaagggcaagtacaagatgaacccccggcagtggagccacatcagcgagagcgccaaggacctggtgcggaggatgctgatgctggaccctgctgagcgcatcaccgtgtatgaggccctgaaccacccctggctgaaggagcgggacagatatgcctacaagatccacctgcctgagaccgtggagcagctgaggaagttcaatgcccggaggaagctgaagggagctgtgctggccgctgtgagcagccacaagttcaacagcttctatggagaccccccagaggagctgcctgacttcagcgaggaccccaccagctctgtgctgctgattgtgtccagagctgtgtcccaggtgctggacagcctggaggagatccacgccctgacagactgcagcgagaaggacctggacttcctgcacagcgtcttccaggaccagcacctgcacaccctgctggacctgtatgacaagatcaacaccaagagcagcccccagatcagaaatcctccttctgatgctgtgcagagggccaaggaggtgctggaggagatcagctgctacccagaaaataatgatgccaaggagctgaagaggatcctgacccagccccacttcatggccctgctgcagacccatgatgtggtggcccacgaggtgtacagtgatgaggccctgcgggtgaccccaccacccaccagcccctacctgaatggagacagccctgagagcgccaatggagacatggacatggagaatgtgaccagggtgcggctggtgcagttccagaagaacacagatgagcccatgggcatcaccctgaagatgaatgagctgaaccactgcatcgtggcccgcatcatgcacggcggcatgatccaccggcagggcaccctgcacgtgggagatgagatccgggagatcaatggcatctctgtggccaaccagacagtggagcagctgcagaagatgctgcgggagatgaggggcagcatcaccttcaagatcgtgcccagctaccgcacccagagcagcagctgtgagcgggacagccccagcaccagccggcagagccctgccaacggccacagcagcaccaacaacagcgtgtctgacctgcccagcaccacccagcccaagggccggcagatctacgtgcgggcccagtttgaatatgaccctgccaaggatgacctgatcccctgcaaggaggccggcatccgcttccgggtgggggacatcatccagatcatcagcaaggatgaccacaactggtggcagggcaagctggagaacagcaagaatggaacagctggcctcatccccagccctgagctgcaggagtggagggtggcctgcatcgccatggagaagaccaagcaggagcagcaggccagctgcacctggtttgggaagaagaagaagcagtacaaggacaagtacctggccaagcacaatgctgacctggtgacctatgaggaggtggtgaagctgcctgccttcaagaggaagaccctggtgctgctgggcgcccatggagtgggcagaagacacatcaagaacaccctcatcaccaagcacccagacagatttgcctaccccatcccccacaccacccggccccccaagaaggatgaggagaatggcaagaactactactttgtgtcccatgaccagatgatgcaggacatcagcaacaatgagtacctggagtatggcagccatgaagatgccatgtatggcaccaagctggagaccatcaggaagatccacgagcagggcctgattgccatcctggatgtggagccccaggccctgaaggtgctgaggacagctgagtttgccccctttgtggtgttcatcgccgcccccaccatcaccccaggcctgaatgaagatgagagcctgcagaggctgcagaaggagagtgacatcctgcagaggacctacgcccactactttgacctgaccatcatcaacaatgaaattgatgagaccatccgccacctggaggaggccgtggagctggtgtgcacagccccccagtgggtgcctgtgtcctgggtgtactag

SEQ ID NO: 145924 - DNA, 2730 bp, Artificial Sequence
  Description of Artificial Sequence: Synthetic coding sequence
atggctgatgatgatgtgctgtttgaagatgtgtatgagctgtgtgaggtgattggcaagggccccttctctgtggtgcggcgctgcatcaaccgggagaccggccagcagtttgctgtgaagatcgtggatgtggccaagttcaccagcagccctggcctgagcacagaggacctgaagcgggaggccagcatctgccacatgctgaagcacccccacatcgtggagctgctggagacctacagcagtgatggcatgctgtacatggtgtttgagttcatggatggagctgacctgtgctttgaaattgtgaagagagcagatgctggctttgtgtacagcgaggccgtggccagccactacatgaggcagatcctggaggccctgcgctactgccacgacaacaacatcatccacagagatgtgaagccccactgtgtgctgctggccagcaaagaaaattctgcccctgtgaagctgggcggctttggagtggccatccagctgggggagagcggcctggtggccggcggccgggtgggcaccccccacttcatggcccctgaggtggtgaagcgggagccctacggcaagcctgtggatgtgtggggctgtggggtcatcctcttcatcctgctgagcggctgcctgcccttctacggcaccaaggagcggctgtttgagggcatcatcaagggcaagtacaagatgaacccccggcagtggagccacatcagcgagagcgccaaggacctggtgcggaggatgctgatgctggaccctgctgagcgcatcaccgtgtatgaggccctgaaccacccctggctgaaggagcgggacagatatgcctacaagatccacctgcctgagaccgtggagcagctgaggaagttcaatgcccggaggaagctgaagggagctgtgctggccgctgtgagcagccacaagttcaacagcttctatggagaccccccagaggagctgcctgacttcagcgaggaccccaccagctctgtgctgctgattgtgtccagagctgtgtcccaggtgctggacagcctggaggagatccacgccctgacagactgcagcgagaaggacctggacttcctgcacagcgtcttccaggaccagcacctgcacaccctgctggacctgtatgacaagatcaacaccaagagcagcccccagatcagaaatcctccttctgatgctgtgcagagggccaaggaggtgctggaggagatcagctgctacccagaaaataatgatgccaaggagctgaagaggatcctgacccagccccacttcatggccctgctgcagacccatgatgtggtggcccacgaggtgtacagtgatgaggccctgcgggtgaccccaccacccaccagcccctacctgaatggagacagccctgagagcgccaatggagacatggacatggagaatgtgaccagggtgcggctggtgcagttccagaagaacacagatgagcccatgggcatcaccctgaagatgaatgagctgaaccactgcatcgtggcccgcatcatgcacggcggcatgatccaccggcagggcaccctgcacgtgggagatgagatccgggagatcaatggcatctctgtggccaaccagacagtggagcagctgcagaagatgctgcgggagatgaggggcagcatcaccttcaagatcgtgcccagctaccgcacccagagcagcagctgtgagcgggacagccccagcaccagccggcagagccctgccaacggccacagcagcaccaacaacagcgtgtccatctacgtgcgggcccagtttgaatatgaccctgccaaggatgacctgatcccctgcaaggaggccggcatccgcttccgggtgggggacatcatccagatcatcagcaaggatgaccacaactggtggcagggcaagctggagaacagcaagaatggaacagctggcctcatccccagccctgagctgcaggagtggagggtggcctgcatcgccatggagaagaccaagcaggagcagcaggccagctgcacctggtttgggaagaagaagaagcagtacaaggacaagtacctggccaagcacaatgctgacctggtgacctatgaggaggtggtgaagctgcctgccttcaagaggaagaccctggtgctgctgggcgcccatggagtgggcagaagacacatcaagaacaccctcatcaccaagcacccagacagatttgcctaccccatcccccacaccacccggccccccaagaaggatgaggagaatggcaagaactactactttgtgtcccatgaccagatgatgcaggacatcagcaacaatgagtacctggagtatggcagccatgaagatgccatgtatggcaccaagctggagaccatcaggaagatccacgagcagggcctgattgccatcctggatgtggagccccaggccctgaaggtgctgaggacagctgagtttgccccctttgtggtgttcatcgccgcccccaccatcaccccaggcctgaatgaagatgagagcctgcagaggctgcagaaggagagtgacatcctgcagaggacctacgcccactactttgacctgaccatcatcaacaatgaaattgatgagaccatccgccacctggaggaggccgtggagctggtgtgcacagccccccagtgggtgcctgtgtcctgggtgtactag

SEQ ID NO: 145925 - DNA, 1773 bp, Artificial Sequence
  Description of Artificial Sequence: Synthetic coding sequence
atggctgatgatgatgtgctgtttgaagatgtgtatgagctgtgtgaggtgattggcaagggccccttctctgtggtgcggcgctgcatcaaccgggagaccggccagcagtttgctgtgaagatcgtggatgtggccaagttcaccagcagccctggcctgagcacagaggacctgaagcgggaggccagcatctgccacatgctgaagcacccccacatcgtggagctgctggagacctacagcagtgatggcatgctgtacatggtgtttgagttcatggatggagctgacctgtgctttgaaattgtgaagagagcagatgctggctttgtgtacagcgaggccgtggccagccactacatgaggcagatcctggaggccctgcgctactgccacgacaacaacatcatccacagagatgtgaagccccactgtgtgctgctggccagcaaagaaaattctgcccctgtgaagctgggcggctttggagtggccatccagctgggggagagcggcctggtggccggcggccgggtgggcaccccccacttcatggcccctgaggtggtgaagcgggagccctacggcaagcctgtggatgtgtggggctgtggggtcatcctcttcatcctgctgagcggctgcctgcccttctacggcaccaaggagcggctgtttgagggcatcatcaagggcaagtacaagatgaacccccggcagtggagccacatcagcgagagcgccaaggacctggtgcggaggatgctgatgctggaccctgctgagcgcatcaccgtgtatgaggccctgaaccacccctggctgaaggagcgggacagatatgcctacaagatccacctgcctgagaccgtggagcagctgaggaagttcaatgcccggaggaagctgaagggagctgtgctggccgctgtgagcagccacaagttcaacagcttctatggagaccccccagaggagctgcctgacttcagcgaggaccccaccagcagcggcctgctggccgctgagagagctgtgtcccaggtgctggacagcctggaggagatccacgccctgacagactgcagcgagaaggacctggacttcctgcacagcgtcttccaggaccagcacctgcacaccctgctggacctgtatgacaagatcaacaccaagagcagcccccagatcagaaatcctccttctgatgctgtgcagagggccaaggaggtgctggaggagatcagctgctacccagaaaataatgatgccaaggagctgaagaggatcctgacccagccccacttcatggccctgctgcagacccatgatgtggtggcccacgaggtgtacagtgatgaggccctgcgggtgaccccaccacccaccagcccctacctgaatggagacagccctgagagcgccaatggagacatggacatggagaatgtgaccagggtgcggctggtgcagttccagaagaacacagatgagcccatgggcatcaccctgaagatgaatgagctgaaccactgcatcgtggcccgcatcatgcacggcggcatgatccaccggcagggcaccctgcacgtgggagatgagatccgggagatcaatggcatctctgtggccaaccagacagtggagcagctgcagaagatgctgcgggagatgaggggcagcatcaccttcaagatcgtgcccagctaccgcacccagagcagcagctgtgaggtgatgaccctgaccaaccacccccacctgctgtag

SEQ ID NO: 145926 - DNA, 2730 bp, Artificial Sequence
  Description of Artificial Sequence: Synthetic coding sequence
atggctgatgatgatgtgctgtttgaagatgtgtatgagctgtgtgaggtgattggcaagggccccttctctgtggtgcggcgctgcatcaaccgggagaccggccagcagtttgctgtgaagatcgtggatgtggccaagttcaccagcagccctggcctgagcacagaggacctgaagcgggaggccagcatctgccacatgctgaagcacccccacatcgtggagctgctggagacctacagcagtgatggcatgctgtacatggtgtttgagttcatggatggagctgacctgtgctttgaaattgtgaagagagcagatgctggctttgtgtacagcgaggccgtggccagccactacatgaggcagatcctggaggccctgcgctactgccacgacaacaacatcatccacagagatgtgaagccccactgtgtgctgctggccagcaaagaaaattctgcccctgtgaagctgggcggctttggagtggccatccagctgggggagagcggcctggtggccggcggccgggtgggcaccccccacttcatggcccctgaggtggtgaagcgggagccctacggcaagcctgtggatgtgtggggctgtggggtcatcctcttcatcctgctgagcggctgcctgcccttctacggcaccaaggagcggctgtttgagggcatcatcaagggcaagtacaagatgaacccccggcagtggagccacatcagcgagagcgccaaggacctggtgcggaggatgctgatgctggaccctgctgagcgcatcaccgtgtatgaggccctgaaccacccctggctgaaggagcgggacagatatgcctacaagatccacctgcctgagaccgtggagcagctgaggaagttcaatgcccggaggaagctgaagggagctgtgctggccgctgtgagcagccacaagttcaacagcttctatggagaccccccagaggagctgcctgacttcagcgaggaccccaccagcagcggcctgctggccgctgagagagctgtgtcccaggtgctggacagcctggaggagatccacgccctgacagactgcagcgagaaggacctggacttcctgcacagcgtcttccaggaccagcacctgcacaccctgctggacctgtatgacaagatcaacaccaagagcagcccccagatcagaaatcctccttctgatgctgtgcagagggccaaggaggtgctggaggagatcagctgctacccagaaaataatgatgccaaggagctgaagaggatcctgacccagccccacttcatggccctgctgcagacccatgatgtggtggcccacgaggtgtacagtgatgaggccctgcgggtgaccccaccacccaccagcccctacctgaatggagacagccctgagagcgccaatggagacatggacatggagaatgtgaccagggtgcggctggtgcagttccagaagaacacagatgagcccatgggcatcaccctgaagatgaatgagctgaaccactgcatcgtggcccgcatcatgcacggcggcatgatccaccggcagggcaccctgcacgtgggagatgagatccgggagatcaatggcatctctgtggccaaccagacagtggagcagctgcagaagatgctgcgggagatgaggggcagcatcaccttcaagatcgtgcccagctaccgcacccagagcagcagctgtgagcgggacagccccagcaccagccggcagagccctgccaacggccacagcagcaccaacaacagcgtgtccatctacgtgcgggcccagtttgaatatgaccctgccaaggatgacctgatcccctgcaaggaggccggcatccgcttccgggtgggggacatcatccagatcatcagcaaggatgaccacaactggtggcagggcaagctggagaacagcaagaatggaacagctggcctcatccccagccctgagctgcaggagtggagggtggcctgcatcgccatggagaagaccaagcaggagcagcaggccagctgcacctggtttgggaagaagaagaagcagtacaaggacaagtacctggccaagcacaatgctgacctggtgacctatgaggaggtggtgaagctgcctgccttcaagaggaagaccctggtgctgctgggcgcccatggagtgggcagaagacacatcaagaacaccctcatcaccaagcacccagacagatttgcctaccccatcccccacaccacccggccccccaagaaggatgaggagaatggcaagaactactactttgtgtcccatgaccagatgatgcaggacatcagcaacaatgagtacctggagtatggcagccatgaagatgccatgtatggcaccaagctggagaccatcaggaagatccacgagcagggcctgattgccatcctggatgtggagccccaggccctgaaggtgctgaggacagctgagtttgccccctttgtggtgttcatcgccgcccccaccatcaccccaggcctgaatgaagatgagagcctgcagaggctgcagaaggagagtgacatcctgcagaggacctacgcccactactttgacctgaccatcatcaacaatgaaattgatgagaccatccgccacctggaggaggccgtggagctggtgtgcacagccccccagtgggtgcctgtgtcctgggtgtactag

SEQ ID NO: 145927 - DNA, 2781 bp, Artificial Sequence
  Description of Artificial Sequence: Synthetic coding sequence
atggctgatgatgatgtgctgtttgaagatgtgtatgagctgtgtgaggtgattggcaagggccccttctctgtggtgcggcgctgcatcaaccgggagaccggccagcagtttgctgtgaagatcgtggatgtggccaagttcaccagcagccctggcctgagcacagaggacctgaagcgggaggccagcatctgccacatgctgaagcacccccacatcgtggagctgctggagacctacagcagtgatggcatgctgtacatggtgtttgagttcatggatggagctgacctgtgctttgaaattgtgaagagagcagatgctggctttgtgtacagcgaggccgtggccagccactacatgaggcagatcctggaggccctgcgctactgccacgacaacaacatcatccacagagatgtgaagccccactgtgtgctgctggccagcaaagaaaattctgcccctgtgaagctgggcggctttggagtggccatccagctgggggagagcggcctggtggccggcggccgggtgggcaccccccacttcatggcccctgaggtggtgaagcgggagccctacggcaagcctgtggatgtgtggggctgtggggtcatcctcttcatcctgctgagcggctgcctgcccttctacggcaccaaggagcggctgtttgagggcatcatcaagggcaagtacaagatgaacccccggcagtggagccacatcagcgagagcgccaaggacctggtgcggaggatgctgatgctggaccctgctgagcgcatcaccgtgtatgaggccctgaaccacccctggctgaaggagcgggacagatatgcctacaagatccacctgcctgagaccgtggagcagctgaggaagttcaatgcccggaggaagctgaagggagctgtgctggccgctgtgagcagccacaagttcaacagcttctatggagaccccccagaggagctgcctgacttcagcgaggaccccaccagcagcggcctgctggccgctgagagagctgtgtcccaggtgctggacagcctggaggagatccacgccctgacagactgcagcgagaaggacctggacttcctgcacagcgtcttccaggaccagcacctgcacaccctgctggacctgtatgacaagatcaacaccaagagcagcccccagatcagaaatcctccttctgatgctgtgcagagggccaaggaggtgctggaggagatcagctgctacccagaaaataatgatgccaaggagctgaagaggatcctgacccagccccacttcatggccctgctgcagacccatgatgtggtggcccacgaggtgtacagtgatgaggccctgcgggtgaccccaccacccaccagcccctacctgaatggagacagccctgagagcgccaatggagacatggacatggagaatgtgaccagggtgcggctggtgcagttccagaagaacacagatgagcccatgggcatcaccctgaagatgaatgagctgaaccactgcatcgtggcccgcatcatgcacggcggcatgatccaccggcagggcaccctgcacgtgggagatgagatccgggagatcaatggcatctctgtggccaaccagacagtggagcagctgcagaagatgctgcgggagatgaggggcagcatcaccttcaagatcgtgcccagctaccgcacccagagcagcagctgtgagcgggacagccccagcaccagccggcagagccctgccaacggccacagcagcaccaacaacagcgtgtctgacctgcccagcaccacccagcccaagggccggcagatctacgtgcgggcccagtttgaatatgaccctgccaaggatgacctgatcccctgcaaggaggccggcatccgcttccgggtgggggacatcatccagatcatcagcaaggatgaccacaactggtggcagggcaagctggagaacagcaagaatggaacagctggcctcatccccagccctgagctgcaggagtggagggtggcctgcatcgccatggagaagaccaagcaggagcagcaggccagctgcacctggtttgggaagaagaagaagcagtacaaggacaagtacctggccaagcacaatgctgtgtttgaccagctggacctggtgacctatgaggaggtggtgaagctgcctgccttcaagaggaagaccctggtgctgctgggcgcccacggcgtgggccgccgccacatcaagaacaccctcatcaccaagcacccagacagatttgcctaccccatcccccacaccaccaggcctcccaagaaggatgaagaaaatggcaagaactactactttgtgtcccatgaccagatgatgcaggacatcagcaacaatgagtacctggagtatggcagccatgaagatgccatgtatggcaccaagctggagaccatcaggaagatccacgagcagggcctcatcgccatcctggatgtggagccccaggccctgaaggtgctgaggacagctgagtttgccccctttgtggtgttcatcgccgcccccaccatcaccccaggcctgaatgaagatgagagcctgcagaggctgcagaaggagagtgacatcctgcagaggacctacgcccactactttgacctgaccatcatcaacaatgaaattgatgagaccatccgccacctggaggaggccgtggagctggtgtgcacagccccccagtgggtgcctgtgtcctgggtgtactag

SEQ ID NO: 145928 - DNA, 2766 bp, Artificial Sequence
  Description of Artificial Sequence: Synthetic coding sequence
atggctgatgatgatgtgctgtttgaagatgtgtatgagctgtgtgaggtgattggcaagggccccttctctgtggtgcggcgctgcatcaaccgggagaccggccagcagtttgctgtgaagatcgtggatgtggccaagttcaccagcagccctggcctgagcacagaggacctgaagcgggaggccagcatctgccacatgctgaagcacccccacatcgtggagctgctggagacctacagcagtgatggcatgctgtacatggtgtttgagttcatggatggagctgacctgtgctttgaaattgtgaagagagcagatgctggctttgtgtacagcgaggccgtggccagccactacatgaggcagatcctggaggccctgcgctactgccacgacaacaacatcatccacagagatgtgaagccccactgtgtgctgctggccagcaaagaaaattctgcccctgtgaagctgggcggctttggagtggccatccagctgggggagagcggcctggtggccggcggccgggtgggcaccccccacttcatggcccctgaggtggtgaagcgggagccctacggcaagcctgtggatgtgtggggctgtggggtcatcctcttcatcctgctgagcggctgcctgcccttctacggcaccaaggagcggctgtttgagggcatcatcaagggcaagtacaagatgaacccccggcagtggagccacatcagcgagagcgccaaggacctggtgcggaggatgctgatgctggaccctgctgagcgcatcaccgtgtatgaggccctgaaccacccctggctgaaggagcgggacagatatgcctacaagatccacctgcctgagaccgtggagcagctgaggaagttcaatgcccggaggaagctgaagggagctgtgctggccgctgtgagcagccacaagttcaacagcttctatggagaccccccagaggagctgcctgacttcagcgaggaccccaccagcagcggcctgctggccgctgagagagctgtgtcccaggtgctggacagcctggaggagatccacgccctgacagactgcagcgagaaggacctggacttcctgcacagcgtcttccaggaccagcacctgcacaccctgctggacctgtatgacaagatcaacaccaagagcagcccccagatcagaaatcctccttctgatgctgtgcagagggccaaggaggtgctggaggagatcagctgctacccagaaaataatgatgccaaggagctgaagaggatcctgacccagccccacttcatggccctgctgcagacccatgatgtggtggcccacgaggtgtacagtgatgaggccctgcgggtgaccccaccacccaccagcccctacctgaatggagacagccctgagagcgccaatggagacatggacatggagaatgtgaccagggtgcggctggtgcagttccagaagaacacagatgagcccatgggcatcaccctgaagatgaatgagctgaaccactgcatcgtggcccgcatcatgcacggcggcatgatccaccggcagggcaccctgcacgtgggagatgagatccgggagatcaatggcatctctgtggccaaccagacagtggagcagctgcagaagatgctgcgggagatgaggggcagcatcaccttcaagatcgtgcccagctaccgcacccagagcagcagctgtgagcgggacagccccagcaccagccggcagagccctgccaacggccacagcagcaccaacaacagcgtgtctgacctgcccagcaccacccagcccaagggccggcagatctacgtgcgggcccagtttgaatatgaccctgccaaggatgacctgatcccctgcaaggaggccggcatccgcttccgggtgggggacatcatccagatcatcagcaaggatgaccacaactggtggcagggcaagctggagaacagcaagaatggaacagctggcctcatccccagccctgagctgcaggagtggagggtggcctgcatcgccatggagaagaccaagcaggagcagcaggccagctgcacctggtttgggaagaagaagaagcagtacaaggacaagtacctggccaagcacaatgctgacctggtgacctatgaggaggtggtgaagctgcctgccttcaagaggaagaccctggtgctgctgggcgcccatggagtgggcagaagacacatcaagaacaccctcatcaccaagcacccagacagatttgcctaccccatcccccacaccacccggccccccaagaaggatgaggagaatggcaagaactactactttgtgtcccatgaccagatgatgcaggacatcagcaacaatgagtacctggagtatggcagccatgaagatgccatgtatggcaccaagctggagaccatcaggaagatccacgagcagggcctgattgccatcctggatgtggagccccaggccctgaaggtgctgaggacagctgagtttgccccctttgtggtgttcatcgccgcccccaccatcaccccaggcctgaatgaagatgagagcctgcagaggctgcagaaggagagtgacatcctgcagaggacctacgcccactactttgacctgaccatcatcaacaatgaaattgatgagaccatccgccacctggaggaggccgtggagctggtgtgcacagccccccagtgggtgcctgtgtcctgggtgtactag

SEQ ID NO: 145929 - DNA, 1146 bp, Artificial Sequence
  Description of Artificial Sequence: Synthetic coding sequence
gatgagatccgggagatcaatggcatctctgtggccaaccagacagtggagcagctgcagaagatgctgcgggagatgaggggcagcatcaccttcaagatcgtgcccagctaccgcacccagagcagcagctgtgagcgggacagccccagcaccagccggcagagccctgccaacggccacagcagcaccaacaacagcgtgtccatctacgtgcgggcccagtttgaatatgaccctgccaaggatgacctgatcccctgcaaggaggccggcatccgcttccgggtgggggacatcatccagatcatcagcaaggatgaccacaactggtggcagggcaagctggagaacagcaagaatggaacagctggcctcatccccagccctgagctgcaggagtggagggtggcctgcatcgccatggagaagaccaagcaggagcagcaggccagctgcacctggtttgggaagaagaagaagcagtacaaggacaagtacctggccaagcacaatgctgtgtttgaccagctggacctggtgacctatgaggaggtggtgaagctgcctgccttcaagaggaagaccctggtgctgctgggcgcccatggagtgggcagaagacacatcaagaacaccctcatcaccaagcacccagacagatttgcctaccccatcccccacaccacccggccccccaagaaggatgaggagaatggcaagaactactactttgtgtcccatgaccagatgatgcaggacatcagcaacaatgagtacctggagtatggcagccatgaagatgccatgtatggcaccaagctggagaccatcaggaagatccacgagcagggcctgattgccatcctggatgtggagccccaggccctgaaggtgctgaggacagctgagtttgccccctttgtggtgttcatcgccgcccccaccatcaccccaggcctgaatgaagatgagagcctgcagaggctgcagaaggagagtgacatcctgcagaggacctacgcccactactttgacctgaccatcatcaacaatgaaattgatgagaccatccgccacctggaggaggccgtggagctggtgtgcacagccccccagtgggtgcctgtgtcctgggtgtactag

SEQ ID NO: 145930 - DNA, 1557 bp, Artificial Sequence
  Description of Artificial Sequence: Synthetic coding sequence
ctctatgacaagatcaacaccaagagcagcccccagatccggaaccccccatctgatgctgtgcagagggccaaggaggtgctggaggagatcagctgctacccagagaacaatgatgccaaggagctgaagaggatcctgacccagccccacttcatggccctgctgcagacccatgatgtggtggcccacgaggtgtacagtgatgaggccctgcgggtgaccccaccacccaccagcccctacctgaatggagacagccctgagagcgccaacggggacatggacatggagaatgtgaccagggtgcggctggtgcagttccagaagaacacagatgagcccatgggcatcaccctgaagatgaatgagctgaaccactgcatcgtggcccgcatcatgcatggaggcatgatccaccggcagggcaccctgcacgtgggagatgagatccgggagatcaatggcatctctgtggccaaccagacagtggagcagctgcagaagatgctgcgggagatgaggggcagcatcaccttcaagatcgtgcccagctaccgcacccagagcagcagctgtgaggacctgcccagcaccacccagcccaagggccggcagatctacgtgcgggcccagtttgaatatgaccctgccaaggatgacctgatcccctgcaaggaggccggcatccgcttccgggtgggggacatcatccagatcatcagcaaggatgaccacaactggtggcagggcaagctggagaacagcaagaatggaacagctggcctcatccccagccctgagctgcaggagtggagggtggcctgcatcgccatggagaagaccaagcaggagcagcaggccagctgcacctggtttgggaagaagaagaagcagtacaaggacaagtacctggccaagcacaatgctgtgtttgaccagctggacctggtgacctatgaggaggtggtgaagctgcctgccttcaagaggaagaccctggtgctgctgggcgcccacggcgtgggccgccgccacatcaagaacaccctcatcaccaagcacccagacagatttgcctaccccatcccccacaccaccaggcctcccaagaaggatgaagaaaatggcaagaactactactttgtgtcccatgaccagatgatgcaggacatcagcaacaatgagtacctggagtatggcagccatgaagatgccatgtatggcaccaagctggagaccatcaggaagatccacgagcagggcctcatcgccatcctggatgtggagccccaggccctgaaggtgctgaggacagctgagtttgccccctttgtggtgttcatcgccgcccccaccatcaccccaggcctgaatgaagatgagagcctgcagaggctgcagaaggagagtgacatcctgcagaggacctacgcccactactttgacctgaccatcatcaacaatgaaattgatgagaccatccgccacctggaggaggccgtggagctggtgtgcacagccccccagtgggtgcctgtgtcctgggtgtactag

SEQ ID NO: 145931 - DNA, 2694 bp, Artificial Sequence
  Description of Artificial Sequence: Synthetic coding sequence
atggctgatgatgatgtgctgtttgaagatgtgtatgagctgtgtgaggtgattggcaagggccccttctctgtggtgcggcgctgcatcaaccgggagaccggccagcagtttgctgtgaagatcgtggatgtggccaagttcaccagcagccctggcctgagcacagaggacctgaagcgggaggccagcatctgccacatgctgaagcacccccacatcgtggagctgctggagacctacagcagtgatggcatgctgtacatggtgtttgagttcatggatggagctgacctgtgctttgaaattgtgaagagagcagatgctggctttgtgtacagcgaggccgtggccagccactacatgaggcagatcctggaggccctgcgctactgccacgacaacaacatcatccacagagatgtgaagccccactgtgtgctgctggccagcaaagaaaattctgcccctgtgaagctgggcggctttggagtggccatccagctgggggagagcggcctggtggccggcggccgggtgggcaccccccacttcatggcccctgaggtggtgaagcgggagccctacggcaagcctgtggatgtgtggggctgtggggtcatcctcttcatcctgctgagcggctgcctgcccttctacggcaccaaggagcggctgtttgagggcatcatcaagggcaagtacaagatgaacccccggcagtggagccacatcagcgagagcgccaaggacctggtgcggaggatgctgatgctggaccctgctgagcgcatcaccgtgtatgaggccctgaaccacccctggctgaaggagcgggacagatatgcctacaagatccacctgcctgagaccgtggagcagctgaggaagttcaatgcccggaggaagctgaagggagctgtgctggccgctgtgagcagccacaagttcaacagcttctatggagaccccccagaggagctgcctgacttcagcgaggaccccaccagcagcggggctgtgtcccaggtgctggacagcctggaggagatccacgccctgacagactgcagcgagaaggacctggacttcctgcacagcgtcttccaggaccagcacctgcacaccctgctggacctgtatgacaagatcaacaccaagagcagcccccagatcagaaatcctccttctgatgctgtgcagagggccaaggaggtgctggaggagatcagctgctacccagaaaataatgatgccaaggagctgaagaggatcctgacccagccccacttcatggccctgctgcagacccatgatgtggtggcccacgaggtgtacagtgatgaggccctgcgggtgaccccaccacccaccagcccctacctgaatggagacagccctgagagcgccaatggagacatggacatggagaatgtgaccagggtgcggctggtgcagttccagaagaacacagatgagcccatgggcatcaccctgaagatgaatgagctgaaccactgcatcgtggcccgcatcatgcacggcggcatgatccaccggcagggcaccctgcacgtgggagatgagatccgggagatcaatggcatctctgtggccaaccagacagtggagcagctgcagaagatgctgcgggagatgaggggcagcatcaccttcaagatcgtgcccagctaccgcacccagagcagcagctgtgaggacctgcccagcaccacccagcccaagggccggcagatctacgtgcgggcccagtttgaatatgaccctgccaaggatgacctgatcccctgcaaggaggccggcatccgcttccgggtgggggacatcatccagatcatcagcaaggatgaccacaactggtggcagggcaagctggagaacagcaagaatggaacagctggcctcatccccagccctgagctgcaggagtggagggtggcctgcatcgccatggagaagaccaagcaggagcagcaggccagctgcacctggtttgggaagaagaagaagcagtacaaggacaagtacctggccaagcacaatgctgtgtttgaccagctggacctggtgacctatgaggaggtggtgaagctgcctgccttcaagaggaagaccctggtgctgctgggcgcccatggagtgggcagaagacacatcaagaacaccctcatcaccaagcacccagacagatttgcctaccccatcccccacaccacccggccccccaagaaggatgaggagaatggcaagaactactactttgtgtcccatgaccagatgatgcaggacatcagcaacaatgagtacctggagtatggcagccatgaagatgccatgtatggcaccaagctggagaccatcaggaagatccacgagcagggcctgattgccatcctggatgtggagccccaggccctgaaggtgctgaggacagctgagtttgccccctttgtggtgttcatcgccgcccccaccatcaccccaggcctgaatgaagatgagagcctgcagaggctgcagaaggagagtgacatcctgcagaggacctacgcccactactttgacctgaccatcatcaacaatgaaattgatgagaccatccgccacctggaggaggccgtggagctggtgtgcacagccccccagtgggtgcctgtgtcctgggtgtactag

SEQ ID NO: 145932 - DNA, 2697 bp, Artificial Sequence
  Description of Artificial Sequence: Synthetic coding sequence
atggctgatgatgatgtgctgtttgaagatgtgtatgagctgtgtgaggtgattggcaagggccccttctctgtggtgcggcgctgcatcaaccgggagaccggccagcagtttgctgtgaagatcgtggatgtggccaagttcaccagcagccctggcctgagcacagaggacctgaagcgggaggccagcatctgccacatgctgaagcacccccacatcgtggagctgctggagacctacagcagtgatggcatgctgtacatggtgtttgagttcatggatggagctgacctgtgctttgaaattgtgaagagagcagatgctggctttgtgtacagcgaggccgtggccagccactacatgaggcagatcctggaggccctgcgctactgccacgacaacaacatcatccacagagatgtgaagccccactgtgtgctgctggccagcaaagaaaattctgcccctgtgaagctgggcggctttggagtggccatccagctgggggagagcggcctggtggccggcggccgggtgggcaccccccacttcatggcccctgaggtggtgaagcgggagccctacggcaagcctgtggatgtgtggggctgtggggtcatcctcttcatcctgctgagcggctgcctgcccttctacggcaccaaggagcggctgtttgagggcatcatcaagggcaagtacaagatgaacccccggcagtggagccacatcagcgagagcgccaaggacctggtgcggaggatgctgatgctggaccctgctgagcgcatcaccgtgtatgaggccctgaaccacccctggctgaaggagcgggacagatatgcctacaagatccacctgcctgagaccgtggagcagctgaggaagttcaatgcccggaggaagctgaagggagctgtgctggccgctgtgagcagccacaagttcaacagcttctatggagaccccccagaggagctgcctgacttcagcgaggaccccaccagcagcggcctgctggccgctgagagagctgtgtcccaggtgctggacagcctggaggagatccacgccctgacagactgcagcgagaaggacctggacttcctgcacagcgtcttccaggaccagcacctgcacaccctgctggacctgtatgacaagatcaacaccaagagcagcccccagatcagaaatcctccttctgatgctgtgcagagggccaaggaggtgctggaggagatcagctgctacccagaaaataatgatgccaaggagctgaagaggatcctgacccagccccacttcatggccctgctgcagacccatgatgtggtggcccacgaggtgtacagtgatgaggccctgcgggtgaccccaccacccaccagcccctacctgaatggagacagccctgagagcgccaatggagacatggacatggagaatgtgaccagggtgcggctggtgcagttccagaagaacacagatgagcccatgggcatcaccctgaagatgaatgagctgaaccactgcatcgtggcccgcatcatgcacggcggcatgatccaccggcagggcaccctgcacgtgggagatgagatccgggagatcaatggcatctctgtggccaaccagacagtggagcagctgcagaagatgctgcgggagatgaggggcagcatcaccttcaagatcgtgcccagctaccgcacccagagcagcagctgtgaggacctgcccagcaccacccagcccaagggccggcagatctacgtgcgggcccagtttgaatatgaccctgccaaggatgacctgatcccctgcaaggaggccggcatccgcttccgggtgggggacatcatccagatcatcagcaaggatgaccacaactggtggcagggcaagctggagaacagcaagaatggaacagctggcctcatccccagccctgagctgcaggagtggagggtggcctgcatcgccatggagaagaccaagcaggagcagcaggccagctgcacctggtttgggaagaagaagaagcagtacaaggacaagtacctggccaagcacaatgctgacctggtgacctatgaggaggtggtgaagctgcctgccttcaagaggaagaccctggtgctgctgggcgcccacggcgtgggccgccgccacatcaagaacaccctcatcaccaagcacccagacagatttgcctaccccatcccccacaccaccaggcctcccaagaaggatgaagaaaatggcaagaactactactttgtgtcccatgaccagatgatgcaggacatcagcaacaatgagtacctggagtatggcagccatgaagatgccatgtatggcaccaagctggagaccatcaggaagatccacgagcagggcctcatcgccatcctggatgtggagccccaggccctgaaggtgctgaggacagctgagtttgccccctttgtggtgttcatcgccgcccccaccatcaccccaggcctgaatgaagatgagagcctgcagaggctgcagaaggagagtgacatcctgcagaggacctacgcccactactttgacctgaccatcatcaacaatgaaattgatgagaccatccgccacctggaggaggccgtggagctggtgtgcacagccccccagtgggtgcctgtgtcctgggtgtactag

SEQ ID NO: 145933 - DNA, 3237 bp, Artificial Sequence
  Description of Artificial Sequence: Synthetic coding sequence
atggccttctacagctgctgctgggtgctgctggccctgacctggcacaccagcgcctacggccctgaccagagggcccagaagaagggggacatcatcctgggcggcctcttccccatccactttggagtggccgccaaggaccaggacctgaagagcaggcctgagagcgtggagtgcatccgctacaacttccggggcttccgctggctgcaggccatgatctttgccatcgaggagatcaacagcagccctgccctgctgcccaacctgaccctgggctaccgcatctttgacacctgcaacacagtgtccaaggccctggaggccaccctgagctttgtggcccagaacaagattgacagcctgaacctggatgagttctgcaactgcagcgagcacatccccagcaccatcgctgtggtgggcgccactggaagtggagtgtccacagctgtggccaacctgctgggcctcttctacatcccccaggtgtcctatgccagcagcagccggctgctgagcaacaagaaccagttcaagagcttcctgcggaccatccccaatgatgagcaccaggccacagccatggctgacatcatcgagtacttccgctggaactgggtgggcaccatcgccgcagatgatgattatggccggcccggcatcgagaagttccgggaggaggccgaggagcgggacatctgcatcgacttcagcgagctgatcagccagtacagtgatgaggaggagatccagcacgtggtggaggtgatccagaacagcacagccaaggtgattgtggtgttcagcagcggccctgacctggagcccctcatcaaggagatcgtgagaagaaacatcaccgggaagatctggctggccagcgaggcctgggccagcagcagcctgattgccatgccccagtacttccacgtggtgggcggcaccatcggctttgccctgaaggccggccagatccctggcttccgggagttcctgaagaaggtgcaccccaggaagtctgtgcacaatggatttgccaaggagttctgggaggagaccttcaactgccacctgcaggagggcgccaagggccccctgcctgtggacaccttcctgcggggccacgaggagagcggggaccgcttcagcaacagcagcacagccttccggcccctgtgcacaggagatgagaacatcagctctgtggagaccccctacatcgactacacccacctgcgcatctcctacaacgtgtacctggccgtgtacagcatcgcccacgccctgcaggacatctacacctgcctgcccggccggggcctcttcaccaacggcagctgtgccgacatcaagaaggtggaggcctggcaggtgctgaagcacctgcggcacctgaacttcaccaacaacatgggagagcaggtgacctttgatgaatgtggggacctggtgggcaactacagcatcatcaactggcacctgagcccagaagatggcagcatcgtgttcaaggaggtgggctactacaacgtgtatgccaagaagggggagcggctcttcatcaatgaggagaagatcctgtggagcggcttcagccgggaggtgcccttcagcaactgcagccgggactgcctggccggcaccaggaagggcatcattgaaggagagcccacctgctgctttgaatgtgtggagtgcccagatggagagtacagtgatgaaacagatgccagcgcctgcaacaagtgcccagatgacttctggagcaatgaaaaccacaccagctgcatcgccaaggagattgagttcctgtcctggacagagcccttcggcatcgccctgaccctgtttgctgtgctgggcatcttcctgacagcctttgtgctgggcgtcttcatcaagttcaggaacacccccatcgtgaaggccaccaaccgggagctgagctacctgctgctcttcagcctgctgtgctgcttcagcagcagcctcttcttcatcggggagccccaggactggacctgccgcctgcggcagcctgccttcggcatcagctttgtgctgtgcatcagctgcatcctggtgaagaccaacagagtgctgctggtgtttgaggccaagatccccaccagcttccacaggaagtggtggggcctgaacctgcagttcctgctggtgttcctgtgcaccttcatgcagatcgtcatctgtgtgatctggctgtacacagccccacccagcagctacagaaaccaggagctggaggatgagatcatcttcatcacctgccacgagggcagcctgatggccctgggcttcctgattggctacacctgcctgctggccgccatctgcttcttctttgccttcaagagcaggaagctgcctgagaacttcaatgaggccaagttcatcaccttctccatgctgatcttcttcatcgtgtggatctccttcatcccagcctatgccagcacctacggcaagtttgtgtctgctgtggaggtgattgccatcctggccgccagctttggcctgctggcctgcatcttcttcaacaagatctacatcatcctcttcaagcccagcaggaacaccatcgaggaggtgcgctgcagcacagctgcccacgccttcaaggtggccgcccgggccaccctgcggcgcagcaatgtgtccaggaagaggagcagcagcctgggcggcagcacaggcagcacccccagcagcagcatcagcagcaagagcaacagcgaggaccccttcccccagcctgagcggcagaagcagcagcagcccctggccctgacccagcaggagcagcagcagcagcccctgaccctgccccagcagcagaggagccagcagcagccccgctgcaagcagaaggtgatcttcggcagcggcaccgtgaccttcagcctgagctttgatgagccccagaagaatgccatggcccacaggaacagcacccaccagaacagcctggaggcccagaagagcagtgacaccctgaccaggcatgagcccctgctgcccctgcagtgtggggagacagacctggacctgactgtgcaggagaccggcctgcagggccctgtgggcggggaccagaggcctgaggtggaggaccctgaggagctgagccctgccctggtggtgagcagcagccagagctttgtgatcagcggcggcggcagcacagtgacagaaaatgtggtgaacagctag

SEQ ID NO: 145934 - DNA, 3237 bp, Artificial Sequence; identical to SEQ ID NO: 145933
  Description of Artificial Sequence: Synthetic coding sequence

SEQ ID NO: 145935 - DNA, 3267 bp, Artificial Sequence
  Description of Artificial Sequence: Synthetic coding sequence
atggccttctacagctgctgctgggtgctgctggccctgacctggcacaccagcgcctacggccctgaccagagggcccagaagaagggggacatcatcctgggcggcctcttccccatccactttggagtggccgccaaggaccaggacctgaagagcaggcctgagagcgtggagtgcatccgctacaacttccggggcttccgctggctgcaggccatgatctttgccatcgaggagatcaacagcagccctgccctgctgcccaacctgaccctgggctaccgcatctttgacacctgcaacacagtgtccaaggccctggaggccaccctgagctttgtggcccagaacaagattgacagcctgaacctggatgagttctgcaactgcagcgagcacatccccagcaccatcgctgtggtgggcgccactggaagtggagtgtccacagctgtggccaacctgctgggcctcttctacatcccccaggtgtcctatgccagcagcagccggctgctgagcaacaagaaccagttcaagagcttcctgcggaccatccccaatgatgagcaccaggccacagccatggctgacatcatcgagtacttccgctggaactgggtgggcaccatcgccgcagatgatgattatggccggcccggcatcgagaagttccgggaggaggccgaggagcgggacatctgcatcgacttcagcgagctgatcagccagtacagtgatgaggaggagatccagcacgtggtggaggtgatccagaacagcacagccaaggtgattgtggtgttcagcagcggccctgacctggagcccctcatcaaggagatcgtgagaagaaacatcaccgggaagatctggctggccagcgaggcctgggccagcagcagcctgattgccatgccccagtacttccacgtggtgggcggcaccatcggctttgccctgaaggccggccagatccctggcttccgggagttcctgaagaaggtgcaccccaggaagtctgtgcacaatggatttgccaaggagttctgggaggagaccttcaactgccacctgcaggagggcgccaagggccccctgcctgtggacaccttcctgcggggccacgaggagagcggggaccgcttcagcaacagcagcacagccttccggcccctgtgcacaggagatgagaacatcagctctgtggagaccccctacatcgactacacccacctgcgcatctcctacaacgtgtacctggccgtgtacagcatcgcccacgccctgcaggacatctacacctgcctgcccggccggggcctcttcaccaacggcagctgtgccgacatcaagaaggtggaggcctggcaggtgctgaagcacctgcggcacctgaacttcaccaacaacatgggagagcaggtgacctttgatgaatgtggggacctggtgggcaactacagcatcatcaactggcacctgagcccagaagatggcagcatcgtgttcaaggaggtgggctactacaacgtgtatgccaagaagggggagcggctcttcatcaatgaggagaagatcctgtggagcggcttcagccgggagcccctgacctttgtgctgtctgtgctgcaggtgcccttcagcaactgcagccgggactgcctggccggcaccaggaagggcatcattgaaggagagcccacctgctgctttgaatgtgtggagtgcccagatggagagtacagtgatgaaacagatgccagcgcctgcaacaagtgcccagatgacttctggagcaatgaaaaccacaccagctgcatcgccaaggagattgagttcctgtcctggacagagcccttcggcatcgccctgaccctgtttgctgtgctgggcatcttcctgacagcctttgtgctgggcgtcttcatcaagttcaggaacacccccatcgtgaaggccaccaaccgggagctgagctacctgctgctcttcagcctgctgtgctgcttcagcagcagcctcttcttcatcggggagccccaggactggacctgccgcctgcggcagcctgccttcggcatcagctttgtgctgtgcatcagctgcatcctggtgaagaccaacagagtgctgctggtgtttgaggccaagatccccaccagcttccacaggaagtggtggggcctgaacctgcagttcctgctggtgttcctgtgcaccttcatgcagatcgtcatctgtgtgatctggctgtacacagccccacccagcagctacagaaaccaggagctggaggatgagatcatcttcatcacctgccacgagggcagcctgatggccctgggcttcctgattggctacacctgcctgctggccgccatctgcttcttctttgccttcaagagcaggaagctgcctgagaacttcaatgaggccaagttcatcaccttctccatgctgatcttcttcatcgtgtggatctccttcatcccagcctatgccagcacctacggcaagtttgtgtctgctgtggaggtgattgccatcctggccgccagctttggcctgctggcctgcatcttcttcaacaagatctacatcatcctcttcaagcccagcaggaacaccatcgaggaggtgcgctgcagcacagctgcccacgccttcaaggtggccgcccgggccaccctgcggcgcagcaatgtgtccaggaagaggagcagcagcctgggcggcagcacaggcagcacccccagcagcagcatcagcagcaagagcaacagcgaggaccccttcccccagcctgagcggcagaagcagcagcagcccctggccctgacccagcaggagcagcagcagcagcccctgaccctgccccagcagcagaggagccagcagcagccccgctgcaagcagaaggtgatcttcggcagcggcaccgtgaccttcagcctgagctttgatgagccccagaagaatgccatggcccacaggaacagcacccaccagaacagcctggaggcccagaagagcagtgacaccctgaccaggcatgagcccctgctgcccctgcagtgtggggagacagacctggacctgactgtgcaggagaccggcctgcagggccctgtgggcggggaccagaggcctgaggtggaggaccctgaggagctgagccctgccctggtggtgagcagcagccagagctttgtgatcagcggcggcggcagcacagtgacagaaaatgtggtgaacagctag

SEQ ID NO: 145936 - DNA, 978 bp, Artificial Sequence
  Description of Artificial Sequence: Synthetic coding sequence
atggcccggcctgtgtctgacaggaccccagcccccctgctgctgggcggccctgctggcaccccacctgggggcggggccctgctgggcctgcggagcctgctgcagggcaccagcaagcccaaggagcccgccagctgcctgctgaaggagaaggagaggaaggccgccctgcctgctgccaccaccccaggccctggcctggagacagctggccctgcagatgccccagctggagctgtggtgggcggcggcagcccccggggccggcccggccctgtgcctgcccctggcctgctggcccccctgctgtgggagaggaccctgccctttggagatgtggagtatgtggacctggatgccttcctgctggagcacggcctgccccccagccccccacctcctgggggccccagccctgagcccagccctgcccggaccccagcccccagccctggccctggcagctgtggcagcgccagccccaggagcagccctggccacgccccagcccgggccgccctgggcacagccagcggccacagagctggcctgaccagccgggacacccccagccctgtggaccctgacacagtggaggtgctgatgacctttgagccagaccctgctgacctggccctgagcagcatccctggccacgagacctttgacccccggcggcaccgcttcagcgaggaggagctgaagccccagcccatcatgaagaaggccaggaagatccaggtgcctgaggagcagaaggatgagaagtactggagccgccgctacaagaacaatgaggccgccaagaggagcagagatgcccggcggctgaaggagaaccagatctctgtgcgggccgccttcctggagaaggaaaatgccctgctgcggcaggaggtggtggccgtgcggcaggagctgagccactacagagctgtgctgagccgctaccaggcccagcacggggccctgtag

SEQ ID NO: 145937 - DNA, 969 bp, Artificial Sequence
  Description of Artificial Sequence: Synthetic coding sequence
agccagaggggcaagggcacctgccccggcagccacagaaatcatgccagcagcctgcccagccacggcctggtgtccatccagggcatcagcgccccagctggccagtggccagcccccccaccctggagccaggagggcatgcagtgccaccgggacctggccctgagccaggccctgtggggctggcagctgagcaagcagagcggctgggcccaccccagcctgccccacagccccctgcccagcacagtgcacagctgctcctgggccccaccccacctgcagaggcacctgcccctggccaccgtgtccccaggcaccacccagctgacccagggccctgctggccgcaccctgggccagacccaggccagctgcccagagccccggcccagcatggatgctgtggatgccaccatggagaagctgcgggcccagtgcctgagcagaggagccagcggcatccagggcctggcccgcttcttccggcagctggacagagatggcagccgcagcctggatgctgatgagttccggcagggcctggccaagctgggcctggtgctggaccaggccgaggccgagggcgtgtgcaggaagtgggacagaaatggaagtggcaccctggacctggaggagttcctgcgggccctgcggccccccatgagccaggcccgggaggccgtgattgctgctgcctttgccaagctggacagaagtggagatggagtggtgacagtggatgacctgcggggcgtgtacagcggccgggcccaccccaaggtgcgctctggagagtggacagaagatgaggtgctgcggcgcttcctggacaactttgacagcagcgagaaggatggccaggtgaccctggccgagttccaggactactacagcggcgtgtctgcctccatgaacacagatgaggagtttgtggccatgatgaccagcgcctggcagctgtag

SEQ ID NO: 145938 - DNA, 489 bp, Artificial Sequence
  Description of Artificial Sequence: Synthetic coding sequence
atggatgctgtggatgccaccatggagaagctgcgggcccagtgcctgagcagaggagccagcggcatccagggcctggcccgcttcttccggcagctggacagagatggcagccgcagcctggatgctgatgagttccggcagggcctggccaagctgggcctggtgctggaccaggccgaggccgagggcgtgtgcaggaagtgggacagaaatggcagcggcaccctggacctggaggagttcctgcgggccctgcggccccccatgagccaggcccgggaggccgtgattgctgctgcctttgccaagctggacagaagtggagatggagtggtgacagtggatgacctgcggggcgtgtacagcggccgggcccaccccaaggtgaccctggccgagttccaggactactacagcggcgtgtctgcctccatgaacacagatgaggagtttgtggccatgatgaccagcgcctggcagctgtag

SEQ ID NO: 145939 - DNA, 882 bp, Artificial Sequence
  Description of Artificial Sequence: Synthetic coding sequence
ctcatcaacatcctgtaccgggccgtcatcagtgaccctgagcagaacctggccatcgagcagaaggagagtgaccacatcctgcctgacagcaagatgacccccctgcgcttcaggaagaggaccctgcacgagaccaagatccgcacccacagcaccctgacagaaaatgtgctgagccacaagctgcagtttgatggaagaattgtgtccaggaccaacgtgctgcccttcatccagaagagcatctacagccaccagtgtggccgcaggaagggcaagcagtaccgcctgggggacttctacgtgggcgccaccctgaccttcctgagcagtgaccacctgagcctgcctgagagcatcaaggagaacaccctgctgaagctgcgcatcaccaacatcgaccagatcgccctggacagcctgaagacagcctccatggagcaggaggatgacatcatcatccaggagaccaatgaccggctggtgttcaaggccatccaggatgtgctgaaggagaagctgcacaagaggggcgtgcgcatcctgaccggcctgggcaagtacttccagcagctggacaaggagggcaatggcctgctggacaaggctgacttcaagcaggccctgaaggtgttccacctggaggtgtctgagaaggactttgagagcgcctggctgatcctgaatgacaatggaaatggcaaggtggactatggagagttcaagaggggcatcattggagagatgaatgagtacaggaagagctatgtgaggaaggccttcatgaagctggacttcaacaagagcggctctgtgcccatcatcaacatcaggaagtgctactgtgccaagaagcacagccaggtgatcagcggctag

SEQ ID NO: 145940 - DNA, 1149 bp, Artificial Sequence
  Description of Artificial Sequence: Synthetic coding sequence
atgattgaccacctgagccgggccgtcatcagtgaccctgagcagaacctggccatcgagcagaaggagagtgaccacatcctgcctgacagcaagatgacccccctgcgcttcaggaagaggaccctgcacgagaccaagatccgcacccacagcaccctgacagaaaatgtgctgagccacaagctgcagtttgatggaagaattgtgtccagaaatggaagagatgcctgccgggagctgattggcttcttcttcacccatgaccagagcctgaccatctatgagtaccggcagtttgggaagaacagaaccaacgtgctgcccttcatccagaagagcatctacagccaccagtgtggccgcaggaagggcaagcagtaccgcctgggggacttctacgtgggcgccaccctgaccttcctgagcagtgaccacctgagcctgcctgagagcatcaaggagaacaccctgctgaagctgcgcatcaccaacatcgaccagatcgccctggacagcctgaagacagcctccatggagcaggaggatgacatcatcatccaggagaccaatgaccggctggtgttcaaggccatccaggatgtgctgaaggagaagctgcacaagaggggcgtgcgcatcctgaccggcctgggcaagtacttccagcagctggacaaggagggcaatggcctgctggacaaggctgacttcaagcaggccctgaaggtgttccacctggaggtgtctgagaaggactttgagagcgcctggctgatcctgaatgacaatggaaatggcaaggtggactatggagagttcaagaggggcatcattggagagatgaatgagtacaggaagagctatgtgaggaaggccttcatgaagctggacttcaacaagagcggctctgtgcccatcatcaacatcaggaagtgctactgtgccaagaagcacagccaggtgatcagcggccacagcacagaggaggagatcaagagcagcttcctggagaccctgaaggtggcctgcagcaagagtgatgaggtgtcctatggagaatttgaggactactatgagggcctgagcatcggcatcgtggatgatgaggactttgtgaacatcctgcggaccccctggggcatctag

SEQ ID NO: 145941 - DNA, 1674 bp, Artificial Sequence
  Description of Artificial Sequence: Synthetic coding sequence
atgggcaacagcttctgctacacagctgtgtactgcatgatcaacacaggcacccagatggacctggaggtgaagggcgtggccgccaccagccgcagccagatccagcccttctttggaaggaagaagcccctgcagcagcgctggaccagcgagagctggaccaaccagaacagctgcccccctgtggtgccccggctggacctgggcagcctggtggacagtgatgatgaggacaacttctcctacatccccctgagcacagccaacctgcccaacagcagcagcaccctgggctgggtgaccccctgccagaccccctacacccagtaccacctgaacaagctggaccagaacatcatccctgagaacctgcctgcccccacagacaagtgcaagctgaagtaccagcagtgcaagacagagatcaaggagggctacaagcagtacagccagagaaatgctgagaacaccaagagcaatgtgacccacaagcagagccccaggaacaagattgatgagaagtgtgtgcaggatgaggaggccaacacagatgacctgaccaccctggacaggaaggccatcctgcagcagggctatgctgacaacagctgtgacaagcagcagagggccaggaagctggatgctgagatcgtggccgctgagaagaagaagcagatcgtggccgagcaggtgatgattgaccacctgagccgggccgtcatcagtgaccctgagcagaacctggccatcgagcagaaggagagtgaccacatcctgcctgacagcaagatgacccccctgcgcttcaggaagaggaccctgcacgagaccaagatccgcacccacagcaccctgacagaaaatgtgctgagccacaagctgcagtttgatggaagaattgtgtccagaaatggaagagatgcctgccgggagctgattggcttcttcttcacccatgaccagagcctgaccatctatgagtaccggcagtttgggaagaacagaaccaacgtgctgcccttcatccagaagagcatctacagccaccagtgtggccgcaggaagggcaagcagtaccgcctgggggacttctacgtgggcgccaccctgaccttcctgagcagtgaccacctgagcctgcctgagagcatcaaggagaacaccctgctgaagctgcgcatcaccaacatcgaccagatcgccctggacagcctgaagacagcctccatggagcaggaggatgacatcatcatccaggagaccaatgaccggctggtgttcaaggccatccaggatgtgctgaaggagaagctgcacaagaggggcgtgcgcatcctgaccggcctgggcaagtacttccagcagctggacaaggagggcaatggcctgctggacaaggctgacttcaagcaggccctgaaggtgttccacctggaggtgtctgagaaggactttgagagcgcctggctgatcctgaatgacaatggaaatggcaaggtggactatggagagttcaagaggggcatcattggagagatgaatgagtacaggaagagctatgtgaggaaggccttcatgaagctggacttcaacaagagcggctctgtgcccatcatcaacatcaggaagtgctactgtgccaagaagcacagccaggtgatcagcggctag

SEQ ID NO: 145942 - DNA, 615 bp, Artificial Sequence
  Description of Artificial Sequence: Synthetic coding sequence
atggagcaggaggatgacatcatcatccaggagaccaatgaccggctggtgttcaaggccatccaggatgtgctgaaggagaagctgcacaagaggggcgtgcgcatcctgaccggcctgggcaagtacttccagcagctggacaaggagggcaatggcctgctggacaaggctgacttcaagcaggccctgaaggtgttccacctggaggtgtctgagaaggactttgagagcgcctggctgatcctgaatgacaatggaaatggcaaggtggactatggagagttcaagaggggcatcattggagagatgaatgagtacaggaagagctatgtgaggaaggccttcatgaagctggacttcaacaagagcggctctgtgcccatcatcaacatcaggaagtgctactgtgccaagaagcacagccaggtgatcagcggccacagcacagaggaggagatcaagagcagcttcctggagaccctgaaggtggcctgcagcaagagtgatgaggtgtcctatggagaatttgaggactactatgagggcctgagcatcggcatcgtggatgatgaggactttgtgaacatcctgcggaccccctggggcatctag

SEQ ID NO: 145943 - DNA, 3009 bp, Artificial Sequence
  Description of Artificial Sequence: Synthetic coding sequence
atggccgcccacgagtgggactggttccagcgggaggagctgattggccagatcagtgacatccgggtgcagaacctgcaggtggagagagaaaatgtgcagaagaggaccttcacccgctggatcaacctgcacctggagaagtgcaacccccccctggaggtgaaggacctgtttgtggacatccaggacggcaagatcctgatggccctgctggaggtgctgagcggcaggaacctgctgcacgagtacaagagcagcagccaccgcatcttccggctgaacaacatcgccaaggccctgaagttcctggaggacagcaatgtgaagctggtgtccattgatgctgctgagattgctgatggcaaccccagcctggtgctgggcctcatctggaacatcatcctcttcttccagatcaaggagctgaccggcaacctgagcaggaacagccccagcagcagcctgagccctggcagcggcggcacagacagcgacagcagcttcccccccacccccacagctgagaggtctgtggccatctctgtgaaggaccagaggaaggccatcaaggccctgctggcctgggtgcagaggaagaccaggaaatatggagtggccgtgcaggactttgctggctcctggaggagcggcctggccttcctggccgtcatcaaggccatcgaccccagcctggtggacatgaagcaggccctggagaacagcacccgggagaacctggagaaggccttcagcatcgcccaggatgccctgcacatcccccggctgctggagcctgaggacatcatggtggacaccccagatgagcagagcatcatgacctacgtggcccagttcctggagcgcttccctgagctggaggccgaggacatctttgacagcgacaaggaggtgcccatcgagagcacctttgtgcgcatcaaggagaccccatctgagcaggagagcaaggtgtttgtgctgacagaaaatggagagaggacctacacagtgaaccacgagaccagccaccccccacccagcaaggtgtttgtgtgtgacaagccagagagcatgaaggagttccggctggatggagtgagcagccacgccctgagtgacagcagcacagagttcatgcaccagatcatcgaccaggtgctgcagggcggccctgggaagaccagtgacatcagcgagcccagccctgagagcagcatcctgagcagcaggaaagaaaatggccgcagcaacagcctgcccatcaagaagacagtgcactttgaggccgacacctacaaggaccccttctgcagcaagaacctgagcctgtgctttgagggcagcccccgggtggccaaggagagcctgcggcaggacggccacgtgctggccgtggaggtggccgaggagaaggagcagaagcaggagagcagcaagatccctgagagcagcagtgacaaggtggccggggacatcttcctggtggagggcaccaacaacaacagccagagcagcagctgcaatggagccctggagagcacagcccggcatgatgaggagagccacagcctgagccccccaggagagaacacagtgatggctgacagcttccagatcaaggtgaacctgatgacagtggaggccctggaggagggggactactttgaggccatccccctgaaggccagcaagttcaacagcgacctgattgactttgccagcaccagccaggccttcaacaaggtgcccagcccccatgagaccaagccagatgaagatgctgaggcctttgaaaatcatgctgagaagctgggcaagaggagcatcaagagcgcccacaagaagaaggacagccctgagccccaggtgaagatggacaagcatgagccccaccaggacagcggggaggaggccgagggctgccccagcgcccctgaggagacccctgtggacaagaagccagaggtgcatgagaaggccaagaggaagagcacccggccccactatgaggaggagggagaagatgatgacctgcagggcgtgggggaggagctgagcagcagcccccccagcagctgtgtgtccctggagaccctgggcagccacagcgaggagggcctggacttcaagcccagcccccccctgagcaaggtgtctgtcatcccccatgacctcttctacttcccccactatgaggtgcccctggccgctgtgctggaggcctacgtggaggaccctgaggacctgaagaatgaggagatggacctggaggagcctgagggctacatgccagacctggacagccgggaggaggaggctgatggcagccagagcagcagcagcagctctgtgcctggagagagcctgcccagcgccagtgaccaggtgctgtacctgagcagaggaggagtgggcaccaccccagccagcgagcccgcccccctggcccctcatgaggaccaccagcagcgggagaccaaggaaaatgaccccatggacagccaccagagccaggagagccccaacctggagaacatcgccaaccccctggaggagaatgtgaccaaggagagcatcagcagcaagaagaaggagaagaggaagcacgtggaccacgtggagagcagcctgtttgtggcccctggctctgtgcagagcagtgatgacctggaggaggacagcagtgactacagcatccccagcaggaccagccacagcgacagcagcatctacctgcggcggcacacccacaggagcagcgagagtgaccacttctcctatgtgcagctgagaaatgctgctgacctggatgacagaagaaaccgcatcctgaccaggaaggccaacagcagcggggaggccatgagcctgggcagccacagcccccagagcgacagcctgacccagctggtgcagcagcctgacatgatgtacttcatcctcttcctgtggctgctggtgtactgcctgctgctcttcccccagctggatgtgtcccggctgtag

SEQ ID NO: 145944 - DNA, 450 bp, Artificial Sequence
  Description of Artificial Sequence: Synthetic coding sequence
atggctgaccagctgacagaggagcagattgctgagttcaaggaggccttcagcctgtttgacaaggatggagatggcaccatcaccaccaaggagctgggcaccgtgatgaggagcctgggccagaaccccacagaagctgagctgcaggacatgatcaatgaggtggatgctgatggaaatggcaccatcgacttccctgagttcctgaccatgatggccaggaagatgaaggacacagacagcgaggaggagatccgggaggccttccgggtgtttgacaaggatggaaatggctacatctctgctgctgagctgcggcacgtgatgaccaacctgggggagaagctgacagatgaggaggtggatgagatgatccgggaggccgacattgatggagatggccaggtgaactatgaggagtttgtgcagatgatgacagccaagtag

SEQ ID NO: 145945 - DNA, 450 bp, Artificial Sequence; identical to SEQ ID NO: 145944
  Description of Artificial Sequence: Synthetic coding sequence

SEQ ID NO: 145946 - DNA, 450 bp, Artificial Sequence; identical to SEQ ID NO: 145944
  Description of Artificial Sequence: Synthetic coding sequence

SEQ ID NO: 145947 - DNA, 450 bp, Artificial Sequence; identical to SEQ ID NO: 145944
  Description of Artificial Sequence: Synthetic coding sequence

SEQ ID NO: 145948 - DNA, 5022 bp, Artificial Sequence
  Description of Artificial Sequence: Synthetic coding sequence
atgtggagggctgagggcaagtggctgcccaagaccagcaggaagtctgtgtcccagagcgtcttctgtggcaccagcacctactgtgtgctgaacacagtgccccccattgaagatgaccacggcaacagcaacagcagccacgtgaagatcttcctgcccaagaagctgctggagtgcctgcccaagtgcagcagcctgcccaaggagcggcaccgctggaacaccaatgaggagattgctgcctacctgatcacctttgagaagcatgaggagtggctgaccaccagccccaagacccggccccagaatggctccatgatcctgtacaacaggaagaaggtgaagtacaggaaggatggctactgctggaagaagaggaaggatggcaagaccacccgggaggaccacatgaagctgaaggtgcagggcgtggagtgcctgtatggctgctacgtgcacagcagcatcatccccaccttccaccggcgctgctactggctgctgcagaacccagacatcgtgctggtgcactacctgaatgtgcctgccatcgaggactgtgggaagccctgtggccccatcctgtgcagcatcaacacagacaagaaggagtgggccaagtggaccaaggaggagctgattggccagctgaagcccatgtttcatggcatcaagtggacctgcagcaatggaaacagcagcagcggcttctctgtggagcagctggtgcagcagatcctggacagccaccagaccaagccccagcccaggacccacaactgcctgtgcaccggcagcctgggcgctgggggctctgtgcaccacaagtgcaacagcgccaagcaccgcatcatcagccccaaggtggagcccaggactggaggctacggcagccacagcgaggtgcagcacaatgatgtgtctgagggcaagcatgagcacagccacagcaagggcagcagccgggagaagagaaatggcaaggtggccaagcctgtgctgctgcaccagagcagcacagaggtgagcagcaccaaccaggtggaggtgcctgacaccacccagagcagccctgtgtccatcagcagcggcctgaacagcgaccctgacatggtggacagccctgtggtgactggagtgtctggcatggctgtggcctctgtgatgggcagcctgagccagagcgccaccgtcttcatgtctgaggtgaccaatgaggccgtgtacaccatgagccccacagctggccccaaccaccacctgctgagcccagatgccagccagggcctggtgctggccgtgtccagtgatggccacaagtttgccttccccaccaccggcagcagcgagagcctgtccatgctgcccaccaacgtgtctgaggagctggtgctgagcaccaccctggatggcggcaggaagatccctgagaccaccatgaactttgatcctgactgcttcctgaacaaccccaagcagggccagacctacggcggcggcggcctgaaggccgagatggtgagcagcaacatccgccacagccccccaggagagaggagcttctccttcaccaccgtgctgaccaaggagatcaagacagaggacaccagctttgagcagcagatggccaaggaggcctacagcagcagcgctgctgctgtggccgccagcagcctgaccctgacagctggcagcagcctgctgcccagcggcggcggcctgagccccagcaccaccctggagcagatggacttcagcgccatcgacagcaacaaggactacaccagcagcttcagccagacaggccacagcccccacatccaccagacccccagccccagcttcttcctgcaggatgccagcaagcccctgcctgtggagcagaacacccacagcagcctgagtgacagcggcggcacctttgtgatgcccaccgtgaagacagaggccagcagccagaccagcagctgcagcggccacgtggagacccgcatcgagagcaccagcagcctgcacctgatgcagttccaggccaacttccaggccatgacagctgagggggaggtgaccatggagaccagccaggccgctgagggcagcgaggtgctgctgaagtctggagagctgcaggcctgcagcagcgagcactacctgcagcctgagaccaacggggtcatccgctctgctgggggcgtgcccatcctgcctggaaatgtggtgcagggcctgtaccctgtggcccagcccagcctgggcaatgccagcaacatggagctgagcctggaccactttgacatctccttcagcaaccagttcagtgacctgatcaatgacttcatctctgtggagggcggcagcagcaccatctacggccaccagctggtgtctggggacagcacagccctgagccagagtgaagatggagcccgggcccccttcacccaggccgagatgtgcctgccctgctgcagcccccagcagggcagcctgcagctgagcagcagcgagggcggggccagcaccatggcctacatgcacgtggccgaggtggtgtctgctgccagcgcccagggcaccctgggcatgctgcagcagagcggccgggtcttcatggtgacagactacagccctgagtggagctacccagagggcggcgtgaaggtgctgatcaccggcccctggcaggaggccagcaacaactacagctgcctgtttgaccagatctctgtgcctgccagcctcatccagcccggggtgctgcgctgctactgcccagcccatgacaccggcctggtgaccctgcaggtggccttcaacaaccagatcatcagcaacagcgtggtgtttgagtacaaggcccgggccctgcccaccctgcccagcagccagcacgactggctgagcctggatgacaaccagttcaggatgagcatcctggagcggctggagcagatggagaggaggatggccgagatgacaggcagccagcagcacaagcaggccagcggcggcggcagcagcggcggcggcagcggcagcggaaatggaggcagccaggcccagtgtgccagcggcactggagccctgggcagctgctttgagagccgggtggtggtggtgtgtgagaagatgatgagccgggcctgctgggccaagagcaagcacctgatccacagcaagaccttccggggcatgaccctgctgcacctggccgccgcccagggctacgccaccctcatccagaccctcatcaagtggaggaccaagcacgccgacagcattgacctggagctggaggtggaccccctgaatgtggaccacttcagctgcacccccctgatgtgggcctgtgccctgggccacctggaggccgctgtggtgctgtacaagtgggaccggcgggccatcagcatcccagacagcctgggccgcctgcccctgggcatcgcccggagccggggccacgtgaagctggctgaatgtctggagcacctgcagagagatgagcaggcccagctgggccagaacccccgcatccactgcccagccagcgaggagcccagcacagagagctggatggcccagtggcacagcgaggccatcagcagccctgagatccccaagggcgtgaccgtcatcgccagcaccaaccctgagctgcggcggcccaggtctgagcccagcaactactacagcagcgagagccacaaggactacccagcccccaagaagcacaagctgaaccctgagtacttccagacccggcaggagaagctgctgcccacagccctgagcctggaggagcccaacatcaggaagcagagccccagcagcaagcagagcgtgcctgagaccctgagccccagcgagggcgtgcgggacttcagccgggagctgagcccccccaccccagagacagctgccttccaggccagcggcagccagcctgtgggcaagtggaacagcaaggacctgtacatcggcgtgtccacagtgcaggtgacaggcaaccccaagggcacctctgtgggcaaggaggccgcccccagccaggtgcggccccgggagcccatgtctgtgctgatgatggccaaccgggaggtggtgaacacagagctgggcagctacagagacagcgcagaaaatgaagaatgtggccagcccatggatgacatccaggtgaacatgatgaccctggccgagcacatcatcgaggccaccccagaccgcatcaagcaggagaactttgtgcccatggagagcagcggcctggagaggacagatcctgccaccatcagcagcaccatgtcctggctggccagctacctggctgatgctgactgcctgcccagcgctgcccagatccgcagcgcctacaatgagcccctgacccccagcagcaacaccagcctgagccctgtgggcagccctgtgtctgagatcgcctttgagaagcccaacctgcccagcgctgctgactggagcgagttcctgagcgccagcaccagcgagaaggtggagaatgaatttgcccagctgaccctgagtgaccacgagcagcgggagctgtatgaagctgcccggctggtgcagacagccttcaggaagtacaagggccggcccctgcgggagcagcaggaggtggccgccgccgtcatccagcgctgctacaggaagtacaagcagtatgccctgtacaagaagatgacccaggccgccatcctgatccagagcaagttccgcagctactatgagcagaagaagttccagcagagccggcgggctgctgtgctgatccagaagtactaccgcagctacaagaagtgtgggaagaggcggcaggccaggagaacagctgtgattgtgcagcagaagctgcggagcagcctgctgaccaagaagcaggaccaggccgccaggaagatcatgaggttcctgcggcgctgccgccacagccccctggtggaccaccggctgtacaagagaagtgaaagaattgagaagggccagggcacctag

SEQ ID NO: 145949 - DNA, 1911 bp, Artificial Sequence
  Description of Artificial Sequence: Synthetic coding sequence
atgatgagccgggcctgctgggccaagagcaagcacctgatccacagcaagaccttccggggcatgaccctgctgcacctggccgccgcccagggctacgccaccctcatccagaccctcatcaagtggaggaccaagcacgccgacagcattgacctggagctggaggtggaccccctgaatgtggaccacttcagctgcacccccctgatgtgggcctgtgccctgggccacctggaggccgctgtggtgctgtacaagtgggaccggcgggccatcagcatcccagacagcctgggccgcctgcccctgggcatcgcccggagccggggccacgtgaagctggctgaatgtctggagcacctgcagagagatgagcaggcccagctgggccagaacccccgcatccactgcccagccagcgaggagcccagcacagagagctggatggcccagtggcacagcgaggccatcagcagccctgagatccccaagggcgtgaccgtcatcgccagcaccaaccctgagctgcggcggcccaggtctgagcccagcaactactacagcagcgagagccacaaggactacccagcccccaagaagcacaagctgaaccctgagtacttccagacccggcaggagaagctgctgcccacagccctgagcctggaggagcccaacatcaggaagcagagccccagcagcaagcagagcgtgcctgagaccctgagccccagcgagggcgtgcgggacttcagccgggagctgagcccccccaccccagagacagctgccttccaggccagcggcagccagcctgtgggcaagtggaacagcaaggacctgtacatcggcgtgtccacagtgcaggtgacaggcaaccccaagggcacctctgtgggcaaggaggccgcccccagccaggtgcggccccgggagcccatgtctgtgctgatgatggccaaccgggaggtggtgaacacagagctgggcagctacagagacagcgcagaaaatgaagaatgtggccagcccatggatgacatccaggtgaacatgatgaccctggccgagcacatcatcgaggccaccccagaccgcatcaagcaggagaactttgtgcccatggagagcagcggcctggagaggacagatcctgccaccatcagcagcaccatgtcctggctggccagctacctggctgatgctgactgcctgcccagcgctgcccagatccgcagcgcctacaatgagcccctgacccccagcagcaacaccagcctgagccctgtgggcagccctgtgtctgagatcgcctttgagaagcccaacctgcccagcgctgctgactggagcgagttcctgagcgccagcaccagcgagaaggtggagaatgaatttgcccagctgaccctgagtgaccacgagcagcgggagctgtatgaagctgcccggctggtgcagacagccttcaggaagtacaagggccggcccctgcgggagcagcaggaggtggccgccgccgtcatccagcgctgctacaggaagtacaagcagggcaagaacatctgcctgaagtatgccctgtacaagaagatgacccaggccgccatcctgatccagagcaagttccgcagctactatgagcagaagaagttccagcagagcagaagagctgctgtgctgatccagaagtactaccgcagctacaagaagtgtgggaagaggcggcaggcccggaggacagctgtgattgtgcagcagaagctgcggagcagcctgctgaccaagaagcaggaccaggccgccaggaagatcatgaggttcctgcggcgctgccgccaccgggtgaaggagctgaagaaggccaaggagctggaggacatccagcagcaccccctggccatgtag

SEQ ID NO: 145950 - DNA, 2151 bp, Artificial Sequence
  Description of Artificial Sequence: Synthetic coding sequence
atggcctgccctgtgtccccagaccacaagcaggagggcgcccatgacaccggcctggtgaccctgcaggtggccttcaacaaccagatcatcagcaacagcgtggtgtttgagtacaaggcccgggccctgcccaccctgcccagcagccagcacgactggctgagcctggatgacaaccagttcaggatgagcatcctggagcggctggagcagatggagaggaggatggccgagatgacaggcagccagcagcacaagcaggccagcggcggcggcagcagcggcggcggcagcggcagcggaaatggaggcagccaggcccagtgtgccagcggcaccggggccctgggcagctgctttgagagccgggtggtggtggtgtgtgagaagatgatgagccgggcctgctgggccaagagcaagcacctgatccacagcaagaccttccggggcatgaccctgctgcacctggccgccgcccagggctacgccaccctcatccagaccctcatcaagtggaggaccaagcatgctgacagcattgacctggagctggaggtggaccccctgaatgtggaccacttcagctgcacccccctgatgtgggcctgtgccctgggccacctggaggccgctgtggtgctgtacaagtgggacagaagagccatcagcatcccagacagcctgggccgcctgcccctgggcatcgcccggagccggggccacgtgaagctggccgagtgcctggagcacctgcagagagatgagcaggcccagctgggccagaacccccgcatccactgcccagccagcgaggagcccagcacagagagctggatggcccagtggcacagcgaggccatcagcagccctgagatccccaagggcgtgacagtgattgccagcaccaaccctgagctgcggcggcccaggtctgagcccagcaactactacagcagcgagagccacaaggactacccagcccccaagaagcacaagctgaaccctgagtacttccagacccggcaggagaagctgctgcccacagccctgagcctggaggagcccaacatcaggaagcagagccccagcagcaagcagagcgtgcctgagaccctgagccccagcgagggcgtgcgggacttcagccgggagctgagcccccccaccccagagacagctgccttccaggccagcggcagccagcctgtgggcaagtggaacagcaaggacctgtacatcggcgtgtccacagtgcaggtgactggaaaccccaagggcacctctgtgggcaaggaggccgcccccagccaggtgcggccccgggagcccatgtctgtgctgatgatggccaaccgggaggtggtgaacacagagctgggcagctacagagattctgcagaaaatgaggagtgtggccagcccatggatgacatccaggtgaacatgatgaccctggccgagcacatcatcgaggccaccctgagcagcaccatgtcctggctggccagctacctggctgatgctgactgcctgcccagcgctgcccagatccgcagcgcctacaatgagcccctgacccccagcagcaacaccagcctgagccctgtgggcagccctgtgtctgaaattgcctttgagaaggtggagaatgaatttgcccagctgaccctgagtgaccacgagcagcgggagctgtatgaggccgcccggctggtgcagacagccttcaggaagtacaagggccggcccctgcgggagcagcaggaggtggccgctgctgtgatccagcgctgctacaggaagtacaagcagtatgccctgtacaagaagatgacccaggccgccatcctgatccagagcaagttccgcagctactatgagcagaagaagttccagcagagcagaagagctgctgtgctgatccagaagtactaccgcagctacaagaagtgtgggaagaggcggcaggcccggaggacagctgtgattgtgcagcagaagctgcggagcagcctgctgaccaagaagcaggaccaggccgccaggaagatcatgaggttcctgcggcgctgccgccaccgggtgaaggagctgaagaaggccaaggagctggaggacatccagcagcaccccctggccatgtag

SEQ ID NO: 145951 - DNA, 4980 bp, Artificial Sequence
  Description of Artificial Sequence: Synthetic coding sequence
atgtggagggctgagggcaagtggctgcccaagaccagcaggaagtctgtgtcccagagcgtcttctgtggcaccagcacctactgtgtgctgaacacagtgccccccattgaagatgaccacggcaacagcaacagcagccacgtgaagatcttcctgcccaagaagctgctggagtgcctgcccaagtgcagcagcctgcccaaggagcggcaccgctggaacaccaatgaggagattgctgcctacctgatcacctttgagaagcatgaggagtggctgaccaccagccccaagacccggccccagaatggctccatgatcctgtacaacaggaagaaggtgaagtacaggaaggatggctactgctggaagaagaggaaggatggcaagaccacccgggaggaccacatgaagctgaaggtgcagggcgtggagtgcctgtatggctgctacgtgcacagcagcatcatccccaccttccaccggcgctgctactggctgctgcagaacccagacatcgtgctggtgcactacctgaatgtgcctgccatcgaggactgtgggaagccctgtggccccatcctgtgcagcatcaacacagacaagaaggagtgggccaagtggaccaaggaggagctgattggccagctgaagcccatgtttcatggcatcaagtggacctgcagcaatggaaacagcagcagcggcttctctgtggagcagctggtgcagcagatcctggacagccaccagaccaagccccagcccaggacccacaactgcctgtgcaccggcagcctgggcgctgggggctctgtgcaccacaagtgcaacagcgccaagcaccgcatcatcagccccaaggtggagcccaggactggaggctacggcagccacagcgaggtgcagcacaatgatgtgtctgagggcaagcatgagcacagccacagcaagggcagcagccgggagaagagaaatggcaaggtggccaagcctgtgctgctgcaccagagcagcacagaggtgagcagcaccaaccaggtggaggtgcctgacaccacccagagcagccctgtgtccatcagcagcggcctgaacagcgaccctgacatggtggacagccctgtggtgactggagtgtctggcatggctgtggcctctgtgatgggcagcctgagccagagcgccaccgtcttcatgtctgaggtgaccaatgaggccgtgtacaccatgagccccacagctggccccaaccaccacctgctgagcccagatgccagccagggcctggtgctggccgtgtccagtgatggccacaagtttgccttccccaccaccggcagcagcgagagcctgtccatgctgcccaccaacgtgtctgaggagctggtgctgagcaccaccctggatggcggcaggaagatccctgagaccaccatgaactttgatcctgactgcttcctgaacaaccccaagcagggccagacctacggcggcggcggcctgaaggccgagatggtgagcagcaacatccgccacagccccccaggagagaggagcttctccttcaccaccgtgctgaccaaggagatcaagacagaggacaccagctttgagcagcagatggccaaggaggcctacagcagcagcgctgctgctgtggccgccagcagcctgaccctgacagctggcagcagcctgctgcccagcggcggcggcctgagccccagcaccaccctggagcagatggacttcagcgccatcgacagcaacaaggactacaccagcagcttcagccagacaggccacagcccccacatccaccagacccccagccccagcttcttcctgcaggatgccagcaagcccctgcctgtggagcagaacacccacagcagcctgagtgacagcggcggcacctttgtgatgcccaccgtgaagacagaggccagcagccagaccagcagctgcagcggccacgtggagacccgcatcgagagcaccagcagcctgcacctgatgcagttccaggccaacttccaggccatgacagctgagggggaggtgaccatggagaccagccaggccgctgagggcagcgaggtgctgctgaagtctggagagctgcaggcctgcagcagcgagcactacctgcagcctgagaccaacggggtcatccgctctgctgggggcgtgcccatcctgcctggaaatgtggtgcagggcctgtaccctgtggcccagcccagcctgggcaatgccagcaacatggagctgagcctggaccactttgacatctccttcagcaaccagttcagtgacctgatcaatgacttcatctctgtggagggcggcagcagcaccatctacggccaccagctggtgtctggggacagcacagccctgagccagagtgaagatggagcccgggcccccttcacccaggccgagatgtgcctgccctgctgcagcccccagcagggcagcctgcagctgagcagcagcgagggcggggccagcaccatggcctacatgcacgtggccgaggtggtgtctgctgccagcgcccagggcaccctgggcatgctgcagcagagcggccgggtcttcatggtgacagactacagccctgagtggagctacccagagggcggcgtgaaggtgctgatcaccggcccctggcaggaggccagcaacaactacagctgcctgtttgaccagatctctgtgcctgccagcctcatccagcccggggtgctgcgctgctactgcccagcccatgacaccggcctggtgaccctgcaggtggccttcaacaaccagatcatcagcaacagcgtggtgtttgagtacaaggcccgggccctgcccaccctgcccagcagccagcacgactggctgagcctggatgacaaccagttcaggatgagcatcctggagcggctggagcagatggagaggaggatggccgagatgacaggcagccagcagcacaagcaggccagcggcggcggcagcagcggcggcggcagcggcagcggaaatggaggcagccaggcccagtgtgccagcggcactggagccctgggcagctgctttgagagccgggtggtggtggtgtgtgagaagatgatgagccgggcctgctgggccaagagcaagcacctgatccacagcaagaccttccggggcatgaccctgctgcacctggccgccgcccagggctacgccaccctcatccagaccctcatcaagtggaggaccaagcacgccgacagcattgacctggagctggaggtggaccccctgaatgtggaccacttcagctgcacccccctgatgtgggcctgtgccctgggccacctggaggccgctgtggtgctgtacaagtgggaccggcgggccatcagcatcccagacagcctgggccgcctgcccctgggcatcgcccggagccggggccacgtgaagctggctgaatgtctggagcacctgcagagagatgagcaggcccagctgggccagaacccccgcatccactgcccagccagcgaggagcccagcacagagagctggatggcccagtggcacagcgaggccatcagcagccctgagatccccaagggcgtgaccgtcatcgccagcaccaaccctgagctgcggcggcccaggtctgagcccagcaactactacagcagcgagagccacaaggactacccagcccccaagaagcacaagctgaaccctgagtacttccagacccggcaggagaagctgctgcccacagccctgagcctggaggagcccaacatcaggaagcagagccccagcagcaagcagagcgtgcctgagaccctgagccccagcgagggcgtgcgggacttcagccgggagctgagcccccccaccccagagacagctgccttccaggccagcggcagccagcctgtgggcaagtggaacagcaaggacctgtacatcggcgtgtccacagtgcaggtgacaggcaaccccaagggcacctctgtgggcaaggaggccgcccccagccaggtgcggccccgggagcccatgtctgtgctgatgatggccaaccgggaggtggtgaacacagagctgggcagctacagagacagcgcagaaaatgaagaatgtggccagcccatggatgacatccaggtgaacatgatgaccctggccgagcacatcatcgaggccaccccagaccgcatcaagcaggagaactttgtgcccatggagagcagcggcctggagaggacagatcctgccaccatcagcagcaccatgtcctggctggccagctacctggctgatgctgactgcctgcccagcgctgcccagatccggctgagccctgtgggcagccctgtgtctgagatcgcctttgagaagcccaacctgcccagcgctgctgactggagcgagttcctgagcgccagcaccagcgagaaggtggagaatgaatttgcccagctgaccctgagtgaccacgagcagcgggagctgtatgaagctgcccggctggtgcagacagccttcaggaagtacaagggccggcccctgcgggagcagcaggaggtggccgccgccgtcatccagcgctgctacaggaagtacaagcagtatgccctgtacaagaagatgacccaggccgccatcctgatccagagcaagttccgcagctactatgagcagaagaagttccagcagagccggcgggctgctgtgctgatccagaagtactaccgcagctacaagaagtgtgggaagaggcggcaggccaggagaacagctgtgattgtgcagcagaagctgcggagcagcctgctgaccaagaagcaggaccaggccgccaggaagatcatgaggttcctgcggcgctgccgccaccgggtgaaggagctgaagaaggccaaggagctggaggacatccagcagcaccccctggccatgtag

SEQ ID NO: 145952 - DNA, 243 bp, Artificial Sequence
  Description of Artificial Sequence: Synthetic coding sequence
atgtggagggctgagggcaagtggctgcccaagaccagcaggaagtctgtgtcccagagcgtcttctgtggcaccagcacctactgtgtgctgaacacagtgccccccattgaagatgaccacggcaacagcaacagcagccacgtgaagatcttcctgcccaagaagctgctggagtgcctgcccaagtgcagcagcctgcccaaggagcggcaccgctggaacaccaatgaaagaagctag

SEQ ID NO: 145953 - DNA, 306 bp, Artificial Sequence
  Description of Artificial Sequence: Synthetic coding sequence
atgtggagggctgagggcaagtggctgcccaagaccagcaggaagtctgtgtcccagagcgtcttctgtggcaccagcacctactgtgtgctgaacacagtgccccccattgaagatgaccacggcaacagcaacagcagccacgtgaagatcttcctgcccaagaagctgctggagtgcctgcccaagtgcagcagcctgcccaaggagcggcaccgctggaacaccaatgaggccctgaccacccacctgttcatgggcgccgccaagaagagggacccccagagctggagccatgagggctag

SEQ ID NO: 145954 - DNA, 3609 bp, Artificial Sequence
  Description of Artificial Sequence: Synthetic coding sequence
atgaacaccaaggacaccacagaggtggccgagaacagccaccacctgaagatcttcctgcccaagaagctgctggagtgcctgccccgctgccccctgctgcccccagagcggctgcgctggaacaccaatgaggagatcgccagctacctgatcacctttgagaagcatgatgagtggctgagctgtgcccccaagacccggccccagaatggcagcatcatcctgtacaacaggaagaaggtgaagtacaggaaggatggctacctgtggaagaagaggaaggatggcaagaccacccgggaggaccacatgaagctgaaggtgcagggcatggagtgcctgtatggctgctacgtgcacagcagcatcgtgcccaccttccaccggcgctgctactggctgctgcagaacccagacatcgtgctggtgcactacctgaatgtgcctgccctggaggactgtgggaagggctgcagccccatcttctgcagcatcagcagtgaccggcgggagtggctgaagtggagccgggaggagctgctgggccagctgaagcccatgttccacggcatcaagtggagctgtggaaatggaacagaggagttctctgtggagcacctggtgcagcagatcctggacacccaccccaccaagccagcccccaggacccacgcctgcctgtgcagcggcggcctgggcagcggcagcctgacccacaagtgcagcagcaccaagcaccgcatcatcagccccaaggtggagccccgggccctgaccctgaccagcatcccccacgcccaccccccagagcccccacccctcatcgcccccctgcccccagagctgcccaaggcccacaccagccccagcagcagcagcagcagcagcagcagcggctttgctgagcccctggagatccggcccagcccccccaccagccggggcggcagcagcagaggaggaacagccatcctgctgctgaccggcctggagcagagagctgggggcctgacccccaccaggcacctggccccccaggccgacccccggcccagcatgagcctggccgtggtggtgggcacagagcccagcgcccccccagccccacccagccctgcctttgatcctgaccgcttcctgaacagcccccagaggggccagacctacggcggcggccagggcgtgtccccagacttccctgaggccgaggccgcccacaccccctgcagcgccctggagcctgctgctgccctggagccccaggccgccgcccggggccccccaccccagagcgtggccggcggcagaagaggcaactgcttcttcatccaggatgatgattctggagaggagctgaagggccacggggccgccccacccatccccagccccccacccagccccccacccagccctgcccccctggagcccagcagccgggtgggccgcggggaggccctgtttggaggccctgtgggcgccagcgagctggagcccttcagcctgagcagcttcccagacctgatgggagagctgatcagtgatgaggcccccagcatcccagcccccaccccccagctgagccctgccctgagcaccatcacagacttcagccctgagtggagctacccagagggcggcgtgaaggtgctgatcaccggcccctggacagaggccgctgagcactacagctgtgtgtttgaccacatcgctgtgcctgccagcctggtgcagcccggggtgctgcgctgctactgcccagcccacgaggtgggcctggtgtccctgcaggtggccggccgggagggccccctgagcgcctctgtgctgtttgagtaccgggcccggcgcttcctgagcctgcccagcacccagctggactggctgagcctggatgacaaccagttcaggatgagcatcctggagcggctggagcagatggagaagaggatggccgagattgctgctgctggccaggtgccctgccagggcccagatgcccctcctgtgcaggatgagggccagggccctggctttgaggcccgggtggtggtgctggtggagagcatgatccccaggagcacctggaagggccctgagcggctggcccacggcagccccttccggggcatgagcctgctgcacctggccgccgcccagggctacgcccggctgattgagaccctgagccagtggaggtctgtggagaccggcagcctggacctggagcaggaggtggaccccctgaatgtggaccacttcagctgcacccccctgatgtgggcctgtgccctgggccacctggaggccgctgtgctgctcttccgctggaaccggcaggccctgagcatcccagacagcctgggccgcctgcccctgtctgtggcccacagccggggccacgtgcggctggcccgctgcctggaggagctgcagaggcaggagcccagcgtggagcccccatttgccctgagcccccccagcagcagcccagacaccggcctgagctctgtgagcagccccagcgagctgagtgatggcaccttctctgtgaccagcgcctacagcagcgccccagatggcagccccccaccagcccccctgcctgccagcgagatgaccatggaggacatggcccctggccagctgagcagcggcgtgcctgaggcccccctgctgctgatggactatgaggccaccaacagcaagggccccctgagcagcctgcctgccctgcccccagccagtgatgatggagctgccccagaagatgctgacagcccccaggccgtggatgtgattcctgtggacatgatcagcctggccaagcagatcatcgaggccaccccagagcgcatcaagagagaagattttgtgggcctgcctgaggccggggcctccatgagggagaggactggagctgtgggcctgtctgagaccatgtcctggctggccagctacctggagaatgtggaccacttccccagcagcaccccacccagcgagctgccctttgagcggggccgcctggccgtgcccagcgcccccagctgggccgagttcctgagcgccagcaccagcggcaagatggagagtgactttgccctgctgaccctgagtgaccacgagcagcgggagctgtatgaagctgcccgggtcatccagacagccttcaggaagtacaagggccgccgcctgaaggagcagcaggaggtggccgccgccgtcatccagcgctgctacaggaagtacaagcagctgacctggatcgccctgaagtttgccctgtacaagaagatgacccaggccgccatcctgatccagagcaagttccgcagctactatgagcagaagcgcttccagcagagcagaagagctgctgtgctgatccagcagcactaccgcagctacagaagaagacctggccccccccacaggaccagcgccaccctgcctgccagaaataaaggcagcttcctgaccaagaagcaggaccaggccgccaggaagatcatgaggttcctgcggcgctgccgccacaggatgagggagctgaagcagaaccaggagctggagggcctgccccagcccggcctggccacctag

SEQ ID NO: 145955 - DNA, 3588 bp, Artificial Sequence
  Description of Artificial Sequence: Synthetic coding sequence
atgaacaccaaggacaccacagaggtggccgagaacagccaccacctgaagatcttcctgcccaagaagctgctggagtgcctgccccgctgccccctgctgcccccagagcggctgcgctggaacaccaatgaggagatcgccagctacctgatcacctttgagaagcatgatgagtggctgagctgtgcccccaagacccggccccagaatggcagcatcatcctgtacaacaggaagaaggtgaagtacaggaaggatggctacctgtggaagaagaggaaggatggcaagaccacccgggaggaccacatgaagctgaaggtgcagggcatggagtgcctgtatggctgctacgtgcacagcagcatcgtgcccaccttccaccggcgctgctactggctgctgcagaacccagacatcgtgctggtgcactacctgaatgtgcctgccctggaggactgtgggaagggctgcagccccatcttctgcagcatcagcagtgaccggcgggagtggctgaagtggagccgggaggagctgctgggccagctgaagcccatgttccacggcatcaagtggagctgtggaaatggaacagaggagttctctgtggagcacctggtgcagcagatcctggacacccaccccaccaagccagcccccaggacccacgcctgcctgtgcagcggcggcctgggcagcggcagcctgacccacaagtgcagcagcaccaagcaccgcatcatcagccccaaggtggagccccgggccctgaccctgaccagcatcccccacgcccaccccccagagcccccacccctcatcgcccccctgcccccagagctgcccaaggcccacaccagccccagcagcagcagcagcagcagcagcagcggctttgctgagcccctggagatccggcccagcccccccaccagccggggcggcagcagcagaggaggaacagccatcctgctgctgaccggcctggagcagagagctgggggcctgacccccaccaggcacctggccccccaggccgacccccggcccagcatgagcctggccgtggtggtgggcacagagcccagcgcccccccagccccacccagccctgcctttgatcctgaccgcttcctgaacagcccccagaggggccagacctacggcggcggccagggcgtgtccccagacttccctgaggccgaggccgcccacaccccctgcagcgccctggagcctgctgctgccctggagccccaggccgccgcccggggccccccaccccagagcgtggccggcggcagaagaggcaactgcttcttcatccaggatgatgattctggagaggagctgaagggccacggggccgccccacccatccccagccccccacccagccccccacccagccctgcccccctggagcccagcagccgggtgggccgcggggaggccctgtttggaggccctgtgggcgccagcgagctggagcccttcagcctgagcagcttcccagacctgatgggagagctgatcagtgatgaggcccccagcatcccagcccccaccccccagctgagccctgccctgagcaccatcacagacttcagccctgagtggagctacccagagggcggcgtgaaggtgctgatcaccggcccctggacagaggccgctgagcactacagctgtgtgtttgaccacatcgctgtgcctgccagcctggtgcagcccggggtgctgcgctgctactgcccagcccacgaggtgggcctggtgtccctgcaggtggccggccgggagggccccctgagcgcctctgtgctgtttgagtaccgggcccggcgcttcctgagcctgcccagcacccagctggactggctgagcctggatgacaaccagttcaggatgagcatcctggagcggctggagcagatggagaagaggatggccgagattgctgctgctggccaggtgccctgccagggcccagatgcccctcctgtgcaggatgagggccagggccctggctttgaggcccgggtggtggtgctggtggagagcatgatccccaggagcacctggaagggccctgagcggctggcccacggcagccccttccggggcatgagcctgctgcacctggccgccgcccagggctacgcccggctgattgagaccctgagccagtggaggtctgtggagaccggcagcctggacctggagcaggaggtggaccccctgaatgtggaccacttcagctgcacccccctgatgtgggcctgtgccctgggccacctggaggccgctgtgctgctcttccgctggaaccggcaggccctgagcatcccagacagcctgggccgcctgcccctgtctgtggcccacagccggggccacgtgcggctggcccgctgcctggaggagctgcagaggcaggagcccagcgtggagcccccatttgccctgagcccccccagcagcagcccagacaccggcctgagctctgtgagcagccccagcgagctgagtgatggcaccttctctgtgaccagcgcctacagcagcgccccagatggcagccccccaccagcccccctgcctgccagcgagatgaccatggaggacatggcccctggccagctgagcagcggcgtgcctgaggcccccctgctgctgatggactatgaggccaccaacagcaagggccccctgagcagcctgcctgccctgcccccagccagtgatgatggagctgccccagaagatgctgacagcccccaggccgtggatgtgattcctgtggacatgatcagcctggccaagcagatcatcgaggccaccccagagcgcatcaagagagaagattttgtgggcctgcctgaggccggggcctccatgagggagaggactggagctgtgggcctgtctgagaccatgtcctggctggccagctacctggagaatgtggaccacttccccagcagcaccccacccagcgagctgccctttgagcggggccgcctggccgtgcccagcgcccccagctgggccgagttcctgagcgccagcaccagcggcaagatggagagtgactttgccctgctgaccctgagtgaccacgagcagcgggagctgtatgaagctgcccgggtcatccagacagccttcaggaagtacaagggccgccgcctgaaggagcagcaggaggtggccgccgccgtcatccagcgctgctacaggaagtacaagcagtttgccctgtacaagaagatgacccaggccgccatcctgatccagagcaagttccgcagctactatgagcagaagcgcttccagcagagccggcgggctgctgtgctgatccagcagcactaccgcagctacagaagaagacctggccccccccacaggaccagcgccaccctgcctgccaggaacaagggcagcttcctgaccaagaagcaggaccaggccgccaggaagatcatgaggttcctgcggcgctgccgccacaggatgagggagctgaagcagaaccaggagctggagggcctgccccagcccggcctggccacctag

SEQ ID NO: 145956 - DNA, 3606 bp, Artificial Sequence
  Description of Artificial Sequence: Synthetic coding sequence
atgggcacagacagccccagcccccggcccctgcggcctggggtgaccctgcccccaggggccctgaccatgaacaccaaggacaccacagaggtggccgagaacagccaccacctgaagatcttcctgcccaagaagctgctggagtgcctgccccgctgccccctgctgcccccagagcggctgcgctggaacaccaatgaggagatcgccagctacctgatcacctttgagaagcatgatgagtggctgagctgtgcccccaagacccggccccagaatggcagcatcatcctgtacaacaggaagaaggtgaagtacaggaaggatggctacctgtggaagaagaggaaggatggcaagaccacccgggaggaccacatgaagctgaaggtgcagggcatggagaacccagacatcgtgctggtgcactacctgaatgtgcctgccctggaggactgtgggaagggctgcagccccatcttctgcagcatcagcagtgacagaagagagtggctgaagtggagccgggaggagctgctgggccagctgaagcccatgtttcatggcatcaagtggagctgtggaaatggaacagaggagttctctgtggagcacctggtgcagcagatcctggacacccaccccaccaagccagcccccaggacccacgcctgcctgtgcagcggcggcctgggcagcggcagcctgacccacaagtgcagcagcaccaagcaccgcatcatcagccccaaggtggagccccgggccctgaccctgaccagcatcccccacgcccaccccccagagcccccacccctgattgcccccctgcccccagagctgcccaaggcccacaccagccccagcagcagcagcagcagcagcagcagcggctttgctgagcccctggagatccggcccagcccccccaccagcagaggaggcagcagccggggcggcacagccatcctgctgctgaccggcctggagcagagagctgggggcctgacccccaccaggcacctggccccccaggccgacccccggcccagcatgagcctggccgtggtggtgggcacagagcccagcgcccccccagccccacccagccctgcctttgatcctgaccgcttcctgaacagcccccagaggggccagacctatggaggcggccagggcgtgtccccagacttccctgaggccgaggccgcccacaccccctgcagcgccctggagcctgctgctgccctggagccccaggccgccgcccggggccccccaccccagagcgtggccggcggccggcggggcaactgcttcttcatccaggatgatgacagcggggaggagctgaagggccatggagctgccccacccatccccagccccccacccagccccccacccagccctgcccccctggagcccagcagccgggtgggccgcggggaggccctgtttggaggccctgtgggcgccagcgagctggagcccttcagcctgagcagcttcccagacctgatgggagagctgatcagtgatgaggcccccagcatcccagcccccaccccccagctgagccctgccctgagcaccatcacagacttcagccctgagtggagctacccagagggcggcgtgaaggtgctgatcaccggcccctggacagaagctgctgagcactacagctgtgtgtttgaccacatcgctgtgcctgccagcctggtgcagcccggggtgctgcgctgctactgcccagcccacgaggtgggcctggtgtccctgcaggtggccggccgggagggccccctgagcgcctctgtgctgtttgagtaccgggcccggcgcttcctgagcctgcccagcacccagctggactggctgagcctggatgacaaccagttcaggatgagcatcctggagcggctggagcagatggagaagaggatggccgagattgctgctgctggccaggtgccctgccagggcccagatgcccctcctgtgcaggatgagggccagggccctggctttgaggcccgggtggtggtgctggtggagagcatgatccccaggagcacctggaagggccctgagcggctggcccacggcagccccttccggggcatgagcctgctgcacctggccgccgcccagggctacgcccggctcatcgagaccctgagccagtggaggtctgtggagaccggcagcctggacctggagcaggaggtggaccccctgaatgtggaccacttcagctgcacccccctgatgtgggcctgtgccctgggccacctggaggccgctgtgctgctcttccgctggaaccggcaggccctgagcatcccagacagcctgggccgcctgcccctgtctgtggcccacagccggggccacgtgcggctggcccgctgcctggaggagctgcagaggcaggagcccagcgtggagcccccatttgccctgagcccccccagcagcagcccagacaccggcctgagctctgtgagcagccccagcgagctgagtgatggcaccttctctgtgaccagcgcctacagcagcgccccagatggcagccccccaccagcccccctgcctgccagcgagatgaccatggaggacatggcccctggccagctgagcagtggagtgcctgaggcccccctgctgctgatggactatgaggccaccaacagcaagggccccctgagcagcctgcctgccctgcccccagccagtgatgatggagctgccccagaagatgctgacagcccccaggccgtggatgtgattcctgtggacatgatcagcctggccaagcagatcatcgaggccaccccagagcgcatcaagcgggaggactttgtgggcctgcctgaggccggggcctccatgagggagaggactggagctgtgggcctgtctgagaccatgtcctggctggccagctacctggagaatgtggaccacttccccagcagcaccccaccttctgagctgccctttgagcggggccgcctggccgtgcccagcgcccccagctgggccgagttcctgagcgccagcaccagcggcaagatggagagtgactttgccctgctgaccctgagtgaccacgagcagcgggagctgtatgaggccgcccgggtcatccagacagccttcaggaagtacaagggccggcggctgaaggagcagcaggaggtggccgctgctgtgatccagcgctgctacaggaagtacaagcagctgacctggatcgccctgaagtttgccctgtacaagaagatgacccaggccgccatcctgatccagagcaagttccgcagctactatgagcagaagcgcttccagcagagccggcgggctgctgtgctgatccagcagcactaccgcagctacagaagaagacctggccccccccacaggaccagcgccaccctgcctgccaggaacaagggcagcttcctgaccaagaagcaggaccaggccgccaggaagatcatgaggttcctgcggcgctgccgccacaggatgagggagctgaagcagaaccaggagctggagggcctgccccagcccggcctggccacctag

SEQ ID NO: 145957 - DNA, 3594 bp, Artificial Sequence
  Description of Artificial Sequence: Synthetic coding sequence
atggctgctgctgctgtgacccggggcaccccaggagagaacagccaccacctgaagatcttcctgcccaagaagctgctggagtgcctgccccgctgccccctgctgcccccagagcggctgcgctggaacaccaatgaggagatcgccagctacctgatcacctttgagaagcatgatgagtggctgagctgtgcccccaagacccggccccagaatggcagcatcatcctgtacaacaggaagaaggtgaagtacaggaaggatggctacctgtggaagaagaggaaggatggcaagaccacccgggaggaccacatgaagctgaaggtgcagggcatggagtgcctgtatggctgctacgtgcacagcagcatcgtgcccaccttccaccggcgctgctactggctgctgcagaacccagacatcgtgctggtgcactacctgaatgtgcctgccctggaggactgtgggaagggctgcagccccatcttctgcagcatcagcagtgaccggcgggagtggctgaagtggagccgggaggagctgctgggccagctgaagcccatgttccacggcatcaagtggagctgtggaaatggaacagaggagttctctgtggagcacctggtgcagcagatcctggacacccaccccaccaagccagcccccaggacccacgcctgcctgtgcagcggcggcctgggcagcggcagcctgacccacaagtgcagcagcaccaagcaccgcatcatcagccccaaggtggagccccgggccctgaccctgaccagcatcccccacgcccaccccccagagcccccacccctcatcgcccccctgcccccagagctgcccaaggcccacaccagccccagcagcagcagcagcagcagcagcagcggctttgctgagcccctggagatccggcccagcccccccaccagccggggcggcagcagcagaggaggaacagccatcctgctgctgaccggcctggagcagagagctgggggcctgacccccaccaggcacctggccccccaggccgacccccggcccagcatgagcctggccgtggtggtgggcacagagcccagcgcccccccagccccacccagccctgcctttgatcctgaccgcttcctgaacagcccccagaggggccagacctacggcggcggccagggcgtgtccccagacttccctgaggccgaggccgcccacaccccctgcagcgccctggagcctgctgctgccctggagccccaggccgccgcccggggccccccaccccagagcgtggccggcggcagaagaggcaactgcttcttcatccaggatgatgattctggagaggagctgaagggccacggggccgccccacccatccccagccccccacccagccccccacccagccctgcccccctggagcccagcagccgggtgggccgcggggaggccctgtttggaggccctgtgggcgccagcgagctggagcccttcagcctgagcagcttcccagacctgatgggagagctgatcagtgatgaggcccccagcatcccagcccccaccccccagctgagccctgccctgagcaccatcacagacttcagccctgagtggagctacccagagggcggcgtgaaggtgctgatcaccggcccctggacagaggccgctgagcactacagctgtgtgtttgaccacatcgctgtgcctgccagcctggtgcagcccggggtgctgcgctgctactgcccagcccacgaggtgggcctggtgtccctgcaggtggccggccgggagggccccctgagcgcctctgtgctgtttgagtaccgggcccggcgcttcctgagcctgcccagcacccagctggactggctgagcctggatgacaaccagttcaggatgagcatcctggagcggctggagcagatggagaagaggatggccgagattgctgctgctggccaggtgccctgccagggcccagatgcccctcctgtgcaggatgagggccagggccctggctttgaggcccgggtggtggtgctggtggagagcatgatccccaggagcacctggaagggccctgagcggctggcccacggcagccccttccggggcatgagcctgctgcacctggccgccgcccagggctacgcccggctgattgagaccctgagccagtggaggtctgtggagaccggcagcctggacctggagcaggaggtggaccccctgaatgtggaccacttcagctgcacccccctgatgtgggcctgtgccctgggccacctggaggccgctgtgctgctcttccgctggaaccggcaggccctgagcatcccagacagcctgggccgcctgcccctgtctgtggcccacagccggggccacgtgcggctggcccgctgcctggaggagctgcagaggcaggagcccagcgtggagcccccatttgccctgagcccccccagcagcagcccagacaccggcctgagctctgtgagcagccccagcgagctgagtgatggcaccttctctgtgaccagcgcctacagcagcgccccagatggcagccccccaccagcccccctgcctgccagcgagatgaccatggaggacatggcccctggccagctgagcagcggcgtgcctgaggcccccctgctgctgatggactatgaggccaccaacagcaagggccccctgagcagcctgcctgccctgcccccagccagtgatgatggagctgccccagaagatgctgacagcccccaggccgtggatgtgattcctgtggacatgatcagcctggccaagcagatcatcgaggccaccccagagcgcatcaagagagaagattttgtgggcctgcctgaggccggggcctccatgagggagaggactggagctgtgggcctgtctgagaccatgtcctggctggccagctacctggagaatgtggaccacttccccagcagcaccccacccagcgagctgccctttgagcggggccgcctggccgtgcccagcgcccccagctgggccgagttcctgagcgccagcaccagcggcaagatggagagtgactttgccctgctgaccctgagtgaccacgagcagcgggagctgtatgaagctgcccgggtcatccagacagccttcaggaagtacaagggccgccgcctgaaggagcagcaggaggtggccgccgccgtcatccagcgctgctacaggaagtacaagcagtttgccctgtacaagaagatgacccaggccgccatcctgatccagagcaagttccgcagctactatgagcagaagcgcttccagcagagccggcgggctgctgtgctgatccagcagcactaccgcagctacagaagaagacctggccccccccacaggaccagcgccaccctgcctgccaggaacaagggcagcttcctgaccaagaagcaggaccaggccgccaggaagatcatgaggttcctgcggcgctgccgccacaggatgagggagctgaagcagaaccaggagctggagggcctgccccagcccggcctggccacctag

SEQ ID NO: 145958 - DNA, 3726 bp, Artificial Sequence
  Description of Artificial Sequence: Synthetic coding sequence
atgggcacagacagccccagcccccggcccctgcggcctggggtgaccctgcccccaggggccctgaccatgaacaccaaggacaccacagaggtggccgagaacagccaccacctgaagatcttcctgcccaagaagctgctggagtgcctgccccgctgccccctgctgcccccagagcggctgcgctggaacaccaatgaggagatcgccagctacctgatcacctttgagaagcatgatgagtggctgagctgtgcccccaagacccggccccagaatggcagcatcatcctgtacaacaggaagaaggtgaagtacaggaaggatggctacctgtggaagaagaggaaggatggcaagaccacccgggaggaccacatgaagctgaaggtgcagggcatggagtgcctgtatggctgctacgtgcacagcagcatcgtgcccaccttccaccggcgctgctactggctgctgcagaacccagacatcgtgctggtgcactacctgaatgtgcctgccctggaggactgtgggaagggctgcagccccatcttctgcagcatcagcagtgacagaagagagtggctgaagtggagccgggaggagctgctgggccagctgaagcccatgtttcatggcatcaagtggagctgtggaaatggaacagaggagttctctgtggagcacctggtgcagcagatcctggacacccaccccaccaagccagcccccaggacccacgcctgcctgtgcagcggcggcctgggcagcggcagcctgacccacaagtgcagcagcaccaagcaccgcatcatcagccccaaggtggagccccgggccctgaccctgaccagcatcccccacgcccaccccccagagcccccacccctgattgcccccctgcccccagagctgcccaaggcccacaccagccccagcagcagcagcagcagcagcagcagcggctttgctgagcccctggagatccggcccagcccccccaccagcagaggaggcagcagccggggcggcacagccatcctgctgctgaccggcctggagcagagagctgggggcctgacccccaccaggcacctggccccccaggccgacccccggcccagcatgagcctggccgtggtggtgggcacagagcccagcgcccccccagccccacccagccctgcctttgatcctgaccgcttcctgaacagcccccagaggggccagacctatggaggcggccagggcgtgtccccagacttccctgaggccgaggccgcccacaccccctgcagcgccctggagcctgctgctgccctggagccccaggccgccgcccggggccccccaccccagagcgtggccggcggccggcggggcaactgcttcttcatccaggatgatgacagcggggaggagctgaagggccatggagctgccccacccatccccagccccccacccagccccccacccagccctgcccccctggagcccagcagccgggtgggccgcggggaggccctgtttggaggccctgtgggcgccagcgagctggagcccttcagcctgagcagcttcccagacctgatgggagagctgatcagtgatgaggcccccagcatcccagcccccaccccccagctgagccctgccctgagcaccatcacagacttcagccctgagtggagctacccagagggcggcgtgaaggtgctgatcaccggcccctggacagaagctgctgagcactacagctgtgtgtttgaccacatcgctgtgcctgccagcctggtgcagcccggggtgctgcgctgctactgcccagcccacgaggtgggcctggtgtccctgcaggtggccggccgggagggccccctgagcgcctctgtgctgtttgagtaccgggcccggcgcttcctgagcctgcccagcacccagctggactggctgagcctggatgacaaccagttcaggatgagcatcctggagcggctggagcagatggagaagaggatggccgagattgctgctgctggccaggtgccctgccagggcccagatgcccctcctgtgcaggatgagggccagggccctggctttgaggcccgggtggtggtgctggtggagagcatgatccccaggagcacctggaagggccctgagcggctggcccacggcagccccttccggggcatgagcctgctgcacctggccgccgcccagggctacgcccggctcatcgagaccctgagccagtggaggtctgtggagaccggcagcctggacctggagcaggaggtggaccccctgaatgtggaccacttcagctgcacccccctgatgtgggcctgtgccctgggccacctggaggccgctgtgctgctcttccgctggaaccggcaggccctgagcatcccagacagcctgggccgcctgcccctgtctgtggcccacagccggggccacgtgcggctggcccgctgcctggaggagctgcagaggcaggagcccagcgtggagcccccatttgccctgagcccccccagcagcagcccagacaccggcctgagctctgtgagcagccccagcgagctgagtgatggcaccttctctgtgaccagcgcctacagcagcgccccagatggcagccccccaccagcccccctgcctgccagcgagatgaccatggaggacatggcccctggccagctgagcagtggagtgcctgaggcccccctgctgctgatggactatgaggccaccaacagcaagggccccctgagcagcctgcctgccctgcccccagccagtgatgatggagctgccccagaagatgctgacagcccccaggccgtggatgtgattcctgtggacatgatcagcctggccaagcagatcatcgaggccaccccagagcgcatcaagcgggaggactttgtgggcctgcctgaggccggggcctccatgagggagaggactggagctgtgggcctgtctgagaccatgtcctggctggccagctacctggagaatgtggaccacttccccagcagcaccccaccttctgagctgccctttgagcggggccgcctggccgtgcccagcgcccccagctgggccgagttcctgagcgccagcaccagcggcaagatggagagtgactttgccctgctgaccctgagtgaccacgagcagcgggagctgtatgaggccgcccgggtcatccagacagccttcaggaagtacaagggccggcggctgaaggagcagcaggaggtggccgctgctgtgatccagcgctgctacaggaagtacaagcagctgacctggatcgccctgaagtttgccctgtacaagaagatgacccaggccgccatcctgatccagagcaagttccgcagctactatgagcagaagcgcttccagcagagccggcgggctgctgtgctgatccagcagcactaccgcagctacagaagaagacctggccccccccacaggaccagcgccaccctgcctgccaggaacaagctgctgagccaccaggaggccggccctggcagcccagaagatcatgagatcccagctgccctgcccacccaggatgagggcacagaggccgagcccggggccggccgggccagccctgctggcaccggccacatgacctggcccccacccttcagccccccctggggccgcctggtgcagagctag

SEQ ID NO: 145959 - DNA, 4470 bp, Artificial Sequence
  Description of Artificial Sequence: Synthetic coding sequence
atgggagatgctgctgacccccgggagatgaggaagaccttcatcgtgcctgccatcaagccctttgaccactatgacttcagccgggccaagatcgcctgcaacctggcctggctggtggccaaggccttcggcacagaaaatgtgcctgaggagctgcaggagcccttctacacagaccagtatgaccaggagcacatcaagccccctgtggtgaacctgctgctgtctgctgagctgtactgccgggccggcagcctcatcctgaagagtgatgctgccaagcccctgctgggccatgatgctgtgatccaggccctggcccagaagggcctgtatgtgacagaccaggagaagctggtgacagagcgggacctgcacaagaagcccatccagatgtctgcccacctggccatgattgacaccctgatgatggcctacacagtggagatggtgtccattgagaaggtgattgcctgtgcccagcagtacagcgccttcttccaggccacagacctgccctatgacattgaagatgctgtgatgtactggatcaacaaggtgaatgagcacctgaaggacatcatggagcaggagcagaagctgaaggagcaccacacagtggaggcccctgggggccagaagagccccagcaagtggttctggaagctggtgcctgcccgctacaggaaggagcagaccctgctgaagcagctgccctgcatccccctggtggagaacctgctgaaggatggaacagatggctgtgccctggccgccctgatccacttctactgcccagatgtggtgcggctggaggacatctgcctgaaggagaccatgagcctggccgacagcctgtacaacctgcagctgatccaggagttctgccaggagtacctgaaccagtgctgccacttcaccctggaggacatgctgtatgctgccagcagcatcaagagcaactacctggtgttcatggccgagctgttctggtggtttgaggtggtgaagcccagctttgtgcagccccgggtggtgcggccccagggcgctgagcctgtgaaggacatgcccagcatccctgtgctgaatgctgccaagagaaatgtgctggacagcagcagtgacttccccagcagtggagagggcgccaccttcacccagagccaccaccacctgcccagccgctacagccggccccaggcccacagcagcgccagcggcggcatccgccgcagcagctccatgtcctatgtggatggcttcatcggcacctggcccaaggagaagaggagctctgtgcacggcgtgtcctttgacatcagctttgacaaggaggacagcgtgcagaggagcacccccaacagaggcatcaccaggagcatcagcaatgaaggcctgaccctgaacaacagccacgtgtccaagcacatcaggaagaacctgtccttcaagcccatcaatggagaggaggaggccgagagcattgaggaggagctgaacatcgacagccacagcgacctgaagagctgtgtgcccctgaacaccaatgagctgaacagcaatgaaaacatccactacaagctgcccaacggggccctgcagaaccgcatcctgctggatgaatttggaaaccagatcgagacccccagcattgaggaggccctgcagatcatccatgacacagagaagagcccccacaccccccagcctgaccagatcgccaacggcttcttcctgcacagccaggagatgagcatcctgaacagcaacatcaagctgaaccagagcagcccagacaacgtgacagacaccaagggggccctgagccccatcacagacaacacagaggtggacaccggcatccacgtgcccagcgaggacatccctgagaccatggatgaggacagcagcctgcgggactacacagtgtccctggacagcgacatggatgatgccagcaagttcctgcaggactatgacatcagaactggaaacacccgggaggccctgagcccctgccccagcacagtgtccaccaagagccagcccggcagcagcgccagcagcagcagtggagtgaagatgaccagctttgctgagcagaagttcaggaagctgaaccacacagatggcaagagcagcggcagcagcagccagaagaccaccccagagggcagcgagctgaacatcccccacgtggtggcctgggcccagatccctgaggagaccggcctgccccagggccgggacaccacccagctgctggccagcgagatggtgcacctgaggatgaagctggaggagaagaggcgggccatcgaggcccagaagaagaagatggaggccgccttcaccaagcagaggcagaagatgggccgcacagccttcctgactgtggtgaagaagaagggagatggcatcagccccctgcgggaggaggccgccggggctgaagatgagaaggtgtacacagaccgggccaaggagaaggagagccagaagacagatggccagaggagcaagagcctggccgacatcaaggagagcatggagaacccccaggccaagtggctgaagagccccaccacccccattgatcctgagaagcagtggaacctggccagccccagcgaggagaccctgaatgaaggagagatcctggagtacaccaagagcattgagaagctgaacagcagcctgcacttcctgcagcaggagatgcagaggctgagcctgcagcaggagatgctgatgcagatgagggagcagcagagctgggtgatcagccccccccagcccagcccccagaagcagatccgggacttcaagcccagcaagcaggccggcctgagcagcgccatcgcccccttcagcagtgacagcccccggcccacccaccccagcccccagagcagcaacaggaagagcgccagcttctctgtgaagagccagaggaccccccggcccaatgagctgaagatcacccccctgaacagaaccctgaccccacccaggtctgtggacagcctgccccggctgcggcgcttcagccccagccaggtgcccatccagaccaggagctttgtgtgctttggagatgatggagagccccagctgaaggagagcaagcccaaggaggaggtgaagaaggaggagctggagagcaagggcaccctggagcagaggggccacaaccctgaggagaaggagatcaagccctttgagagcacagtgtctgaggtgctgagcctgcctgtgacagaaacagtgtgcctgaccccaaatgaagaccagctgaaccagcccacagagcccccacccaagcctgtgttccccccaacagcccccaagaatgtgaacctgattgaggtgtccctgagtgacctgaagcccccagagaaggcagatgtgcctgtggagaagtatgatggagagagtgacaaggagcagtttgatgatgaccagaaggtgtgctgcggcttcttcttcaaggatgaccagaaggccgagaatgacatggccatgaagagagctgccctgctggagaagaggctgcggcgggagaaggagacccagctgaggaagcagcagctggaggccgagatggagcacaagaaggaggagaccaggaggaagacagaggaggagcggcagaagaaggaggatgagcgggcccggcgggagttcatccggcaggagtacatgaggaggaagcagctgaagctgatggaggacatggacaccgtcatcaagccccggccccaggtggtgaagcagaagaagcagaggcccaagagcatccaccgggaccacatcgagagccccaagacccccatcaagggcccccctgtgagcagcctgagcctggccagcctgaacacaggagacaatgaatctgtgcacagcggcaagaggacccccaggtctgagagcgtggagggcttcctgagccccagccgctgtggcagcagaaatggagagaaggactgggagaatgccagcaccaccagctctgtggccagcggcacagagtacacaggccccaagctgtacaaggagcccagcgccaagagcaacaagcacatcatccagaatgccctggcccactgctgcctggccggcaaggtgaatgaaggccagaagaagaagatcctggaggagatggagaagagtgatgccaacaacttcctgatcctcttccgggacagcggctgccagttccgcagcctgtacacctactgcccagagacagaggagatcaacaagctgaccggcatcggccccaagagcatcaccaagaagatgattgagggcctgtacaagtacaacagcgacaggaagcagttcagccacatcccagccaagaccctgagcgcctctgtggatgccatcaccatccacagccacctgtggcagaccaagaggcctgtgacccccaagaagctgctgcccaccaaggcctag

SEQ ID NO: 145960 - DNA, 4437 bp, Artificial Sequence
  Description of Artificial Sequence: Synthetic coding sequence
atgggagatgctgctgacccccgggagatgaggaagaccttcatcgtgcctgccatcaagccctttgaccactatgacttcagccgggccaagatcgcctgcaacctggcctggctggtggccaaggccttcggcacagaaaatgtgcctgaggagctgcaggagcccttctacacagaccagtatgaccaggagcacatcaagccccctgtggtgaacctgctgctgtctgctgagctgtactgccgggccggcagcctcatcctgaagagtgatgctgccaagcccctgctgggccatgatgctgtgatccaggccctggcccagaagggcctgtatgtgacagaccaggagaagctggtgacagagcgggacctgcacaagaagcccatccagatgtctgcccacctggccatgattgacaccctgatgatggcctacacagtggagatggtgtccattgagaaggtgattgcctgtgcccagcagtacagcgccttcttccaggccacagacctgccctatgacattgaagatgctgtgatgtactggatcaacaaggtgaatgagcacctgaaggacatcatggagcaggagcagaagctgaaggagcaccacacagtggaggcccctgggggccagaaggcccgctacaggaaggagcagaccctgctgaagcagctgccctgcatccccctggtggagaacctgctgaaggatggaacagatggctgtgccctggccgccctgatccacttctactgcccagatgtggtgcggctggaggacatctgcctgaaggagaccatgagcctggccgacagcctgtacaacctgcagctgatccaggagttctgccaggagtacctgaaccagtgctgccacttcaccctggaggacatgctgtatgctgccagcagcatcaagagcaactacctggtgttcatggccgagctgttctggtggtttgaggtggtgaagcccagctttgtgcagccccgggtggtgcggccccagggcgctgagcctgtgaaggacatgcccagcatccctgtgctgaatgctgccaagagaaatgtgctggacagcagcagtgacttccccagcagcggggagggcgccaccttcacccagagccaccaccacctgcccagccgctacagccggccccaggcccacagcagcgccagcggcggcatcagaagaagcagctccatgtcctatgtggatggcttcatcggcacctggcccaaggagaagaggagctctgtgcatggagtgtcctttgacatcagctttgacaaggaggacagcgtgcagaggagcacccccaacagaggcatcaccaggagcatcagcaatgaaggcctgaccctgaacaacagccacgtgtccaagcacatcaggaagaacctgtccttcaagcccatcaacggggaggaggaggccgagagcattgaggaggagctgaacatcgacagccacagcgacctgaagagctgtgtgcccctgaacaccaatgagctgaacagcaatgaaaacatccactacaagctgcccaatggagccctgcagaaccgcatcctgctggatgaatttggaaaccagatcgagacccccagcattgaggaggccctgcagatcatccatgacacagagaagagcccccacaccccccagcctgaccagatcgccaacggcttcttcctgcacagccaggagatgagcatcctgaacagcaacatcaagctgaaccagagcagcccagacaacgtgacagacaccaagggggccctgagccccatcacagacaacacagaggtggacaccggcatccacgtgcccagcgaggacatccctgagaccatggatgaggacagcagcctgcgggactacacagtgtccctggacagcgacatggatgatgccagcaagttcctgcaggactatgacatcagaacaggcaacacccgggaggccctgagcccctgccccagcacagtgtccaccaagagccagcccggcagcagcgccagcagcagcagcggcgtgaagatgaccagctttgctgagcagaagttcaggaagctgaaccacacagatggcaagagcagcggcagcagcagccagaagaccaccccagagggcagcgagctgaacatcccccacgtggtggcctgggcccagatccctgaggagaccggcctgccccagggccgggacaccacccagctgctggccagcgagatggtgcacctgaggatgaagctggaggagaagagaagagccatcgaggcccagaagaagaagatggaggccgccttcaccaagcagaggcagaagatgggccgcacagccttcctgactgtggtgaagaagaagggagatggcatcagccccctgcgggaggaggccgccggggctgaagatgagaaggtgtacacagaccgggccaaggagaaggagagccagaagacagatggccagaggagcaagagcctggccgacatcaaggagagcatggagaacccccaggccaagtggctgaagagccccaccacccccatcgaccctgagaagcagtggaacctggccagccccagcgaggagaccctgaatgaaggagagatcctggagtacaccaagagcattgagaagctgaacagcagcctgcacttcctgcagcaggagatgcagaggctgagcctgcagcaggagatgctgatgcagatgagggagcagcagagctgggtgatcagccccccccagcccagcccccagaagcagatccgggacttcaagcccagcaagcaggccggcctgagcagcgccatcgcccccttcagcagtgacagcccccggcccacccaccccagcccccagagcagcaacaggaagagcgccagcttctctgtgaagagccagaggaccccccggcccaatgagctgaagatcacccccctgaacagaaccctgaccccacccaggtctgtggacagcctgccccggctgcggcgcttcagccccagccaggtgcccatccagaccaggagctttgtgtgctttggagatgatggagagccccagctgaaggagagcaagcccaaggaggaggtgaagaaggaggagctggagagcaagggcaccctggagcagaggggccacaaccctgaggagaaggagatcaagccctttgagagcacagtgtctgaggtgctgagcctgcctgtgacagagaccgtgtgcctgaccccaaatgaagaccagctgaaccagcccacagagcccccacccaagcctgtgtttcctcccacagcccccaagaatgtgaacctgattgaggtgtccctgagtgacctgaagcccccagagaaggcagatgtgcctgtggagaagtatgatggagagagtgacaaggagcagtttgatgatgaccagaaggtgtgctgcggcttcttcttcaaggatgaccagaaggcagaaaatgacatggccatgaagagagctgccctgctggagaagaggctgcggcgggagaaggagacccagctgaggaagcagcagctggaggccgagatggagcacaagaaggaggagaccaggaggaagacagaggaggagcggcagaagaaggaggatgagcgggcccggcgggagttcatccggcaggagtacatgaggaggaagcagctgaagctgatggaggacatggacaccgtcatcaagccccggccccaggtggtgaagcagaagaagcagaggcccaagagcatccaccgggaccacatcgagagccccaagacccccatcaagggcccccctgtgagcagcctgagcctggccagcctgaacacaggagacaatgaatctgtgcacagcggcaagaggacccccaggtctgagagcgtggagggcttcctgagccccagccgctgtggcagcagaaatggagagaaggactgggagaatgccagcaccaccagctctgtggccagcggcacagagtacacaggccccaagctgtacaaggagcccagcgccaagagcaacaagcacatcatccagaatgccctggcccactgctgcctggccggcaaggtgaatgaaggccagaagaagaagatcctggaggagatggagaagagtgatgccaacaacttcctgatcctcttccgggacagcggctgccagttccgcagcctgtacacctactgcccagagacagaggagatcaacaagctgactggaattggccccaagagcatcaccaagaagatgattgagggcctgtacaagtacaacagcgacaggaagcagttcagccacatcccagccaagaccctgagcgcctctgtggatgccatcaccatccacagccacctgtggcagaccaagaggcctgtgacccccaagaagctgctgcccaccaaggcctag

SEQ ID NO: 145961 - DNA, 4389 bp, Artificial Sequence
  Description of Artificial Sequence: Synthetic coding sequence
atgggagatgctgctgacccccgggagatgaggaagaccttcatcgtgcctgccatcaagccctttgaccactatgacttcagccgggccaagatcgcctgcaacctggcctggctggtggccaaggccttcggcacagaaaatgtgcctgaggagctgcaggagcccttctacacagaccagtatgaccaggagcacatcaagccccctgtggtgaacctgctgctgtctgctgagctgtactgccgggccggcagcctcatcctgaagagtgatgctgccaagcccctgctgggccatgatgctgtgatccaggccctggcccagaagggcctgtatgtgacagaccaggagaagctggtgacagagcgggacctgcacaagaagcccatccagatgtctgcccacctggccatgattgacaccctgatgatggcctacacagtggagatggtgtccattgagaaggtgattgcctgtgcccagcagtacagcgccttcttccaggccacagacctgccctatgacattgaagatgctgtgatgtactggatcaacaaggtgaatgagcacctgaaggacatcatggagcaggagcagaagctgaaggagcaccacacagtggaggcccctgggggccagaaggcccgctacaggaaggagcagaccctgctgaagcagctgccctgcatccccctggtggagaacctgctgaaggatggaacagatggctgtgccctggccgccctgatccacttctactgcccagatgtggtgcggctggaggacatctgcctgaaggagaccatgagcctggccgacagcctgtacaacctgcagctgatccaggagttctgccaggagtacctgaaccagtgctgccacttcaccctggaggacatgctgtatgctgccagcagcatcaagagcaactacctggtgttcatggccgagctgttctggtggtttgaggtggtgaagcccagctttgtgcagccccgggtggtgcggccccagggcgctgagcctgtgaaggacatgcccagcatccctgtgctgaatgctgccaagagaaatgtgctggacagcagcagtgacttccccagccgctacagccggccccaggcccacagcagcgccagcggcggcatcagaagaagcagctccatgtcctatgtggatggcttcatcggcacctggcccaaggagaagaggagctctgtgcatggagtgtcctttgacatcagctttgacaaggaggacagcgtgcagaggagcacccccaacagaggcatcaccaggagcatcagcaatgaaggcctgaccctgaacaacagccacgtgtccaagcacatcaggaagaacctgtccttcaagcccatcaacggggaggaggaggccgagagcattgaggaggagctgaacatcgacagccacagcgacctgaagagctgtgtgcccctgaacaccaatgagctgaacagcaatgaaaacatccactacaagctgcccaatggagccctgcagaaccgcatcctgctggatgaatttggaaaccagatcgagacccccagcattgaggaggccctgcagatcatccatgacacagagaagagcccccacaccccccagcctgaccagatcgccaacggcttcttcctgcacagccaggagatgagcatcctgaacagcaacatcaagctgaaccagagcagcccagacaacgtgacagacaccaagggggccctgagccccatcacagacaacacagaggtggacaccggcatccacgtgcccagcgaggacatccctgagaccatggatgaggacagcagcctgcgggactacacagtgtccctggacagcgacatggatgatgccagcaagttcctgcaggactatgacatcagaacaggcaacacccgggaggccctgagcccctgccccagcacagtgtccaccaagagccagcccggcagcagcgccagcagcagcagcggcgtgaagatgaccagctttgctgagcagaagttcaggaagctgaaccacacagatggcaagagcagcggcagcagcagccagaagaccaccccagagggcagcgagctgaacatcccccacgtggtggcctgggcccagatccctgaggagaccggcctgccccagggccgggacaccacccagctgctggccagcgagatggtgcacctgaggatgaagctggaggagaagagaagagccatcgaggcccagaagaagaagatggaggccgccttcaccaagcagaggcagaagatgggccgcacagccttcctgactgtggtgaagaagaagggagatggcatcagccccctgcgggaggaggccgccggggctgaagatgagaaggtgtacacagaccgggccaaggagaaggagagccagaagacagatggccagaggagcaagagcctggccgacatcaaggagagcatggagaacccccaggccaagtggctgaagagccccaccacccccatcgaccctgagaagcagtggaacctggccagccccagcgaggagaccctgaatgaaggagagatcctggagtacaccaagagcattgagaagctgaacagcagcctgcacttcctgcagcaggagatgcagaggctgagcctgcagcaggagatgctgatgcagatgagggagcagcagagctgggtgatcagccccccccagcccagcccccagaagcagatccgggacttcaagcccagcaagcaggccggcctgagcagcgccatcgcccccttcagcagtgacagcccccggcccacccaccccagcccccagagcagcaacaggaagagcgccagcttctctgtgaagagccagaggaccccccggcccaatgagctgaagatcacccccctgaacagaaccctgaccccacccaggtctgtggacagcctgccccggctgcggcgcttcagccccagccaggtgcccatccagaccaggagctttgtgtgctttggagatgatggagagccccagctgaaggagagcaagcccaaggaggaggtgaagaaggaggagctggagagcaagggcaccctggagcagaggggccacaaccctgaggagaaggagatcaagccctttgagagcacagtgtctgaggtgctgagcctgcctgtgacagagaccgtgtgcctgaccccaaatgaagaccagctgaaccagcccacagagcccccacccaagcctgtgtttcctcccacagcccccaagaatgtgaacctgattgaggtgtccctgagtgacctgaagcccccagagaaggcagatgtgcctgtggagaagtatgatggagagagtgacaaggagcagtttgatgatgaccagaaggtgtgctgcggcttcttcttcaaggatgaccagaaggcagaaaatgacatggccatgaagagagctgccctgctggagaagaggctgcggcgggagaaggagacccagctgaggaagcagcagctggaggccgagatggagcacaagaaggaggagaccaggaggaagacagaggaggagcggcagaagaaggaggatgagcgggcccggcgggagttcatccggcaggagtacatgaggaggaagcagctgaagctgatggaggacatggacaccgtcatcaagccccggccccaggtggtgaagcagaagaagcagaggcccaagagcatccaccgggaccacatcgagagccccaagacccccatcaagggcccccctgtgagcagcctgagcctggccagcctgaacacaggagacaatgaatctgtgcacagcggcaagaggacccccaggtctgagagcgtggagggcttcctgagccccagccgctgtggcagcagaaatggagagaaggactgggagaatgccagcaccaccagctctgtggccagcggcacagagtacacaggccccaagctgtacaaggagcccagcgccaagagcaacaagcacatcatccagaatgccctggcccactgctgcctggccggcaaggtgaatgaaggccagaagaagaagatcctggaggagatggagaagagtgatgccaacaacttcctgatcctcttccgggacagcggctgccagttccgcagcctgtacacctactgcccagagacagaggagatcaacaagctgactggaattggccccaagagcatcaccaagaagatgattgagggcctgtacaagtacaacagcgacaggaagcagttcagccacatcccagccaagaccctgagcgcctctgtggatgccatcaccatccacagccacctgtggcagaccaagaggcctgtgacccccaagaagctgctgcccaccaaggcctag

SEQ ID NO: 145962 - DNA, 450 bp, Artificial Sequence
  Description of Artificial Sequence: Synthetic coding sequence
atggctgaccagctgacagaggagcaggtgacagagttcaaggaggccttcagcctgtttgacaaggatggagatggctgcatcaccacccgggagctgggcaccgtgatgaggagcctgggccagaaccccacagaagctgagctgcgggacatgatgtctgaaattgacagagatggaaatggaacagtggacttccctgagttcctgggcatgatggccaggaagatgaaggacacagacaatgaggaggagatccgggaggccttccgggtgtttgacaaggatggaaatggatttgtgtctgctgctgagctgcggcacgtgatgacccggctgggggagaagctgagtgatgaggaggtggatgagatgatccgggctgctgacacagatggagatggccaggtgaactatgaggagtttgtgcgggtgctggtgtccaagtag

SEQ ID NO: 145963 - DNA, 546 bp, Artificial Sequence
  Description of Artificial Sequence: Synthetic coding sequence
atgggcctgcagcaggagatcagcctgcagccctggtgccaccaccctgctgagagctgccagaccaccacagacatgacagagcggctgtctgctgagcagatcaaggagtacaagggcgtgtttgagatgtttgatgaggagggcaatggagaggtgaagacaggagagctggagtggctgatgagcctgctgggcatcaaccccaccaagtctgagctggcctccatggccaaggatgtggaccgggacaacaagggcttcttcaactgtgatggcttcctggccctgatgggcgtgtaccacgagaaggcccagaaccaggagagcgagctgcgggccgccttccgggtgtttgacaaggagggcaagggctacatcgactggaacaccctgaagtatgtgctgatgaatgctggggagcccctgaatgaggtggaggccgagcagatgatgaaggaggccgacaaggatggagacaggaccattgattatgaggagtttgtggccatgatgactggagagagcttcaagctgatccagtag

SEQ ID NO: 145964 - DNA, 495 bp, Artificial Sequence
  Description of Artificial Sequence: Synthetic coding sequence
atgggcctgcagcaggagatcagcctgacagagcggctgtctgctgagcagatcaaggagtacaagggcgtgtttgagatgtttgatgaggagggcaatggagaggtgaagacaggagagctggagtggctgatgagcctgctgggcatcaaccccaccaagtctgagctggcctccatggccaaggatgtggaccgggacaacaagggcttcttcaactgtgatggcttcctggccctgatgggcgtgtaccacgagaaggcccagaaccaggagagcgagctgcgggccgccttccgggtgtttgacaaggagggcaagggctacatcgactggaacaccctgaagtatgtgctgatgaatgctggggagcccctgaatgaggtggaggccgagcagatgatgaaggaggccgacaaggatggagacaggaccatcgactatgaggagtttgtggccatgatgaccggggagagcttcaagctgatccagtag

SEQ ID NO: 145965 - DNA, 1779 bp, Artificial Sequence
  Description of Artificial Sequence: Synthetic coding sequence
atggagggcaagtggctgctgtgcatgctgctggtgctgggcacagccatcgtggaggcccatgatggccatgatgatgatgtgattgatattgaagatgacctggatgatgtgattgaggaggtggaggacagcaagccagacaccacagccccacccagcagccccaaggtgacctacaaggcccctgtgcccaccggggaggtgtactttgctgacagctttgaccggggcaccctgagcggctggatcctgagcaaggccaagaaggatgacacagatgatgaaattgccaagtatgatggcaagtgggaggtggaggagatgaaggagagcaagctgcccggggacaagggcctggtgctgatgagccgggccaagcaccacgccatcagcgccaagctgaacaagcccttcctgtttgacaccaagcccctgattgtgcagtatgaggtgaacttccagaatggaattgaatgtggcggggcctacgtgaagctgctgagcaagaccccagagctgaacctggaccagttccatgacaagaccccctacaccatcatgtttggaccagacaagtgtggggaggactacaagctgcacttcatcttccgccacaagaaccccaagacaggcatctatgaggagaagcacgccaagaggccagatgctgacctgaagacctacttcacagacaagaagacccacctgtacaccctcatcctgaacccagacaacagctttgagatcctggtggaccagagcgtggtgaacagcggcaacctgctgaatgacatgaccccacctgtgaaccccagccgggagattgaagatcctgaggacaggaagccagaggactgggatgagcggcccaagatcccagaccctgaggccgtgaagccagatgactgggatgaagatgccccagccaagatcccagatgaggaggccaccaagccagagggctggctggatgatgagccagaatatgtgcctgaccctgatgctgagaagccagaggactgggatgaggacatggatggagagtgggaggccccccagatcgccaacccccgctgtgagagcgcccctggctgcggcgtgtggcagaggcctgtgattgacaaccccaactacaagggcaagtggaagccacccatgattgacaaccccagctaccagggcatctggaagcccaggaagatccccaacccagacttctttgaggacctggagcccttcaggatgacccccttcagcgccatcggcctggagctgtggagcatgaccagtgacatcttctttgacaacttcatcatctgtgccgaccggcgcatcgtggatgactgggccaatgatggctggggcctgaagaaggctgctgatggagctgctgagcccggggtggtgggccagatgattgaggccgctgaggagcggccctggctgtgggtggtgtacatcctgactgtggccctgcccgtcttcctggtgatcctcttctgctgcagcggcaagaagcagaccagcggcatggagtacaagaagacagatgccccccagccagatgtgaaggaggaggaggaggagaaggaggaggagaaggacaagggagatgaggaggaggagggggaggagaagctggaggagaagcagaagagtgatgctgaggaggatggcggcaccgtgtcccaggaggaggaggacaggaagcccaaggccgaggaggatgagatcctgaacagaagccccaggaacaggaagccccggcgggagtag

SEQ ID NO: 145966 - DNA, 852 bp, Artificial Sequence
  Description of Artificial Sequence: Synthetic coding sequence
atgctgctggtgctgggcacagccatcgtggaggcccatgatggccatgatgatgatgtgattgatattgaagatgacctggatgatgtgattgaggaggtggaggacagcaagccagacaccacagccccacccagcagccccaaggtgacctacaaggcccctgtgcccaccggggaggtgtactttgctgacagctttgaccggggcaccctgagcggctggatcctgagcaaggccaagaaggatgacacagatgatgaaattgccaagtatgatggcaagtgggaggtggaggagatgaaggagagcaagctgcccggggacaagggcctggtgctgatgagccgggccaagcaccacgccatcagcgccaagctgaacaagcccttcctgtttgacaccaagcccctgattgtgcagtatgaggtgaacttccagaatggaattgaatgtggcggggcctacaactgcttcctgaagcaccagaacagcacctgggaccagttccatgacaagaccccctacaccatcatgtttggaccagacaagtgtggggaggactacaagctgcacttcatcttccgccacaagaaccccaagacaggcatctatgaggagaagcacgccaagaggccagatgctgacctgaagacctacttcacagacaagaagacccacctgtacaccctcatcctgaacccagacaacagctttgagatcctggtggaccagagcgtgccccctgtgaaccccagccgggagattgaagatcctgaggacaggaagccagaggactgggatgagcggcccaagatcccagaccctgaggccgtgaagccagatgactag

SEQ ID NO: 145967 - DNA, 984 bp, Artificial Sequence
  Description of Artificial Sequence: Synthetic coding sequence
atggagggcaagtggctgctgtgcatgctgctggtgctgggcacagccatcgtggaggcccatgatggccatgatgatgatgtgattgatattgaagatgacctggatgatgtgattgaggaggtggaggagatgaaggagagcaagctgcccggggacaagggcctggtgctgatgagccgggccaagcaccacgccatcagcgccaagctgaacaagcccttcctgtttgacaccaagcccctgattgtgcagtatgaggtgaacttccagaatggaattgaatgtggcggggcctacgtgaagctgctgagcaagaccccagagctgaacctggaccagttccatgacaagaccccctacaccatcatgtttggaccagacaagtgtggggaggactacaagctgcacttcatcttccgccacaagaaccccaagacaggcatctatgaggagaagcacgccaagaggccagatgctgacctgaagacctacttcacagacaagaagacccacctgtacaccctcatcctgaacccagacaacagctttgagatcctggtggaccagagcgtggtgaacagcggcaacctgctgaatgacatgaccccacctgtgaaccccagccgggagattgaagatcctgaggacaggaagccagaggactgggatgagcggcccaagatcccagaccctgaggccgtgaagccagatgactgggatgaagatgccccagccaagatcccagatgaggaggccaccaagccagagggctggctggatgatgagccagaatatgtgcctgaccctgatgctgagaagccagaggactgggatgaggacatggatggagagtgggaggccccccagatcgccaacccccgctgtgagagcgcccctggctgcggcgtgtggcagaggcctgtggtggacatccagaagaccagccgccaccaccaccagcaggcccctgtggagcactag

SEQ ID NO: 145968 - DNA, 1884 bp, Artificial Sequence
  Description of Artificial Sequence: Synthetic coding sequence
atggctgacaggaggacccccaccccatttgctggctgccgcctgccccggcagaggcgggccagagatgccagccaggtgtctgcccctggcacccggcgcatcatggagggcaagtggctgctgtgcatgctgctggtgctgggcacagccatcgtggaggcccatgatggccatgatgatgatgtgattgatattgaagatgacctggatgatgtgattgaggaggtggaggacagcaagccagacaccacagccccacccagcagccccaaggtgacctacaaggcccctgtgcccactggagaggtgtactttgctgacagctttgaccggggcaccctgagcggctggatcctgagcaaggccaagaaggatgacacagatgatgagatcgccaagtatgatggcaagtgggaggtggaggagatgaaggagagcaagctgcccggggacaagggcctggtgctgatgagccgggccaagcaccacgccatcagcgccaagctgaacaagcccttcctgtttgacaccaagcccctcatcgtgcagtatgaggtgaacttccagaatggaattgaatgtggcggggcctacgtgaagctgctgagcaagaccccagagctgaacctggaccagttccatgacaagaccccctacaccatcatgtttggaccagacaagtgtggggaggactacaagctgcacttcatcttccgccacaagaaccccaagacaggcatctatgaggagaagcacgccaagaggccagatgctgacctgaagacctacttcacagacaagaagacccacctgtacaccctcatcctgaacccagacaacagctttgagatcctggtggaccagagcgtggtgaacagcggcaacctgctgaatgacatgaccccacctgtgaaccccagccgggagattgaggaccctgaggacaggaagccagaggactgggatgagcggcccaagatcccagaccctgaggccgtgaagccagatgactgggatgaagatgccccagccaagatcccagatgaggaggccaccaagccagagggctggctggatgatgagccagaatatgtgcctgaccctgatgctgagaagccagaggactgggatgaggacatggatggagagtgggaggccccccagatcgccaacccccgctgtgagagcgcccctggctgcggcgtgtggcagaggcctgtgattgacaaccccaactacaagggcaagtggaagccacccatgattgacaaccccagctaccagggcatctggaagcccaggaagatccccaacccagacttctttgaggacctggagcccttcaggatgacccccttcagcgccatcggcctggagctgtggagcatgaccagtgacatcttctttgacaacttcatcatctgtgccgacagaagaattgtggatgactgggccaatgatggctggggcctgaagaaggccgcagatggagctgctgagcccggggtggtgggccagatgattgaagctgctgaggagcggccctggctgtgggtggtgtacatcctgactgtggccctgcctgtgttcctggtgatcctcttctgctgcagcggcaagaagcagaccagcggcatggagtacaagaagacagatgccccccagccagatgtgaaggaggaggaggaggagaaggaggaggagaaggacaagggagatgaggaggaggagggggaggagaagctggaggagaagcagaagagtgatgctgaagaagatggcggcaccgtgtcccaggaggaggaggacaggaagcccaaggccgaggaggatgagatcctgaacagaagccccaggaacaggaagccccggcgggagtag

SEQ ID NO: 145969 - DNA, 1779 bp, Artificial Sequence; identical to SEQ ID NO: 145965
  Description of Artificial Sequence: Synthetic coding sequence

SEQ ID NO: 145970 - DNA, 405 bp, Artificial Sequence
  Description of Artificial Sequence: Synthetic coding sequence
atggagggcaagtggctgctgtgcatgctgctggtgctgggcacagccatcgtggaggcccatgatggccatgatgatgatgtgattgatattgaagatgacctggatgatgtgattgaggaggtggaggacagcaagccagacaccacagccccacccagcagccccaaggtgacctacaaggcccctgtgcccaccggggaggtgtactttgctgacagctttgaccggggcaccctgagcggctggatcctgagcaaggccaagaaggatgacacagatgatgaaattgccaagtatgatggcaagtgggaggtggaggagatgaaggagagcaagctgcccggggacaagggcctggtgctgatgagccgggccaagcaccacgccatcagcgccaagtag

SEQ ID NO: 145971 - DNA, 507 bp, Artificial Sequence
  Description of Artificial Sequence: Synthetic coding sequence
atggagggcaagtggctgctgtgcatgctgctggtgctgggcacagccatcgtggaggcccatgatggccatgatgatgatgtgattgatattgaagatgacctggatgatgtgattgaggaggtggaggacagcaagccagacaccacagccccacccagcagccccaaggtgacctacaaggcccctgtgcccaccggggaggtgtactttgctgacagctttgaccggggcaccctgagcggctggatcctgagcaaggccaagaaggatgacacagatgatgaaattgccaagtatgatggcaagtgggaggtggaggagatgaaggagagcaagctgcccggggacaagggcctggtgctgatgagccgggccaagcaccacgccatcagcgccaagctgaacaagcccttcctgtttgacaccaagcccctgattgtgcagtatgaggtgaacttccagaatggaattgaatgtggcggggcctacgtgaagctgctgtag

SEQ ID NO: 145972 - DNA, 1779 bp, Artificial Sequence; identical to SEQ ID NO: 145965
  Description of Artificial Sequence: Synthetic coding sequence

SEQ ID NO: 145973 - DNA, 240 bp, Artificial Sequence
  Description of Artificial Sequence: Synthetic coding sequence
atggagggcaagtggctgctgtgcatgctgctggtgctgggcacagccatcgtggaggcccatgatggccatgatgatgatgtgattgatattgaagatgacctggatgatgtgattgaggaggtggaggacagcaagccagacaccacagccccacccagcagccccaaggtgacctacaaggcccctgtgcccaccggggaggtgtactttgctgacagctttgaccggggcacctag

SEQ ID NO: 145974 - DNA, 99 bp, Artificial Sequence
  Description of Artificial Sequence: Synthetic coding sequence
atggagggcaagtggctgctgtgcatgctgctggtgctgggcacagccatcgtggaggcccatgatggccatgatgatgatgtgattgatattgaatag

SEQ ID NO: 145975 - DNA, 1455 bp, Artificial Sequence
  Description of Artificial Sequence: Synthetic coding sequence
atgaaggagagcaagctgcccggggacaagggcctggtgctgatgagccgggccaagcaccacgccatcagcgccaagctgaacaagcccttcctgtttgacaccaagcccctgattgtgcagtatgaggtgaacttccagaatggaattgaatgtggcggggcctacgtgaagctgctgagcaagaccccagagctgaacctggaccagttccatgacaagaccccctacaccatcatgtttggaccagacaagtgtggggaggactacaagctgcacttcatcttccgccacaagaaccccaagacaggcatctatgaggagaagcacgccaagaggccagatgctgacctgaagacctacttcacagacaagaagacccacctgtacaccctcatcctgaacccagacaacagctttgagatcctggtggaccagagcgtggtgaacagcggcaacctgctgaatgacatgaccccacctgtgaaccccagccgggagattgaagatcctgaggacaggaagccagaggactgggatgagcggcccaagatcccagaccctgaggccgtgaagccagatgactgggatgaagatgccccagccaagatcccagatgaggaggccaccaagccagagggctggctggatgatgagccagaatatgtgcctgaccctgatgctgagaagccagaggactgggatgaggacatggatggagagtgggaggccccccagatcgccaacccccgctgtgagagcgcccctggctgcggcgtgtggcagaggcctgtgattgacaaccccaactacaagggcaagtggaagccacccatgattgacaaccccagctaccagggcatctggaagcccaggaagatccccaacccagacttctttgaggacctggagcccttcaggatgacccccttcagcgccatcggcctggagctgtggagcatgaccagtgacatcttctttgacaacttcatcatctgtgccgaccggcgcatcgtggatgactgggccaatgatggctggggcctgaagaaggctgctgatggagctgctgagcccggggtggtgggccagatgattgaggccgctgaggagcggccctggctgtgggtggtgtacatcctgactgtggccctgcccgtcttcctggtgatcctcttctgctgcagcggcaagaagcagaccagcggcatggagtacaagaagacagatgccccccagccagatgtgaaggaggaggaggaggagaaggaggaggagaaggacaagggagatgaggaggaggagggggaggagaagctggaggagaagcagaagagtgatgctgaggaggatggcggcaccgtgtcccaggaggaggaggacaggaagcccaaggccgaggaggatgagatcctgaacagaagccccaggaacaggaagccccggcgggagtag

SEQ ID NO: 145976 - DNA, 324 bp, Artificial Sequence
  Description of Artificial Sequence: Synthetic coding sequence
atggagggcaagtggctgctgtgcatgctgctggtgctgggcacagccatcgtggaggcccatgatggccatgatgatgatgtgattgatattgaagatgacctggatgatgtgattgaggaggtggaggacagcaagccagacaccacagccccacccagcagccccaaggtgacctacaaggcccctgtgcccaccggggaggtgtactttgctgacagctttgaccggggcaccctgagcggctggatcctgagcaaggccaagaaggatgacacagatgatgaaattgccaagtatgatggcaagtgggaggtggagtag

SEQ ID NO: 145977 - DNA, 435 bp, Artificial Sequence
  Description of Artificial Sequence: Synthetic coding sequence
atggagggcaagtggctgctgtgcatgctgctggtgctgggcacagccatcgtggaggcccatgatggccatgatgatgatgtgattgatattgaagatgacctggatgatgtgattgaggaggtggaggacagcaagccagacaccacagccccacccagcagccccaaggtgacctacaaggcccctgtgcccaccggggaggtgtactttgctgacagctttgaccggggcaccctgagcggctggatcctgagcaaggccaagaaggatgacacagatgatgaaattgccaagtatgatggcaagtgggaggtggaggagatgaaggagagcaagctgcccggggacaagggcctggtgctgatgagccgggccaagcaccacgccatcagcgccaagctgaacaagcccttcctgtttgacaccaagtag

SEQ ID NO: 145978 - DNA, 420 bp, Artificial Sequence
  Description of Artificial Sequence: Synthetic coding sequence
atgagagctggccgcggggccaccccagcccgggagctgttcagagatgctgccttccctgctgctgacagcagcctcttctgtgacctgagcacccccctggcccagttccgggaggacatcacctggaggcggccccaggagatctgtgccacccccaggctcttcccagatgacccccgggagggccaggtgaagcagggcctgctgggggactgctggttcctgtgtgcctgtgccgccctgcagaagagccgccacctgctggaccaggtgtcctgccctgtgcagctgcctgctgactggacctgcaaggtgcagcctgtgtggctggagttcccctgcctgcccatcagctgccgcctgcgggtgtccagtgacaccagcccagacagcgccacctggggctcctggaagtag

SEQ ID NO: 145979 - DNA, 417 bp, Artificial Sequence
  Description of Artificial Sequence: Synthetic coding sequence
atgagagctggccgcggggccaccccagcccgggagctgttcagagatgctgccttccctgctgctgacagcagcctcttctgtgacctgagcacccccctggcccagttccgggaggacatcacctggaggcggccccaggtgcctgagggcggccgcagccaggatgccccacccctgctgctgcaggagcccctgctgagctgtgtgccccacagatatgcccaggaggtgtcccggctgtgcctgctgcctgctggcacctacaaggtggtgcccagcacctacctgcctgacacagagggcgccttcaccgtgaccatcgccaccagaattgaccggcccagcatccacagccaggagatgctgggccagttcctgcaggaggtgtccatcatggctgtgatgaagacctag

SEQ ID NO: 145980 - DNA, 1554 bp, Artificial Sequence
  Description of Artificial Sequence: Synthetic coding sequence
atgagagctggccgcggggccaccccagcccgggagctgttcagagatgctgccttccctgctgctgacagcagcctcttctgtgacctgagcacccccctggcccagttccgggaggacatcacctggaggcggccccaggagatctgtgccacccccaggctcttcccagatgacccccgggagggccaggtgaagcagggcctgctgggggactgctggttcctgtgtgcctgtgccgccctgcagaagagccgccacctgctggaccaggtgatccccccaggccagcccagctgggccgaccaggagtaccggggcagcttcacctgccgcatctggcagtttggccgctgggtggaggtgaccacagatgaccggctgccctgcctggccggccgcctgtgcttcagccgctgccagagagaagatgtgttctggctgcccctgctggagaaggtgtatgccaaggtgcacggcagctatgagcacctgtgggccggccaggtggctgatgccctggtggacctgaccggcggcctggccgagcgctggaacctgaagggcgtggccggcagcggcggccagcaggaccggcccggccgctgggagcacaggacctgccggcagctgctgcacctgaaggaccagtgcctgatcagctgctgcgtgctgagccccagggctggggcccgggagctgggggagttccacgccttcatcgtgtctgacctgcgggagctgcagggccaggccggccagtgcatcctgctgctgcgcatccagaacccctggggccgccgctgctggcagggcctgtggagggagggcggggagggctggagccaggtggatgctgctgtggccagcgagctgctgagccagctgcaggagggggagttctgggtggaggaggaggagttcctgcgggagtttgatgagctgactgtgggctaccctgtgacagaggccggccacctgcagagcctgtacacagagcggctgctgtgccacacccgggccctgcccggggcctgggtgaagggccagagcgctgggggctgcaggaacaacagcggcttccccagcaaccccaagttctggctgcgggtgtctgagcccagcgaggtgtacatcgctgtgctgcagaggagccggctgcatgctgctgactgggccggccgggcccgggccctggtgggggacagccacacctcctggagccctgccagcatccctgggaagcactaccaggccgtgggcctgcacctgtggaaggtgcctgagggcggccgcagccaggatgccccacccctgctgctgcaggagcccctgctgagctgtgtgccccacagatatgcccaggaggtgtcccggctgtgcctgctgcctgctggcacctacaaggtggtgcccagcacctacctgcctgacacagaaggagccttcaccgtgaccatcgccaccagaattgaccggcccagcatccacagccaggagatgctgggccagttcctgcaggaggtgtccatcatggctgtgatgaagacctag

SEQ ID NO: 145981 - DNA, 1335 bp, Artificial Sequence
  Description of Artificial Sequence: Synthetic coding sequence
atgagagctggccgcggggccaccccagcccgggagctgttcagagatgctgccttccctgctgctgacagcagcctcttctgtgacctgagcacccccctggcccagttccgggaggacatcacctggaggcggccccaggagatctgtgccacccccaggctcttcccagatgacccccgggagggccaggtgaagcagggcctgctgggggactgctggttcctgtgtgcctgtgccgccctgcagaagagccgccacctgctggaccaggtgatccccccaggccagcccagctgggccgaccaggagtaccggggcagcttcacctgccgcatctggcagtttggccgctgggtggaggtgaccacagatgaccggctgccctgcctggccggccgcctgtgcttcagccgctgccagagagaagatgtgttctggctgcccctgctggagaaggtgtatgccaaggtgcacggcagctatgagcacctgtgggccggccaggtggctgatgccctggtggacctgaccggcggcctggccgagcgctggaacctgaagggcgtggccggcagcggcggccagcaggaccggcccggccgctgggagcacaggacctgccggcagctgctgcacctgaaggaccagtgcctgatcagctgctgcgtgctgagccccagggctggggcccgggagctgggggagttccacgccttcatcgtgtctgacctgcgggagctgcagggccaggccggccagtgcatcctgctgctgcgcatccagaacccctggggccgccgctgctggcagggcctgtggagggagggcggggagggctggagccaggtggatgctgctgtggccagcgagctgctgagccagctgcaggagggggagttctgggtggaggaggaggagttcctgcgggagtttgatgagctgactgtgggctaccctgtgacagaggccggccacctgcagagcctgtacacagagcggctgctgtgccacacccgggccctgcccggggcctgggtgaagggccagagcgctgggggctgcaggaacaacagcggcttccccagcaaccccaagttctggctgcgggtgtctgagcccagcgaggtgtacatcgctgtgctgcagaggagccggctgcatgctgctgactgggccggccgggcccgggccctggtgggggacagccacacctcctggagccctgccagcatccctgggaagcactaccaggccgtgggcctgcacctgtggaagggcgtgaccctgggcaccaccctcttccctgtgcccagctggatgtggcccacctag

SEQ ID NO: 145982 - DNA, 2019 bp, Artificial Sequence
  Description of Artificial Sequence: Synthetic coding sequence
atgagagctggccgcggggccaccccagcccgggagctgttcagagatgctgccttccctgctgctgacagcagcctcttctgtgacctgagcacccccctggcccagttccgggaggacatcacctggaggcggccccaggagatctgtgccacccccaggctcttcccagatgacccccgggagggccaggtgaagcagggcctgctgggggactgctggttcctgtgtgcctgtgccgccctgcagaagagccgccacctgctggaccaggtgatccccccaggccagcccagctgggccgaccaggagtaccggggcagcttcacctgccgcatctggcagtttggccgctgggtggaggtgaccacagatgaccggctgccctgcctggccggccgcctgtgcttcagccgctgccagagagaagatgtgttctggctgcccctgctggagaaggtgtatgccaaggtgcacggcagctatgagcacctgtgggccggccaggtggctgatgccctggtggacctgaccggcggcctggccgagcgctggaacctgaagggcgtggccggcagcggcggccagcaggaccggcccggccgctgggagcacaggacctgccggcagctgctgcacctgaaggaccagtgcctgatcagctgctgcgtgctgagccccagggctggggcccgggagctgggggagttccacgccttcatcgtgtctgacctgcgggagctgcagggccaggccggccagtgcatcctgctgctgcgcatccagaacccctggggccgccgctgctggcagggcctgtggagggagggcggggagggctggagccaggtggatgctgctgtggccagcgagctgctgagccagctgcaggagggggagttctgggtggaggaggaggagttcctgcgggagtttgatgagctgactgtgggctaccctgtgacagaggccggccacctgcagagcctgtacacagagcggctgctgtgccacacccgggccctgcccggggcctgggtgaagggccagagcgctgggggctgcaggaacaacagcggcttccccagcaaccccaagttctggctgcgggtgtctgagcccagcgaggtgtacatcgctgtgctgcagaggagccggctgcatgctgctgactgggccggccgggcccgggccctggtgggggacagccacacctcctggagccctgccagcatccctgggaagcactaccaggccgtgggcctgcacctgtggaaggtggagaagagaagagtgaacctgccccgggtgctgtccatgcctcctgtggccggcacagcctgccacgcctatgaccgggaggtgcacctgcgctgtgagctgagccctggctactacctggccgtgcccagcaccttcctgaaggatgcccctggagagttcctgctgcgggtcttcagcacaggccgggtgtccctgagcgccatccgggctgtggccaagaacaccaccccaggagctgccctgcctgctggggagtggggcaccgtgcagctgcggggctcctggagggtgggccagacagctgggggcagcaggaactttgccagctaccccaccaacccctgcttccccttctctgtgcctgagggccctggcccccgctgtgtgcgcatcaccctgcaccagcactgccggcccagcgacacagagttccaccccatcggcttccacatcttccaggtgcctgagggcggccgcagccaggatgccccacccctgctgctgcaggagcccctgctgagctgtgtgccccacagatatgcccaggaggtgtcccggctgtgcctgctgcctgctggcacctacaaggtggtgcccagcacctacctgcctgacacagagggcgccttcaccgtgaccatcgccaccagaattgaccggcccagcatccacagccaggagatgctgggccagttcctgcaggaggtgtccatcatggctgtgatgaagacctag

SEQ ID NO: 145983 - DNA, 2220 bp, Artificial Sequence
  Description of Artificial Sequence: Synthetic coding sequence
atgctgtacagccctggccccagcctgcctgagagcgctgagagcctggatggcagccaggaggacaagccccggggcagctgtgccgagcccaccttcacagacaccggcatggtggcccacatcaacaacagccggctgaaggccaagggcgtgggccagcacgacaatgcccagaactttggaaaccagagctttgaggagctgcgggccgcctgcctgaggaagggggagctgtttgaggaccccctcttccctgctgagcccagcagcctgggcttcaaggacctgggccccaacagcaagaatgtgcagaacatctcctggcagaggcccaaggacatcatcaacaaccccctcttcatcatggatggcatcagccccacagacatctgccagggcatcctgggggactgctggctgctggccgccatcggcagcctgaccacctgccccaagctgctgtacagagtggtgccccggggccagagcttcaagaagaactatgccggcatcttccacttccagatctggcagtttggccagtgggtgaatgtggtggtggatgaccggctgcccaccaagaatgacaagctggtgtttgtgcacagcacagagaggtctgagttctggagcgccctgctggagaaggcctatgccaagctgagcggcagctatgaggccctgagcggcggcagcaccatggagggcctggaggacttcaccggcggcgtggcccagagcttccagctgcagaggcctccccagaacctgctgcggctgctgaggaaggctgtggagaggagcagcctgatgggctgcagcattgaggtgaccagtgacagcgagctggagagcatgacagacaagatgctggtgcggggccacgcctacagcgtgacaggcctgcaggatgtgcactaccggggcaagatggagaccctcatccgggtgaggaacccctggggcagaattgagtggaatggagcctggagcgacagcgcccgggagtgggaggaggtggccagtgacatccagatgcagctgctgcacaagacagaagatggagagttctggatgagctaccaggacttcctgaacaacttcaccctgctggagatctgcaacctgaccccagacaccctgagcggggactacaagagctactggcacaccaccttctatgagggctcctggaggcggggcagcagcgctgggggctgcaggaaccaccctggcaccttctggaccaacccccagttcaagatcagcctgcctgaaggagatgatcctgaagatgatgctgagggcaatgtggtggtgtgcacctgcctggtggccctgatgcagaagaactggaggcatgcccggcagcagggcgcccagctgcagaccatcggctttgtgctgtatgctgtgcccaaggagttccagaacatccaggatgtgcacctgaagaaggagttcttcaccaagtaccaggaccacggcttcagcgagatcttcaccaacagccgggaggtgagcagccagctgcggctgcccccaggagagtacatcatcatccccagcacctttgagccccacagagatgctgacttcctgctgcgggtcttcacagagaagcacagcgagagctgggagctggatgaggtgaactatgcagagcagctgcaggaggagaaggtgtctgaagatgacatggaccaggacttcctgcacctgttcaagatcgtggccggggagggcaaggagattggagtgtatgagctgcagaggctgctgaacaggatggccatcaagttcaagagcttcaagaccaagggcttcggcctggatgcctgccgctgcatgatcaacctgatggacaaggatggcagcggcaagctgggcctgctggagttcaagatcctgtggaagaagctgaagaagtggatggacatcttcagagaatgtgaccaggaccacagcggcaccctgaacagctatgagatgaggctggtgattgagaaggccggcatcaagctgaacaacaaggtgatgcaggtgctggtggcccgctatgcagatgatgacctgatcatcgactttgacagcttcatcagctgcttcctgcggctgaagaccatgttcaccttcttcctgaccatggaccccaagaacacaggccacatctgcctgagcctggagcagtggctgcagatgaccatgtggggctag

SEQ ID NO: 145984 - DNA, 2220 bp, Artificial Sequence
  Description of Artificial Sequence: Synthetic coding sequence
atgctgtacagccctggccccagcctgcctgagagcgctgagagcctggatggcagccaggaggacaagccccggggcagctgtgccgagcccaccttcacagacaccggcatggtggcccacatcaacaacagccggctgaaggccaagggcgtgggccagcacgacaatgcccagaactttggaaaccagagctttgaggagctgcgggccgcctgcctgaggaagggggagctgtttgaggaccccctcttccctgctgagcccagcagcctgggcttcaaggacctgggccccaacagcaagaatgtgcagaacatctcctggcagaggcccaaggacatcatcaacaaccccctcttcatcatggatggcatcagccccacagacatctgccagggcatcctgggggactgctggctgctggccgccatcggcagcctgaccacctgccccaagctgctgtacagagtggtgccccggggccagagcttcaagaagaactatgccggcatcttccacttccagatctggcagtttggccagtgggtgaatgtggtggtggatgaccggctgcccaccaagaatgacaagctggtgtttgtgcacagcacagagaggtctgagttctggagcgccctgctggagaaggcctatgccaagctgagcggcagctatgaggccctgagcggcggcagcaccatggagggcctggaggacttcaccggcggcgtggcccagagcttccagctgcagaggcctccccagaacctgctgcggctgctgaggaaggctgtggagaggagcagcctgatgggctgcagcattgaggtgaccagtgacagcgagctggagagcatgacagacaagatgctggtgcggggccacgcctacagcgtgacaggcctgcaggatgtgcactaccggggcaagatggagaccctcatccgggtgaggaacccctggggcagaattgagtggaatggagcctggagcgacagcgcccgggagtgggaggaggtggccagtgacatccagatgcagctgctgcacaagacagaagatggagagttctggatgagctaccaggacttcctgaacaacttcaccctgctggagatctgcaacctgaccccagacaccctgagcggggactacaagagctactggcacaccaccttctatgagggctcctggaggcggggcagcagcgctgggggctgcaggaaccaccctggcaccttctggaccaacccccagttcaagatcagcctgcctgaaggagatgatcctgaagatgatgctgagggcaatgtggtggtgtgcacctgcctggtggccctgatgcagaagaactggaggcatgcccggcagcagggcgcccagctgcagaccatcggctttgtgctgtatgctgtggccagccccttccagaacatccaggatgtgcacctgaagaaggagttcttcaccaagtaccaggaccacggcttcagcgagatcttcaccaacagccgggaggtgagcagccagctgcggctgcccccaggagagtacatcatcatccccagcacctttgagccccacagagatgctgacttcctgctgcgggtcttcacagagaagcacagcgagagctgggagctggatgaggtgaactatgcagagcagctgcaggaggagaaggtgtctgaagatgacatggaccaggacttcctgcacctgttcaagatcgtggccggggagggcaaggagattggagtgtatgagctgcagaggctgctgaacaggatggccatcaagttcaagagcttcaagaccaagggcttcggcctggatgcctgccgctgcatgatcaacctgatggacaaggatggcagcggcaagctgggcctgctggagttcaagatcctgtggaagaagctgaagaagtggatggacatcttcagagaatgtgaccaggaccacagcggcaccctgaacagctatgagatgaggctggtgattgagaaggccggcatcaagctgaacaacaaggtgatgcaggtgctggtggcccgctatgcagatgatgacctgatcatcgactttgacagcttcatcagctgcttcctgcggctgaagaccatgttcaccttcttcctgaccatggaccccaagaacacaggccacatctgcctgagcctggagcagtggctgcagatgaccatgtggggctag

SEQ ID NO: 145985 - DNA, 2160 bp, Artificial Sequence
  Description of Artificial Sequence: Synthetic coding sequence
atggccagcagcagcggccgggtgaccatccagctggtggatgaggaggccggcgtgggcgccggccgcctgcagctgttccggggccagagctatgaggccatccgggccgcctgcctggacagcggcatcctcttccgggacccctacttccctgctggcccagatgccctgggctatgaccagctgggcccagattctgagaaggccaagggcgtgaagtggatgaggcctcatgagttctgtgccgagcccaagttcatctgtgaggacatgagcaggacagatgtgtgccagggcagcctgggcaactgctggttcctggccgctgctgccagcctgaccctgtacccccggctgctgcggcgggtggtgcccccaggccaggacttccagcacggctacgccggggtcttccacttccagctgtggcagtttggccgctggatggatgtggtggtggatgaccggctgcctgtgcgggagggcaagctgatgtttgtgcgctctgagcagagaaatgagttctgggcccccctgctggagaaggcctatgccaagctgcacggcagctatgaggtgatgagaggaggccacatgaatgaggcctttgtggacttcaccggcggcgtgggggaggtgctgtacctgcggcagaacagcatgggcctcttcagcgccctgcggcatgccctggccaaggagagcctggtgggcgccacagccctgagtgacagaggagagtacagaacagaggagggcctggtgaagggccacgcctacagcatcaccggcacccacaaggtgttcctgggcttcaccaaggtgcggctgctgcggctgaggaacccctggggctgtgtggagtggacaggagcctggagcgacagctgcccccgctgggacaccctgcccacagaatgtagagatgccctgctggtgaagaaggaggatggagagttctggatggagctgcgggacttcctgctgcactttgacacagtgcagatctgcagcctgagccctgaggtgctgggccccagccctgagggcggcggctggcacgtgcacaccttccagggccgctgggtgcggggcttcaacagcggcggcagccagcccaatgctgagaccttctggaccaacccccagttccggctgaccctgctggagccagatgaagaagatgatgaagatgaggagggcccctggggcggctggggcgccgccggggcccggggccctgcccggggcggccgcacccccaagtgcaccgtgctgctgagcctcatccagaggaacagaagaaggctgcgggccaagggcctgacctacctgactgtgggcttccacgtgttccagatccctgaggagctgctgggcctgtgggacagccccaggagccacgccctgctgccccggctgctgcgggctgacaggagccccctgagcgccaggagagatgtgacccggcgctgctgcctgcggcccggccactacctggtggtgcccagcacagcccatgctggagatgaagctgacttcaccctgcgggtcttcagcgagaggaggcacacagctgtggagattgatgatgtgatctctgctgacctgcagagcctgcagggcccctacctgcccctggagctgggcctggagcagctgttccaggagctggccggggaggaggaggagctgaatgccagccagctgcaggccctgctgagcatcgccctggagcccgcccgggcccacaccagcaccccccgggagatcggcctgcggacctgtgagcagctgctgcagtgcttcggccacggccagagcctggccctgcaccacttccagcagctgtggggctacctgctggagtggcaggccatcttcaacaagtttgatgaggacaccagcggcaccatgaacagctatgagctgcggctggccctgaatgctgctggcttccacctgaacaaccagctgacccagaccctgaccagccgctacagagacagccggctgcgggtggactttgaaagatttgtgtcctgtgtggcccacctgacctgcatcttctgccactgcagccagcacctggatggaggagaaggagtcatctgcctgacccaccggcagtggatggaggtggccaccttctcctag

SEQ ID NO: 145986 - DNA, 2448 bp, Artificial Sequence
  Description of Artificial Sequence: Synthetic coding sequence
atgcccaccgtcatcagcgcctctgtggcccccaggacagctgctgagcccaggagccctggccctgtgccccacccagcccagagcaaggccacagaggccggcggcggcaaccccagcggcatctacagcgccatcatcagcaggaacttccccatcatcggcgtgaaggagaagacctttgagcagctgcacaagaagtgcctggagaagaaggtgctgtatgtggaccctgagttccccccagatgagaccagcctcttctacagccagaagttccccatccagtttgtgtggaagaggcctcctgagatctgtgagaacccccgcttcatcattgatggagccaacagaacagacatctgccagggcgagctgggggactgctggttcctggccgccatcgcctgcctgaccctgaaccagcacctgctcttccgggtcatcccccatgaccagagcttcattgaaaattatgccggcatcttccacttccagttctggaggtatggagagtgggtggatgtggtgattgatgactgcctgcccacctacaacaaccagctggtgttcaccaagagcaaccacagaaatgagttctggagcgccctgctggagaaggcctatgccaagctgcacggcagctatgaggccctgaagggcggcaacaccacagaggccatggaggacttcaccggcggcgtggccgagttctttgagatcagagatgcccccagcgacatgtacaagatcatgaagaaggccatcgagcggggcagcctgatgggctgcagcattgatgatggcaccaacatgacctacggcaccagccccagcggcctgaacatgggagagctgattgccaggatggtgaggaacatggacaacagcctgctgcaggacagcgacctggacccccggggcagtgatgagcggcccaccaggaccatcatccctgtgcagtatgagaccaggatggcctgtggcctggtgcggggccacgcctacagcgtgacaggcctggatgaggtgcccttcaagggggagaaggtgaagctggtgcggctgaggaacccctggggccaggtggagtggaatggctcctggagcgaccgctggaaggactggagctttgtggacaaggatgagaaggcccggctgcagcaccaggtgacagaagatggagagttctggatgtcctatgaggacttcatctaccacttcaccaagctggagatctgcaacctgacagcagatgccctgcagagcgacaagctgcagacctggacagtgtctgtgaatgaaggccgctgggtgcggggctgcagcgctgggggctgcaggaacttcccagacaccttctggaccaacccccagtaccgcctgaagctgctggaggaggatgatgatcctgatgacagcgaggtgatctgcagcttcctggtggccctgatgcagaagaacagaaggaaggacaggaagctgggcgccagcctcttcaccatcggctttgccatctatgaggtgccccaccagatgcacggcaacaagcagcacctgcagaaggacttcttcctgtacaatgccagcaaggcccggagcaagacctacatcaacatgagggaggtgtcccagcgcttccggctgcccccatctgaatatgtgattgtgcccagcacctatgagccccaccaggagggggagttcatcctgcgggtcttcagcgagaagaggaacctgtctgaggaggtggagaacaccatctctgtggacaggcctgtgcccatcatctttgtgtctgaccgggccaacagcaacaaggagctgggcgtggaccaggagagcgaggagggcaagggcaagaccagcccagacaagcagaagcagagcccccagccccagcccggcagcagtgaccaggagagcgaggagcagcagcagttcaggaacatcttcaagcagattgctggagatgacatggagatctgtgctgatgagctgaagaaggtgctgaacacagtggtgaacaagcacaaggacctgaagacccacggcttcaccctggagagctgccgctccatgattgccctgatggacacagatggcagcggcaagctgaacctgcaggagttccaccacctgtggaacaagatcaaggcctggcagaagatcttcaagcactatgacacagaccagagcggcaccatcaacagctatgagatgagaaatgctgtgaatgatgctggcttccacctgaacaaccagctgtatgacatcatcaccatgagatatgctgacaagcacatgaacatcgactttgacagcttcatctgctgctttgtgcggctggagggcatgttccgggccttccacgcctttgacaaggatggagatggcatcatcaagctgaatgtgctggagtggctgcagctgaccatgtatgcctag

SEQ ID NO: 145987 - DNA, 930 bp, Artificial Sequence
  Description of Artificial Sequence: Synthetic coding sequence
atgcacggcaacaagcagcacctgcagaaggacttcttcctgtacaatgccagcaaggcccggagcaagacctacatcaacatgagggaggtgtcccagcgcttccggctgcccccatctgaatatgtgattgtgcccagcacctatgagccccaccaggagggggagttcatcctgcgggtcttcagcgagaagaggaacctgtctgaggaggtggagaacaccatctctgtggacaggcctgtgaggaaggagacctacaagcccatcatctttgtgtctgaccgggccaacagcaacaaggagctgggcgtggaccaggagagcgaggagggcaagggcaagaccagcccagacaagcagaagcagagcccccagccccagcccggcagcagtgaccaggagagcgaggagcagcagcagttcaggaacatcttcaagcagattgctggagatgacatggagatctgtgctgatgagctgaagaaggtgctgaacacagtggtgaacaagcacaaggacctgaagacccacggcttcaccctggagagctgccgctccatgattgccctgatggacacagatggcagcggcaagctgaacctgcaggagttccaccacctgtggaacaagatcaaggcctggcagaagatcttcaagcactatgacacagaccagagcggcaccatcaacagctatgagatgagaaatgctgtgaatgatgctggcttccacctgaacaaccagctgtatgacatcatcaccatgagatatgctgacaagcacatgaacatcgactttgacagcttcatctgctgctttgtgcggctggagggcatgttccgggccttccacgcctttgacaaggatggagatggcatcatcaagctgaatgtgctggagtggctgcagctgaccatgtatgcctag

SEQ ID NO: 145988 - DNA, 471 bp, Artificial Sequence
  Description of Artificial Sequence: Synthetic coding sequence
atggagatctgtgctgatgagctgaagaaggtgctgaacacagtggtgaacaagcacaaggacctgaagacccacggcttcaccctggagagctgccgctccatgattgccctgatggacacagatggcagcggcaagctgaacctgcaggagttccaccacctgtggaacaagatcaaggcctggcagaagatcttcaagcactatgacacagaccagagcggcaccatcaacagctatgagatgagaaatgctgtgaatgatgctggcttccacctgaacaaccagctgtatgacatcatcaccatgagatatgctgacaagcacatgaacatcgactttgacagcttcatctgctgctttgtgcggctggagggcatgttccgggccttccacgcctttgacaaggatggagatggcatcatcaagctgaatgtgctggagtggctgcagctgaccatgtatgcctag

SEQ ID NO: 145989 - DNA, 2190 bp, Artificial Sequence
  Description of Artificial Sequence: Synthetic coding sequence
atgcccaccgtcatcagcgcctctgtggcccccaggacagctgctgagcccaggagccctggccctgtgccccacccagcccagagcaaggccacagaggccggcggcggcaaccccagcggcatctacagcgccatcatcagcaggaacttccccatcatcggcgtgaaggagaagacctttgagcagctgcacaagaagtgcctggagaagaaggtgctgtatgtggaccctgagttccccccagatgagaccagcctcttctacagccagaagttccccatccagtttgtgtggaagaggcctcctgagatctgtgagaacccccgcttcatcattgatggagccaacagaacagacatctgccagggcgagctgggggactgctggttcctggccgccatcgcctgcctgaccctgaaccagcacctgctcttccgggtcatcccccatgaccagagcttcattgaaaattatgccggcatcttccacttccagttctggaggtatggagagtgggtggatgtggtgattgatgactgcctgcccacctacaacaaccagctggtgttcaccaagagcaaccacagaaatgagttctggagcgccctgctggagaaggcctatgccaagctgcacggcagctatgaggccctgaagggcggcaacaccacagaggccatggaggacttcaccggcggcgtggccgagttctttgagatcagagatgcccccagcgacatgtacaagatcatgaagaaggccatcgagcggggcagcctgatgggctgcagcattgacaccatcatccctgtgcagtatgagaccaggatggcctgtggcctggtgcggggccacgcctacagcgtgacaggcctggatgaggtgcccttcaagggggagaaggtgaagctggtgcggctgaggaacccctggggccaggtggagtggaatggctcctggagcgaccgctggaaggactggagctttgtggacaaggatgagaaggcccggctgcagcaccaggtgacagaagatggagagttctggatgtcctatgaggacttcatctaccacttcaccaagctggagatctgcaacctgacagcagatgccctgcagagcgacaagctgcagacctggacagtgtctgtgaatgaaggccgctgggtgcggggctgcagcgctgggggctgcaggaacttcccagacaccttctggaccaacccccagtaccgcctgaagctgctggaggaggatgatgatcctgatgacagcgaggtgatctgcagcttcctggtggccctgatgcagaagaacagaaggaaggacaggaagctgggcgccagcctcttcaccatcggctttgccatctatgaggtgcccaaggagatgcacggcaacaagcagcacctgcagaaggacttcttcctgtacaatgccagcaaggcccggagcaagacctacatcaacatgagggaggtgtcccagcgcttccggctgcccccatctgaatatgtgattgtgcccagcacctatgagccccaccaggagggggagttcatcctgcgggtcttcagcgagaagaggaacctgtctgaggaggtggagaacaccatctctgtggacaggcctgtgccccagcccggcagcagtgaccaggagagcgaggagcagcagcagttcaggaacatcttcaagcagattgctggagatgacatggagatctgtgctgatgagctgaagaaggtgctgaacacagtggtgaacaagcacaaggacctgaagacccacggcttcaccctggagagctgccgctccatgattgccctgatggacacagatggcagcggcaagctgaacctgcaggagttccaccacctgtggaacaagatcaaggcctggcagaagatcttcaagcactatgacacagaccagagcggcaccatcaacagctatgagatgagaaatgctgtgaatgatgctggcttccacctgaacaaccagctgtatgacatcatcaccatgagatatgctgacaagcacatgaacatcgactttgacagcttcatctgctgctttgtgcggctggagggcatgttccgggccttccacgcctttgacaaggatggagatggcatcatcaagctgaatgtgctggagtggctgcagctgaccatgtatgcctag

SEQ ID NO: 145990 - DNA, 2187 bp, Artificial Sequence
  Description of Artificial Sequence: Synthetic coding sequence
atgtcctggcagatcagcctgaagacccagaccacccagcagaagaatgagatctgtgagaacccccgcttcatcattgatggagccaacagaacagacatctgccagggcgagctgggggactgctggttcctggccgccatcgcctgcctgaccctgaaccagcacctgctcttccgggtcatcccccatgaccagagcttcatcgagaactatgccggcatcttccacttccagttctggaggtatggagagtgggtggatgtggtgattgatgactgcctgcccacctacaacaaccagctggtgttcaccaagagcaaccacagaaatgagttctggagcgccctgctggagaaggcctatgccaagctgcacggcagctatgaggccctgaagggcggcaacaccacagaggccatggaggacttcaccggaggagtggccgagttctttgagatcagagatgcccccagcgacatgtacaagatcatgaagaaggccatcgagcggggcagcctgatgggctgcagcattgatgatggcaccaacatgacctacggcaccagccccagcggcctgaacatgggagagctgattgccaggatggtgaggaacatggacaacagcctgctgcaggacagcgacctggacccccggggcagtgatgagcggcccaccaggaccatcatccctgtgcagtatgagaccaggatggcctgtggcctggtgcggggccacgcctacagcgtgacaggcctggatgaggtgcccttcaagggggagaaggtgaagctggtgcggctgaggaacccctggggccaggtggagtggaatggctcctggagcgaccgctggaaggactggagctttgtggacaaggatgagaaggcccggctgcagcaccaggtgacagaagatggagagttctggatgtcctatgaggacttcatctaccacttcaccaagctggagatctgcaacctgacagcagatgccctgcagagcgacaagctgcagacctggacagtgtctgtgaatgaaggccgctgggtgcggggctgcagcgctgggggctgcaggaacttcccagacaccttctggaccaacccccagtaccgcctgaagctgctggaggaggatgatgatcctgatgattctgaggtgatctgcagcttcctggtggccctgatgcagaagaacagaaggaaggacaggaagctgggcgccagcctcttcaccatcggctttgccatctatgaggtgcccaaggagatgcacggcaacaagcagcacctgcagaaggacttcttcctgtacaatgccagcaaggcccggagcaagacctacatcaacatgagggaggtgtcccagcgcttccggctgcccccatctgaatatgtgattgtgcccagcacctatgagccccaccaggagggggagttcatcctgcgggtcttcagcgagaagaggaacctgtctgaggaggtggagaacaccatctctgtggacaggcctgtgcccatcatctttgtgtctgaccgggccaacagcaacaaggagctgggcgtggaccaggagagcgaggagggcaagggcaagaccagcccagacaagcagaagcagagcccccagccccagcccggcagcagtgaccaggagagcgaggagcagcagcagttcaggaacatcttcaagcagattgctggagatgacatggagatctgtgctgatgagctgaagaaggtgctgaacacagtggtgaacaagcacaaggacctgaagacccacggcttcaccctggagagctgccgctccatgattgccctgatggacacagatggcagcggcaagctgaacctgcaggagttccaccacctgtggaacaagatcaaggcctggcagaagatcttcaagcactatgacacagaccagagcggcaccatcaacagctatgagatgagaaatgctgtgaatgatgctggcttccacctgaacaaccagctgtatgacatcatcaccatgagatatgctgacaagcacatgaacatcgactttgacagcttcatctgctgctttgtgcggctggagggcatgttccgggccttccacgcctttgacaaggatggagatggcatcatcaagctgaatgtgctggagtggctgcagctgaccatgtatgcctag

SEQ ID NO: 145991 - DNA, 2448 bp, Artificial Sequence
  Description of Artificial Sequence: Synthetic coding sequence
atgcccaccgtcatcagcgcctctgtggcccccaggacagctgctgagcccaggagccctggccctgtgccccacccagcccagagcaaggccacagaggccggcggcggcaaccccagcggcatctacagcgccatcatcagcaggaacttccccatcatcggcgtgaaggagaagacctttgagcagctgcacaagaagtgcctggagaagaaggtgctgtatgtggaccctgagttccccccagatgagaccagcctcttctacagccagaagttccccatccagtttgtgtggaagaggcctcctgagatctgtgagaacccccgcttcatcattgatggagccaacagaacagacatctgccagggcgagctgggggactgctggttcctggccgccatcgcctgcctgaccctgaaccagcacctgctcttccgggtcatcccccatgaccagagcttcattgaaaattatgccggcatcttccacttccagttctggaggtatggagagtgggtggatgtggtgattgatgactgcctgcccacctacaacaaccagctggtgttcaccaagagcaaccacagaaatgagttctggagcgccctgctggagaaggcctatgccaagctgcacggcagctatgaggccctgaagggcggcaacaccacagaggccatggaggacttcaccggcggcgtggccgagttctttgagatcagagatgcccccagcgacatgtacaagatcatgaagaaggccatcgagcggggcagcctgatgggctgcagcattgatgatggcaccaacatgacctacggcaccagccccagcggcctgaacatgggagagctgattgccaggatggtgaggaacatggacaacagcctgctgcaggacagcgacctggacccccggggcagtgatgagcggcccaccaggaccatcatccctgtgcagtatgagaccaggatggcctgtggcctggtgcggggccacgcctacagcgtgacaggcctggatgaggtgcccttcaagggggagaaggtgaagctggtgcggctgaggaacccctggggccaggtggagtggaatggctcctggagcgaccgctggaaggactggagctttgtggacaaggatgagaaggcccggctgcagcaccaggtgacagaagatggagagttctggatgtcctatgaggacttcatctaccacttcaccaagctggagatctgcaacctgacagcagatgccctgcagagcgacaagctgcagacctggacagtgtctgtgaatgaaggccgctgggtgcggggctgcagcgctgggggctgcaggaacttcccagacaccttctggaccaacccccagtaccgcctgaagctgctggaggaggatgatgatcctgatgacagcgaggtgatctgcagcttcctggtggccctgatgcagaagaacagaaggaaggacaggaagctgggcgccagcctcttcaccatcggctttgccatctatgaggtgcccaaggagatgcacggcaacaagcagcacctgcagaaggacttcttcctgtacaatgccagcaaggcccggagcaagacctacatcaacatgagggaggtgtcccagcgcttccggctgcccccatctgaatatgtgattgtgcccagcacctatgagccccaccaggagggggagttcatcctgcgggtcttcagcgagaagaggaacctgtctgaggaggtggagaacaccatctctgtggacaggcctgtgcccatcatctttgtgtctgaccgggccaacagcaacaaggagctgggcgtggaccaggagagcgaggagggcaagggcaagaccagcccagacaagcagaagcagagcccccagccccagcccggcagcagtgaccaggagagcgaggagcagcagcagttcaggaacatcttcaagcagattgctggagatgacatggagatctgtgctgatgagctgaagaaggtgctgaacacagtggtgaacaagcacaaggacctgaagacccacggcttcaccctggagagctgccgctccatgattgccctgatggacacagatggcagcggcaagctgaacctgcaggagttccaccacctgtggaacaagatcaaggcctggcagaagatcttcaagcactatgacacagaccagagcggcaccatcaacagctatgagatgagaaatgctgtgaatgatgctggcttccacctgaacaaccagctgtatgacatcatcaccatgagatatgctgacaagcacatgaacatcgactttgacagcttcatctgctgctttgtgcggctggagggcatgttccgggccttccacgcctttgacaaggatggagatggcatcatcaagctgaatgtgctggagtggctgcagctgaccatgtatgcctag

SEQ ID NO: 145992 - DNA, 2466 bp, Artificial Sequence
  Description of Artificial Sequence: Synthetic coding sequence
atgcccaccgtcatcagcgcctctgtggcccccaggacagctgctgagcccaggagccctggccctgtgccccacccagcccagagcaaggccacagaggccggcggcggcaaccccagcggcatctacagcgccatcatcagcaggaacttccccatcatcggcgtgaaggagaagacctttgagcagctgcacaagaagtgcctggagaagaaggtgctgtatgtggaccctgagttccccccagatgagaccagcctcttctacagccagaagttccccatccagtttgtgtggaagaggcctcctgagatctgtgagaacccccgcttcatcattgatggagccaacagaacagacatctgccagggcgagctgggggactgctggttcctggccgccatcgcctgcctgaccctgaaccagcacctgctcttccgggtcatcccccatgaccagagcttcattgaaaattatgccggcatcttccacttccagttctggaggtatggagagtgggtggatgtggtgattgatgactgcctgcccacctacaacaaccagctggtgttcaccaagagcaaccacagaaatgagttctggagcgccctgctggagaaggcctatgccaagctgcacggcagctatgaggccctgaagggcggcaacaccacagaggccatggaggacttcaccggcggcgtggccgagttctttgagatcagagatgcccccagcgacatgtacaagatcatgaagaaggccatcgagcggggcagcctgatgggctgcagcattgatgatggcaccaacatgacctacggcaccagccccagcggcctgaacatgggagagctgattgccaggatggtgaggaacatggacaacagcctgctgcaggacagcgacctggacccccggggcagtgatgagcggcccaccaggaccatcatccctgtgcagtatgagaccaggatggcctgtggcctggtgcggggccacgcctacagcgtgacaggcctggatgaggtgcccttcaagggggagaaggtgaagctggtgcggctgaggaacccctggggccaggtggagtggaatggctcctggagcgaccgctggaaggactggagctttgtggacaaggatgagaaggcccggctgcagcaccaggtgacagaagatggagagttctggatgtcctatgaggacttcatctaccacttcaccaagctggagatctgcaacctgacagcagatgccctgcagagcgacaagctgcagacctggacagtgtctgtgaatgaaggccgctgggtgcggggctgcagcgctgggggctgcaggaacttcccagacaccttctggaccaacccccagtaccgcctgaagctgctggaggaggatgatgatcctgatgacagcgaggtgatctgcagcttcctggtggccctgatgcagaagaacagaaggaaggacaggaagctgggcgccagcctcttcaccatcggctttgccatctatgaggtgcccaaggagatgcacggcaacaagcagcacctgcagaaggacttcttcctgtacaatgccagcaaggcccggagcaagacctacatcaacatgagggaggtgtcccagcgcttccggctgcccccatctgaatatgtgattgtgcccagcacctatgagccccaccaggagggggagttcatcctgcgggtcttcagcgagaagaggaacctgtctgaggaggtggagaacaccatctctgtggacaggcctgtgaagaagaagaagaccaagcccatcatctttgtgtctgaccgggccaacagcaacaaggagctgggcgtggaccaggagagcgaggagggcaagggcaagaccagcccagacaagcagaagcagagcccccagccccagcccggcagcagtgaccaggagagcgaggagcagcagcagttcaggaacatcttcaagcagattgctggagatgacatggagatctgtgctgatgagctgaagaaggtgctgaacacagtggtgaacaagcacaaggacctgaagacccacggcttcaccctggagagctgccgctccatgattgccctgatggacacagatggcagcggcaagctgaacctgcaggagttccaccacctgtggaacaagatcaaggcctggcagaagatcttcaagcactatgacacagaccagagcggcaccatcaacagctatgagatgagaaatgctgtgaatgatgctggcttccacctgaacaaccagctgtatgacatcatcaccatgagatatgctgacaagcacatgaacatcgactttgacagcttcatctgctgctttgtgcggctggagggcatgttccgggccttccacgcctttgacaaggatggagatggcatcatcaagctgaatgtgctggagtggctgcagctgaccatgtatgcctag

SEQ ID NO: 145993 - DNA, 930 bp, Artificial Sequence
  Description of Artificial Sequence: Synthetic coding sequence
atgcacggcaacaagcagcacctgcagaaggacttcttcctgtacaatgccagcaaggcccggagcaagacctacatcaacatgagggaggtgtcccagcgcttccggctgcccccatctgaatatgtgattgtgcccagcacctatgagccccaccaggagggggagttcatcctgcgggtcttcagcgagaagaggaacctgtctgaggaggtggagaacaccatctctgtggacaggcctgtgaagaagaagaagaccaagcccatcatctttgtgtctgaccgggccaacagcaacaaggagctgggcgtggaccaggagagcgaggagggcaagggcaagaccagcccagacaagcagaagcagagcccccagccccagcccggcagcagtgaccaggagagcgaggagcagcagcagttcaggaacatcttcaagcagattgctggagatgacatggagatctgtgctgatgagctgaagaaggtgctgaacacagtggtgaacaagcacaaggacctgaagacccacggcttcaccctggagagctgccgctccatgattgccctgatggacacagatggcagcggcaagctgaacctgcaggagttccaccacctgtggaacaagatcaaggcctggcagaagatcttcaagcactatgacacagaccagagcggcaccatcaacagctatgagatgagaaatgctgtgaatgatgctggcttccacctgaacaaccagctgtatgacatcatcaccatgagatatgctgacaagcacatgaacatcgactttgacagcttcatctgctgctttgtgcggctggagggcatgttccgggccttccacgcctttgacaaggatggagatggcatcatcaagctgaatgtgctggagtggctgcagctgaccatgtatgcctag

SEQ ID NO: 145994 - DNA, 471 bp, Artificial Sequence; identical to SEQ ID NO: 145988
  Description of Artificial Sequence: Synthetic coding sequence

SEQ ID NO: 145995 - DNA, 1923 bp, Artificial Sequence
  Description of Artificial Sequence: Synthetic coding sequence
atgttcagctgtgtgaagccctatgaggaccagaactacagcgccctgcggcgggactgcagaagaaggaaggtgctgtttgaggaccccctcttccctgccacagatgacagcctgtactacaagggcaccccaggccctgctgtgcgctggaagaggcccaagggcatctgtgaggacccccggctgtttgtggatggcatcagcagccatgacctgcaccagggccaggtgggcaactgctggtttgtggccgcctgcagcagcctggccagccgggagagcctgtggcagaaggtgatcccagactggaaggagcaggagtgggaccctgagaagcccaatgcctatgccggcatcttccacttccacttctggaggtttggagagtgggtggatgtggtgattgatgaccggctgcccaccgtgaacaaccagctgatctactgccacagcaacagcagaaatgagttctggtgtgccctggtggagaaggcctatgccaagctggccggctgctaccaggccctggatggcggcaacacagcagatgccctggtggacttcaccggcggcgtgtctgagcccatcgacctgacagaaggagactttgccaatgatgagaccaagaggaaccagctgtttgagaggatgctgaaggtgcacagcagaggaggcctcatcagcgccagcatcaaggctgtgacagctgctgacatggaggcccggctggcctgtggcctggtgaagggccacgcctatgctgtgacagatgtgaggaaggtgcggctgggccacggcctgctggccttcttcaagtctgagaagctggacatgatccggctgaggaacccctggggcgagcgggagtggaatggcccctggagcgacaccagcgaggagtggcagaaggtgtccaagtctgagcgggagaagatgggcgtgacagtgcaggatgatggagagttctggatgacctttgaagatgtgtgccgctacttcacagacatcatcaagtgcagggtcatcaacaccagccacctgagcatccacaagacctgggaggaggcccggctgcacggggcctggaccctgcacgaggacccccggcagaacagaggaggcggctgcatcaaccacaaggacaccttcttccagaacccccagtacatctttgaggtgaagaagccagaagatgaggtgctgatctgcatccagcagaggcccaagaggagcacccggcgggagggcaagggggagaacctggccatcggctttgacatctacaaggtggaggagaaccggcagtacaggatgcacagcctgcagcacaaggccgccagcagcatctacatcaacagccgcagcgtcttcctgaggacagaccagcctgagggccgctacgtgatcatccccaccacctttgagcccggccacactggagagttcctgctgcgggtcttcacagatgtgcccagcaactgccgggagctgcggctggatgagcccccccacacctgctggagcagcctgtgtggctacccccagctggtgacccaggtgcacgtgctgggcgctgctggcctgaaggacagccccaccggggccaacagctatgtgatcatcaagtgtgagggggacaaggtgcgctctgctgtgcagaagggcaccagcaccccagagtacaacgtgaagggcatcttctacaggaagaagctgagccagcccatcaccgtgcaggtgtggaaccaccgggtgctgaaggatgagttcctgggccaggtgcacctgaaggctgaccctgacaacctgcaggccctgcacaccctgcacctgcgggacaggaacagccggcagcccagcaacctgcccggcaccgtggccgtgcacatcctgagcagcaccagcctgatggctgtgtag

SEQ ID NO: 145996 - DNA, 2043 bp, Artificial Sequence
  Description of Artificial Sequence: Synthetic coding sequence
atgagctgcaccggcacccccagctgcatctacctgctgagcgccctgagcctgcaggacctggtgctggactgggagccccggggcgtgcccccacccctgcctggagctgctgccaccatgttcagctgtgtgaagccctatgaggaccagaactacagcgccctgcggcgggactgcagaagaaggaaggtgctgtttgaggaccccctcttccctgccacagatgacagcctgtactacaagggcaccccaggccctgctgtgcgctggaagaggcccaagggcatctgtgaggacccccggctgtttgtggatggcatcagcagccatgacctgcaccagggccaggtgggcaactgctggtttgtggccgcctgcagcagcctggccagccgggagagcctgtggcagaaggtgatcccagactggaaggagcaggagtgggaccctgagaagcccaatgcctatgccggcatcttccacttccacttctggaggtttggagagtgggtggatgtggtgattgatgaccggctgcccaccgtgaacaaccagctgatctactgccacagcaacagcagaaatgagttctggtgtgccctggtggagaaggcctatgccaagctggccggctgctaccaggccctggatggcggcaacacagcagatgccctggtggacttcaccggcggcgtgtctgagcccatcgacctgacagaaggagactttgccaatgatgagaccaagaggaaccagctgtttgagaggatgctgaaggtgcacagcagaggaggcctcatcagcgccagcatcaaggctgtgacagctgctgacatggaggcccggctggcctgtggcctggtgaagggccacgcctatgctgtgacagatgtgaggaaggtgcggctgggccacggcctgctggccttcttcaagtctgagaagctggacatgatccggctgaggaacccctggggcgagcgggagtggaatggcccctggagcgacaccagcgaggagtggcagaaggtgtccaagtctgagcgggagaagatgggcgtgacagtgcaggatgatggagagttctggatgacctttgaagatgtgtgccgctacttcacagacatcatcaagtgcagggtcatcaacaccagccacctgagcatccacaagacctgggaggaggcccggctgcacggggcctggaccctgcacgaggacccccggcagaacagaggaggcggctgcatcaaccacaaggacaccttcttccagaacccccagtacatctttgaggtgaagaagccagaagatgaggtgctgatctgcatccagcagaggcccaagaggagcacccggcgggagggcaagggggagaacctggccatcggctttgacatctacaaggtggaggagaaccggcagtacaggatgcacagcctgcagcacaaggccgccagcagcatctacatcaacagccgcagcgtcttcctgaggacagaccagcctgagggccgctacgtgatcatccccaccacctttgagcccggccacactggagagttcctgctgcgggtcttcacagatgtgcccagcaactgccgggagctgcggctggatgagcccccccacacctgctggagcagcctgtgtggctacccccagctggtgacccaggtgcacgtgctgggcgctgctggcctgaaggacagccccaccggggccaacagctatgtgatcatcaagtgtgagggggacaaggtgcgctctgctgtgcagaagggcaccagcaccccagagtacaacgtgaagggcatcttctacaggaagaagctgagccagcccatcaccgtgcaggtgtggaaccaccgggtgctgaaggatgagttcctgggccaggtgcacctgaaggctgaccctgacaacctgcaggccctgcacaccctgcacctgcgggacaggaacagccggcagcccagcaacctgcccggcaccgtggccgtgcacatcctgagcagcaccagcctgatggctgtgtag

SEQ ID NO: 145997 - DNA, 294 bp, Artificial Sequence
  Description of Artificial Sequence: Synthetic coding sequence
atgttcagctgtgtgaagccctatgaggaccagaactacagcgccctgcggcgggactgcagaagaaggaaggtgctgtttgaggaccccctcttccctgccacagatgacagcctgtactacaagggcaccccaggccctgctgtgcgctggaagaggcccaagggcatctgtgaggacccccggctgtttgtggatggcatcagcagccatgacctgcaccagggccaggtgggcaactgctggtttgtggccgcctgcagcagcctggccagccgggagagcctgtggtag

SEQ ID NO: 145998 - DNA, 1923 bp, Artificial Sequence; identical to SEQ ID NO: 145995
  Description of Artificial Sequence: Synthetic coding sequence

SEQ ID NO: 145999 - DNA, 1674 bp, Artificial Sequence
  Description of Artificial Sequence: Synthetic coding sequence
atgttcagctgtgtgaagccctatgaggaccagaactacagcgccctgcggcgggactgcagaagaaggaaggtgctgtttgaggaccccctcttccctgccacagatgacagcctgtactacaagggcaccccaggccctgctgtgcgctggaagaggcccaagtacagcggccacagcctggccccccaccggcccggctggggagatgcccggaggatggagaatgtgccccggcccggcagcagcggctgccccagcagcagcctgcgggcccgggacctgggcatctgtgaggacccccggctgtttgtggatggcatcagcagccatgacctgcaccagggccaggtgggcaactgctggtttgtggccgcctgcagcagcctggccagccgggagagcctgtggcagaaggtgatcccagactggaaggagcaggagtgggaccctgagaagcccaatgcctatgccggcatcttccacttccacttctggaggtttggagagtgggtggatgtggtgattgatgaccggctgcccaccgtgaacaaccagctgatctactgccacagcaacagcagaaatgagttctggtgtgccctggtggagaaggcctatgccaagctggccggctgctaccaggccctggatggcggcaacacagcagatgccctggtggacttcaccggcggcgtgtctgagcccatcgacctgacagaaggagactttgccaatgatgagaccaagaggaaccagctgtttgagaggatgctgaaggtgcacagcagaggaggcctcatcagcgccagcatcaaggctgtgacagctgctgacatggaggcccggctggcctgtggcctggtgaagggccacgcctatgctgtgacagatgtgaggaaggtgcggctgggccacggcctgctggccttcttcaagtctgagaagctggacatgatccggctgaggaacccctggggcgagcgggagtggaatggcccctggagcgacaccagcgaggagtggcagaaggtgtccaagtctgagcgggagaagatgggcgtgacagtgcaggatgatggagagttctggatgacctttgaagatgtgtgccgctacttcacagacatcatcaagtgcagggtcatcaacaccagccacctgagcatccacaagacctgggaggaggcccggctgcacggggcctggaccctgcacgaggacccccggcagaacagaggaggcggctgcatcaaccacaaggacaccttcttccagaacccccagtacatctttgaggtgaagaagccagaagatgaggtgctgatctgcatccagcagaggcccaagaggagcacccggcgggagggcaagggggagaacctggccatcggctttgacatctacaaggtggaggagaaccggcagtacaggatgcacagcctgcagcacaaggccgccagcagcatctacatcaacagccgcagcgtcttcctgaggacagaccagcctgagggccgctacgtgatcatccccaccacctttgagcccggccacactggagagttcctgctgcgggtcttcacagatgtgcccagcaactgccgggagctgcggctggatgagcccccccacacctgctggagcagcctgtgtggctacccccagtggtag

SEQ ID NO: 146000 - DNA, 2442 bp, Artificial Sequence
  Description of Artificial Sequence: Synthetic coding sequence
atggatgccacagccctggagagagatgctgtgcagtttgcccggctggccgtgcagagggaccacgagggccgctacagcgaggccgtgttctactacaaggaggccgcccaggccctgatctatgcagagatggccggcagcagcctggagaacatccaggagaagatcacagagtacctggagcgggtgcaggccctgcacagcgctgtgcagagcaagtctgctgaccccctgaagagcaagcaccagctggacctggagcgggcccacttcctggtgacccaggcctttgatgaagatgagaaggaaaatgtggaggatgccatcgagctgtacacagaggccgtggacctgtgcctgaagaccagctatgaaacagctgacaaggtgctgcagaacaagctgaagcagctggcccggcaggccctggacagagctgaggccctgtctgagcccctgaccaagcctgtgggcaagatcagcagcacctctgtgaagcccaagcccccacctgtgcgggcccacttccccctgggcgccaaccccttcctggagcggccccagagcttcatcagcccccagagctgtgatgcccagggccagcgctacacagctgaggagattgaggtgctgcggaccaccagcaagatcaatggaattgaatatgtgcccttcatgaatgtggacctgcgggagagatttgcctaccccatgcccttctgtgaccgctggggcaagctgcccctgagccccaagcagaagaccaccttcagcaagtgggtgcggcctgaggacctgaccaacaaccccaccatgatctacacagtgtcctccttcagcatcaagcagaccatcgtgtctgactgcagctttgtggccagcctggccatctctgctgcctatgaaagacgcttcaacaagaagctgatcaccggcatcatctacccccagaacaaggatggagagcctgagtacaacccctgtgggaagtacatggtgaagctgcacctgaatggagtgcccaggaaggtgatcattgatgaccagctgcctgtggaccacaagggggagctgctgtgcagctacagcaacaacaagtctgagctgtgggtgtccctgattgagaaggcctacatgaaggtgatgggcggctatgacttccctggcagcaacagcaacatcgacctgcacgccctgaccggctggatccctgagcgcatcgccatgcacagcgacagccagaccttcagcaaggacaacagcttcaggatgctgtaccagcgcttccacaagggagatgtgctgatcacagccagcacaggcatgatgacagaagctgagggggagaagtggggcctggtgcccacccacgcctatgctgtgctggacatccgggagttcaagggcctgcgcttcatccagctgaagaacccctggagccacctgcgctggaagggccgctacagtgaaaatgatgtgaagaactggaccccagagctgcagaagtacctgaactttgaccccaggacagcccagaagattgacaatggcatcttctggatctcctgggatgacctgtgccagtactatgatgtgatctacctgtcctggaaccctggcctcttcaaggagagcacctgcatccacagcacctgggatgccaagcagggccctgtgaaggatgcctacagcctggccaacaacccccagtacaagctggaggtgcagtgcccccagggcggcgctgctgtgtgggtgctgctgagccgccacatcacagacaaggatgactttgccaacaaccgggagttcatcaccatggtggtgtacaagacagatggcaagaaggtgtactacccagctgaccccccaccctacattgatggcatccgcatcaacagcccccactacctgaccaagatcaagctgaccaccccaggcacccacaccttcaccctggtggtgtcccagtatgagaagcagaacaccatccactacacagtgcgggtgtacagcgcctgcagcttcaccttcagcaagatccccagcccctacaccctgagcaagaggatcaatggcaagtggagcggccagagcgctgggggctgcggcaacttccaggagacccacaagaacaaccccatctaccagttccacatcgagaagacaggccccctgctgattgagctgcggggcccccggcagtacagcgtgggctttgaggtggtgacagtgtccaccctgggggaccccggcccccacggcttcctgaggaagagcagcggggactaccgctgtggcttctgctacctggagctggagaacatccccagcggcatcttcaacatcatccccagcaccttcctgcccaagcaggagggccccttcttcctggacttcaacagcatcatccccatcaagatcacccagctgcagtag

SEQ ID NO: 146001 - DNA, 2073 bp, Artificial Sequence
  Description of Artificial Sequence: Synthetic coding sequence
atgccctacctgtaccgggcccctggcccccaggcccaccctgtgcccaaggatgcccgcatcacccacagcagcggccagagctttgagcagatgaggcaggagtgcctgcagaggggcaccctgtttgaagatgctgacttccctgccagcaacagcagcctcttctacagcgagcggccccagatcccctttgtgtggaagaggcctggagaaattgtgaagaaccctgagttcatcctgggcggggccaccaggacagacatctgccagggcgagctgggggactgctggctgctggccgccatcgccagcctgaccctgaaccagaaggccctggcccgggtcatcccccaggaccagagctttggacctggctacgccggcatcttccacttccagttctggcagcacagcgagtggctggatgtggtgattgatgaccggctgcccaccttccgggaccggctggtgttcctgcacagcgctgaccacaatgagttctggagcgccctgctggagaaggcctatgccaagctgaatggcagctatgaggccctgaagggcggcagcgccatcgaggccatggaggacttcaccggcggcgtggccgagaccttccagaccaaggaggcccctgagaacttctatgagatcctggagaaggccctgaagaggggcagcctgctgggctgcttcatcgacaccaggtctgctgctgagagcgaggcccggacccccttcggcctcatcaagggccacgcctacagcgtgactggaattgaccaggtgtccttccggggccagagaattgagctgatccgcatccggaacccctggggccaggtggagtggaatggctcctggagcgacagcagccctgagtggaggtctgtgggccctgctgagcagaagaggctgtgccacacagccctggatgatggagagttctggatggccttcaaggacttcaaggcccactttgacaaggtggagatctgcaacctgaccccagatgccctggaggaggatgccatccacaagtgggaggtgacagtgcaccagggctcctgggtgcggggcagcacagctgggggctgcaggaacttcctggacaccttctggaccaacccccagatcaagctgagcctgacagagaaggatgagggccaggaggagtgcagcttcctggtggccctgatgcagaaggacaggaggaagctgaagagatttggagccaacgtgctgaccatcggctacgccatctatgagtgcccagacaaggatgagcacctgaacaaggacttcttccgctaccacgccagccgggcccggagcaagaccttcatcaacctgcgggaggtgtctgaccgcttcaagctgcccccaggagagtacatcctgatccccagcacctttgagccccaccaggaggccgacttctgcctgcgcatcttcagcgagaagaaggccatcacccgggacatggatggaaatgtggacatcgacctgcctgagccccccaagcccaccccaccagaccaggagacagaggaggagcagcgcttccgggccctgtttgagcaggtggccggggaggacatggaggtgacagctgaggagctggagtatgtgctgaatgctgtgctgcagaagaagaaggacatcaagttcaagaagctgagcctcatcagctgcaagaacatcatcagcctgatggacaccagcggaaatggcaagctggagtttgatgagttcaaggtgttctgggacaagctgaagcagtggatcaacctcttcctgcgctttgatgctgacaagagcggcaccatgagcacctatgagctgaggacagccctgaaggctgctggcttccagctgagcagccacctgctgcagctgattgtgctgcgctatgcagatgaggagctgcagctggactttgatgacttcctgaactgcctggtgcggctggagaatgccagcagggtcttccaggccctgagcaccaagaacaaggagttcatccacctgaacatcaatgagttcatccacctgaccatgaacatctag

SEQ ID NO: 146002 - DNA, 1995 bp, Artificial Sequence
  Description of Artificial Sequence: Synthetic coding sequence
atgccctacctgtaccgggcccctggcccccaggcccaccctgtgcccaaggatgcccgcatcacccacagcagcggccagagctttgagcagatgaggcaggagtgcctgcagaggggcaccctgtttgaagatgctgacttccctgccagcaacagcagcctcttctacagcgagcggccccagatcccctttgtgtggaagaggcctggagaaattgtgaagaaccctgagttcatcctgggcggggccaccaggacagacatctgccagggcgagctgggggactgctggctgctggccgccatcgccagcctgaccctgaaccagaaggccctggcccgggtcatcccccaggaccagagctttggacctggctacgccggcatcttccacttccagttctggcagcacagcgagtggctggatgtggtgattgatgaccggctgcccaccttccgggaccggctggtgttcctgcacagcgctgaccacaatgagttctggagcgccctgctggagaaggcctatgccaagctgaatggcagctatgaggccctgaagggcggcagcgccatcgaggccatggaggacttcaccggcggcgtggccgagaccttccagaccaaggaggcccctgagaacttctatgagatcctggagaaggccctgaagaggggcagcctgctgggctgcttcatcgacaccaggtctgctgctgagagcgaggcccggacccccttcggcctcatcaagggccacgcctacagcgtgactggaattgaccaggtgtccttccggggccagagaattgagctgatccgcatccggaacccctggggccaggtggagtggaatggctcctggagcgacaggatggccttcaaggacttcaaggcccactttgacaaggtggagatctgcaacctgaccccagatgccctggaggaggatgccatccacaagtgggaggtgacagtgcaccagggctcctgggtgcggggcagcacagctgggggctgcaggaacttcctggacaccttctggaccaacccccagatcaagctgagcctgacagagaaggatgagggccaggaggagtgcagcttcctggtggccctgatgcagaaggacaggaggaagctgaagagatttggagccaacgtgctgaccatcggctacgccatctatgagtgcccagacaaggatgagcacctgaacaaggacttcttccgctaccacgccagccgggcccggagcaagaccttcatcaacctgcgggaggtgtctgaccgcttcaagctgcccccaggagagtacatcctgatccccagcacctttgagccccaccaggaggccgacttctgcctgcgcatcttcagcgagaagaaggccatcacccgggacatggatggaaatgtggacatcgacctgcctgagccccccaagcccaccccaccagaccaggagacagaggaggagcagcgcttccgggccctgtttgagcaggtggccggggaggacatggaggtgacagctgaggagctggagtatgtgctgaatgctgtgctgcagaagaagaaggacatcaagttcaagaagctgagcctcatcagctgcaagaacatcatcagcctgatggacaccagcggaaatggcaagctggagtttgatgagttcaaggtgttctgggacaagctgaagcagtggatcaacctcttcctgcgctttgatgctgacaagagcggcaccatgagcacctatgagctgaggacagccctgaaggctgctggcttccagctgagcagccacctgctgcagctgattgtgctgcgctatgcagatgaggagctgcagctggactttgatgacttcctgaactgcctggtgcggctggagaatgccagcagggtcttccaggccctgagcaccaagaacaaggagttcatccacctgaacatcaatgagttcatccacctgaccatgaacatctag

SEQ ID NO: 146003 - DNA, 1884 bp, Artificial Sequence
  Description of Artificial Sequence: Synthetic coding sequence
atgccctacctgtaccgggcccctggcccccaggcccaccctgtgcccaaggatgcccgcatcacccacagcagcggccagagctttgagcagatgaggcaggagtgcctgcagaggggcaccctgtttgaagatgctgacttccctgccagcaacagcagcctcttctacagcgagcggccccagatcccctttgtgtggaagaggcctggcttctggcagcacagcgagtggctggatgtggtgattgatgaccggctgcccaccttccgggaccggctggtgttcctgcacagcgctgaccacaatgagttctggagcgccctgctggagaaggcctatgccaagctgaatggcagctatgaggccctgaagggcggcagcgccatcgaggccatggaggacttcaccggaggagtggccgagaccttccagaccaaggaggcccctgagaacttctatgagatcctggagaaggccctgaagaggggcagcctgctgggctgcttcatcgacaccaggtctgctgctgagagcgaggcccggaccccatttggcctcatcaagggccacgcctacagcgtgacaggcatcgaccaggtgtccttccggggccagagaattgagctgatccgcatccggaacccctggggccaggtggagtggaatggctcctggagcgacagcagccctgagtggaggtctgtgggccctgctgagcagaagaggctgtgccacacagccctggatgatggagagttctggatggccttcaaggacttcaaggcccactttgacaaggtggagatctgcaacctgaccccagatgccctggaggaggatgccatccacaagtgggaggtgacagtgcaccagggctcctgggtgcggggcagcacagctgggggctgcaggaacttcctggacaccttctggaccaacccccagatcaagctgagcctgacagagaaggatgagggccaggaggagtgcagcttcctggtggccctgatgcagaaggacaggaggaagctgaagagatttggagccaacgtgctgaccatcggctacgccatctatgaatgtcctgacaaggatgagcacctgaacaaggacttcttccgctaccacgccagccgggcccggagcaagaccttcatcaacctgcgggaggtgtctgaccgcttcaagctgcccccaggagagtacatcctgatccccagcacctttgagccccaccaggaggccgacttctgcctgcgcatcttcagcgagaagaaggccatcacccgggacatggatggaaatgtggacatcgacctgcctgagccccccaagcccaccccaccagaccaggagacagaggaggagcagcgcttccgggccctgtttgagcaggtggccggggaggacatggaggtgacagctgaggagctggagtatgtgctgaatgctgtgctgcagaagaagaaggacatcaagttcaagaagctgagcctcatcagctgcaagaacatcatcagcctgatggacaccagcggaaatggcaagctggagtttgatgagttcaaggtgttctgggacaagctgaagcagtggatcaacctcttcctgcgctttgatgctgacaagagcggcaccatgagcacctatgagctgaggacagccctgaaggccgccggcttccagctgagcagccacctgctgcagctgattgtgctgcgctatgcagatgaggagctgcagctggactttgatgacttcctgaactgcctggtgcggctggagaatgccagcagggtcttccaggccctgagcaccaagaacaaggagttcatccacctgaacatcaatgagttcatccacctgaccatgaacatctag

SEQ ID NO: 146004 - DNA, 807 bp, Artificial Sequence
  Description of Artificial Sequence: Synthetic coding sequence
atgttcctggtgaacagcttcctgaagggcggcggcggcggcggcggcggcggcggcggcctgggcggcggcctgggcaatgtgctgggcggcctcatcagcggggccggcggcggcggcggcggcggcggcggcggcggcggcggcggcggcggcggcggcggcggcacagccatgaggatcctgggcggcgtcatcagcgccatcagcgaggccgccgcccagtacaaccctgagcccccaccacccaggacccactacagcaacatcgaggccaatgaaagtgaggaggtgcggcagttccggcggctgtttgcccagctggccggagatgacatggaggtgtctgccacagagctgatgaacatcctgaacaaggtggtgaccaggcacccagacctgaagacagatggctttggaattgacacctgccgctccatggtggccgtgatggacagcgacaccaccgggaagctgggctttgaggagttcaagtacctgtggaacaacatcaagcgctggcaggccatctacaagcagtttgacacagacaggagcggcaccatctgcagcagcgagctgcccggggcctttgaggccgccggcttccacctgaatgagcacctgtacaacatgatcatccgccgctacagtgatgaaagtggcaacatggactttgacaacttcatcagctgcctggtgcggctggatgccatgttccgggccttcaagagcctggacaaggatggcaccggccagatccaggtgaacatccaggagtggctgcagctgaccatgtacagctag

SEQ ID NO: 146005 - DNA, 2061 bp, Artificial Sequence
  Description of Artificial Sequence: Synthetic coding sequence
atgaaccccacagagaccaaggctgtgaagacagagcctgagaagaagagccagagcaccaagctgtctgtggtgcatgagaagaagagccaggagggcaagcccaaggagcacacagagcccaagagcctgcccaagcaggccagtgacaccggcagcaatgatgcccacaacaagaaggctgtgagccgctctgctgagcagcagcccagcgagaagagcacagagcccaagaccaagccccaggacatgatctctgctggaggagagagcgtggccggcatcacagccatcagcggcaagccaggggacaagaagaaggagaagaagagcctgaccccagctgtgcctgtggagagcaagccagacaagcccagcggcaagagcggcatggatgctgccctggatgacctgattgacaccctgggcggccctgaggagacagaggaggagaacaccacctacacaggccctgaggtgtctgaccccatgagcagcacctacatcgaggagctgggcaagcgggaggtgaccatcccccccaagtaccgggagctgctggccaagaaggagggcatcaccggccccccagctgacagcagcaagcccatcggcccagatgatgccattgatgccctgagcagtgacttcacctgtggcagccccacagctgctgggaagaagacagagaaggaggagagcacagaggtgctgaaggcccagagcgctggcaccgtgcgctctgctgccccaccccaggagaagaagaggaaggtggagaaggacaccatgtctgaccaggccctggaggccctgagcgccagcctgggcacccggcaggccgagcctgagctggacctgcggagcatcaaggaggtggatgaggccaaggccaaggaggagaagctggagaagtgtggggaggatgatgagaccatccccagcgagtaccgcctgaagccagccacagacaaggatggcaagcccctgctgcctgagcctgaggagaagcccaagcccaggtctgagagcgagctgattgatgagctgtctgaggactttgacagaagtgagtgcaaggagaagcccagcaagcccacagagaagacagaggagagcaaggccgccgccccagcccctgtgtctgaggccgtgtgcaggacctccatgtgcagcatccagagcgcccctcctgagcccgccaccctgaagggcaccgtgcctgatgatgctgtggaggccctggccgacagcctgggcaagaaggaggccgaccctgaagatggcaagcctgtgatggacaaggtgaaggagaaggccaaggaggaggaccgggagaagctgggggagaaggaggagaccatccccccagactaccgcctggaggaggtgaaggacaaggatggcaagcccctgctgcccaaggagagcaaggagcagctgccccccatgtctgaggacttcctgctggatgccctgtctgaggacttcagcggcccccagaatgccagcagcctgaagtttgaagatgccaagctggccgccgccatcagcgaggtggtgtcccagaccccagccagcaccacccaggccggggccccaccccgggacaccagccagagcgacaaggacctggatgatgccctggacaagctgagtgacagcctgggccagaggcagcctgaccctgatgagaacaagcccatggaggacaaggtgaaggagaaggccaaggccgagcaccgggacaagctgggggagagagatgacaccatccccccagagtaccgccacctgctggatgacaatggccaggacaagcctgtgaagccacccaccaagaagtctgaggacagcaagaagccagcagatgaccaggaccccattgatgccctgagcggggacctggacagctgccccagcaccacagagaccagccagaacacagccaaggacaagtgcaagaaggccgccagcagcagcaaggcccccaagaatggaggcaaggccaaggacagcgccaagaccacagaggagaccagcaagcccaaggatgactag

SEQ ID NO: 146006 - DNA, 2271 bp, Artificial Sequence
  Description of Artificial Sequence: Synthetic coding sequence
atgagccagcccggccagaagccagctgccagcccccggcccaggagagctgctgctgcccggaggacccatgagcacgtgtctgagaagaccagcgagagccccagcaagccaggagagaagaagggcagtgatgagaagaaggccgccagcctgggcagcagccagagcagcaggacctacgccggcggcacagccagcgccaccaaggtgtctgccagcagcggggccaccagcaagagcagctccatgaaccccacagagaccaaggctgtgaagacagagcctgagaagaagagccagagcaccaagctgtctgtggtgcatgagaagaagagccaggagggcaagcccaaggagcacacagagcccaagagcctgcccaagcaggccagtgacaccggcagcaatgatgcccacaacaagaaggctgtgagccgctctgctgagcagcagcccagcgagaagagcacagagcccaagaccaagccccaggacatgatctctgctggaggagagagcgtggccggcatcacagccatcagcggcaagccaggggacaagaagaaggagaagaagagcctgaccccagctgtgcctgtggagagcaagccagacaagcccagcggcaagagcggcatggatgctgccctggatgacctgattgacaccctgggcggccctgaggagacagaggaggagaacaccacctacacaggccctgaggtgtctgaccccatgagcagcacctacatcgaggagctgggcaagcgggaggtgaccatcccccccaagtaccgggagctgctggccaagcccatcggcccagatgatgccattgatgccctgagcagtgacttcacctgtggcagccccacagctgctgggaagaagacagagaaggaggagagcacagaggtgctgaaggcccagagcgctggcaccgtgcgctctgctgccccaccccaggagaagaagaggaaggtggagaaggacaccatgtctgaccaggccctggaggccctgagcgccagcctgggcacccggcaggccgagcctgagctggacctgcggagcatcaaggaggtggatgaggccaaggccaaggaggagaagctggagaagtgtggggaggatgatgagaccatccccagcgagtaccgcctgaagccagccacagacaaggatggcaagcccctgctgcctgagcctgaggagaagcccaagcccaggtctgagagcgagctgattgatgagctgtctgaggactttgacagaagtgagtgcaaggagaagcccagcaagcccacagagaagacagaggagagcaaggccgccgccccagcccctgtgtctgaggccgtgtgcaggacctccatgtgcagcatccagagcgcccctcctgagcccgccaccctgaagggcaccgtgcctgatgatgctgtggaggccctggccgacagcctgggcaagaaggaggccgaccctgaagatggcaagcctgtgatggacaaggtgaaggagaaggccaaggaggaggaccgggagaagctgggggagaaggaggagaccatccccccagactaccgcctggaggaggtgaaggacaaggatggcaagcccctgctgcccaaggagagcaaggagcagctgccccccatgtctgaggacttcctgctggatgccctgtctgaggacttcagcggcccccagaatgccagcagcctgaagtttgaagatgccaagctggccgccgccatcagcgaggtggtgtcccagaccccagccagcaccacccaggccggggccccaccccgggacaccagccagagcgacaaggacctggatgatgccctggacaagctgagtgacagcctgggccagaggcagcctgaccctgatgagaacaagcccatggaggacaaggtgaaggagaaggccaaggccgagcaccgggacaagctgggggagagagatgacaccatccccccagagtaccgccacctgctggatgacaatggccaggacaagcctgtgaagccacccaccaagaagtctgaggacagcaagaagccagcagatgaccaggaccccattgatgccctgagcggggacctggacagctgccccagcaccacagagaccagccagaacacagccaaggacaagtgcaagaaggccgccagcagcagcaaggcccccaagaatggaggcaaggccaaggacagcgccaagaccacagaggagaccagcaagcccaaggatgactag

SEQ ID NO: 146007 - DNA, 2088 bp, Artificial Sequence
  Description of Artificial Sequence: Synthetic coding sequence
atgaaccccacagagaccaaggccatccctgtgtcccagcagatggagggcccccacctgcccaacaagaagaagcacaagaagcaggccgtgaagacagagcctgagaagaagagccagagcaccaagctgtctgtggtgcatgagaagaagagccaggagggcaagcccaaggagcacacagagcccaagagcctgcccaagcaggccagtgacaccggcagcaatgatgcccacaacaagaaggctgtgagccgctctgctgagcagcagcccagcgagaagagcacagagcccaagaccaagccccaggacatgatctctgctggaggagagagcgtggccggcatcacagccatcagcggcaagccaggggacaagaagaaggagaagaagagcctgaccccagctgtgcctgtggagagcaagccagacaagcccagcggcaagagcggcatggatgctgccctggatgacctgattgacaccctgggcggccctgaggagacagaggaggagaacaccacctacacaggccctgaggtgtctgaccccatgagcagcacctacatcgaggagctgggcaagcgggaggtgaccatcccccccaagtaccgggagctgctggccaagcccatcggcccagatgatgccattgatgccctgagcagtgacttcacctgtggcagccccacagctgctgggaagaagacagagaaggaggagagcacagaggtgctgaaggcccagagcgctggcaccgtgcgctctgctgccccaccccaggagaagaagaggaaggtggagaaggacaccatgtctgaccaggccctggaggccctgagcgccagcctgggcacccggcaggccgagcctgagctggacctgcggagcatcaaggaggtggatgaggccaaggccaaggaggagaagctggagaagtgtggagaagatgatgagaccatccccagcgagtaccgcctgaagccagccacagacaaggatggcaagcccctgctgcctgagcctgaggagaagcccaagcccaggtctgagagcgagctgattgatgagctgtctgaagattttgacagaagtgagtgcaaggagaagcccagcaagcccacagagaagacagaggagagcaaggctgctgccccagcccctgtgtctgaggccgtgtgcaggacctccatgtgcagcatccagagcgcccctcctgagcccgccaccctgaagggcaccgtgcctgatgatgctgtggaggccctggccgacagcctgggcaagaaggaggccgaccctgaagatggcaagcctgtgatggacaaggtgaaggagaaggccaaggaggaggaccgggagaagctgggggagaaggaggagaccatccccccagactaccgcctggaggaggtgaaggacaaggatggcaagcccctgctgcccaaggagagcaaggagcagctgccccccatgtctgaggacttcctgctggatgccctgtctgaggacttcagcggcccccagaatgccagcagcctgaagtttgaagatgccaagctggccgccgccatcagcgaggtggtgtcccagaccccagccagcaccacccaggccggggccccaccccgggacaccagccagagcgacaaggacctggatgatgccctggacaagctgagtgacagcctgggccagaggcagcctgaccctgatgagaacaagcccatggaggacaaggtgaaggagaaggccaaggccgagcaccgggacaagctgggggagagagatgacaccatccccccagagtaccgccacctgctggatgacaatggccaggacaagcctgtgaagccacccaccaagaagtctgaggacagcaagaagccagcagatgaccaggaccccattgatgccctgagcggggacctggacagctgccccagcaccacagagaccagccagaacacagccaaggacaagtgcaagaaggccgccagcagcagcaaggcccccaagaatggaggcaaggccaaggacagcgccaagaccacagaggagaccagcaagcccaaggatgactag

SEQ ID NO: 146008 - DNA, 2127 bp, Artificial Sequence
  Description of Artificial Sequence: Synthetic coding sequence
atgaaccccacagagaccaaggccatccctgtgtcccagcagatggagggcccccacctgcccaacaagaagaagcacaagaagcaggccgtgaagacagagcctgagaagaagagccagagcaccaagctgtctgtggtgcatgagaagaagagccaggagggcaagcccaaggagcacacagagcccaagagcctgcccaagcaggccagtgacaccggcagcaatgatgcccacaacaagaaggctgtgagccgctctgctgagcagcagcccagcgagaagagcacagagcccaagaccaagccccaggacatgatctctgctggaggagagagcgtggccggcatcacagccatcagcggcaagccaggggacaagaagaaggagaagaagagcctgaccccagctgtgcctgtggagagcaagccagacaagcccagcggcaagagcggcatggatgctgccctggatgacctgattgacaccctgggcggccctgaggagacagaggaggagaacaccacctacacaggccctgaggtgtctgaccccatgagcagcacctacatcgaggagctgggcaagcgggaggtgaccatcccccccaagtaccgggagctgctggccaagaaggagggcatcaccggccccccagctgacagcagcaagcccatcggcccagatgatgccattgatgccctgagcagtgacttcacctgtggcagccccacagctgctgggaagaagacagagaaggaggagagcacagaggtgctgaaggcccagagcgctggcaccgtgcgctctgctgccccaccccaggagaagaagaggaaggtggagaaggacaccatgtctgaccaggccctggaggccctgagcgccagcctgggcacccggcaggccgagcctgagctggacctgcggagcatcaaggaggtggatgaggccaaggccaaggaggagaagctggagaagtgtggggaggatgatgagaccatccccagcgagtaccgcctgaagccagccacagacaaggatggcaagcccctgctgcctgagcctgaggagaagcccaagcccaggtctgagagcgagctgattgatgagctgtctgaggactttgacagaagtgagtgcaaggagaagcccagcaagcccacagagaagacagaggagagcaaggccgccgccccagcccctgtgtctgaggccgtgtgcaggacctccatgtgcagcatccagagcgcccctcctgagcccgccaccctgaagggcaccgtgcctgatgatgctgtggaggccctggccgacagcctgggcaagaaggaggccgaccctgaagatggcaagcctgtgatggacaaggtgaaggagaaggccaaggaggaggaccgggagaagctgggggagaaggaggagaccatccccccagactaccgcctggaggaggtgaaggacaaggatggcaagcccctgctgcccaaggagagcaaggagcagctgccccccatgtctgaggacttcctgctggatgccctgtctgaggacttcagcggcccccagaatgccagcagcctgaagtttgaagatgccaagctggccgccgccatcagcgaggtggtgtcccagaccccagccagcaccacccaggccggggccccaccccgggacaccagccagagcgacaaggacctggatgatgccctggacaagctgagtgacagcctgggccagaggcagcctgaccctgatgagaacaagcccatggaggacaaggtgaaggagaaggccaaggccgagcaccgggacaagctgggggagagagatgacaccatccccccagagtaccgccacctgctggatgacaatggccaggacaagcctgtgaagccacccaccaagaagtctgaggacagcaagaagccagcagatgaccaggaccccattgatgccctgagcggggacctggacagctgccccagcaccacagagaccagccagaacacagccaaggacaagtgcaagaaggccgccagcagcagcaaggcccccaagaatggaggcaaggccaaggacagcgccaagaccacagaggagaccagcaagcccaaggatgactag

SEQ ID NO: 146009 - DNA, 2319 bp, Artificial Sequence
  Description of Artificial Sequence: Synthetic coding sequence
atgagccagcccggccagaagccagctgccagcccccggcccaggagagctgctgctgcccggaggacccatgagcacgtgtctgagaagaccagcgagagccccagcaagccaggagagaagaagggcagtgatgagaagaaggccgccagcctgggcagcagccagagcagcaggacctacgccggcggcacagccagcgccaccaaggtgtctgccagcagcggggccaccagcaagagcagctccatgaaccccacagagaccaaggccatccctgtgtcccagcagatggagggcccccacctgcccaacaagaagaagcacaagaagcaggccgtgaagacagagcctgagaagaagagccagagcaccaagcccaagagcctgcccaagcaggccagtgacaccggcagcaatgatgcccacaacaagaaggctgtgagccgctctgctgagcagcagcccagcgagaagagcacagagcccaagaccaagccccaggacatgatctctgctggaggagagagcgtggccggcatcacagccatcagcggcaagccaggggacaagaagaaggagaagaagagcctgaccccagctgtgcctgtggagagcaagccagacaagcccagcggcaagagcggcatggatgctgccctggatgacctgattgacaccctgggcggccctgaggagacagaggaggagaacaccacctacacaggccctgaggtgtctgaccccatgagcagcacctacatcgaggagctgggcaagcgggaggtgaccatcccccccaagtaccgggagctgctggccaagaaggagggcatcaccggccccccagctgacagcagcaagcccatcggcccagatgatgccattgatgccctgagcagtgacttcacctgtggcagccccacagctgctgggaagaagacagagaaggaggagagcacagaggtgctgaaggcccagagcgctggcaccgtgcgctctgctgccccaccccaggagaagaagaggaaggtggagaaggacaccatgtctgaccaggccctggaggccctgagcgccagcctgggcacccggcaggccgagcctgagctggacctgcggagcatcaaggaggtggatgaggccaaggccaaggaggagaagctggagaagtgtggggaggatgatgagaccatccccagcgagtaccgcctgaagccagccacagacaaggatggcaagcccctgctgcctgagcctgaggagaagcccaagcccaggtctgagagcgagctgattgatgagctgtctgaggactttgacagaagtgagtgcaaggagaagcccagcaagcccacagagaagacagaggagagcaaggccgccgccccagcccctgtgtctgaggccgtgtgcaggacctccatgtgcagcatccagagcgcccctcctgagcccgccaccctgaagggcaccgtgcctgatgatgctgtggaggccctggccgacagcctgggcaagaaggaggccgaccctgaagatggcaagcctgtgatggacaaggtgaaggagaaggccaaggaggaggaccgggagaagctgggggagaaggaggagaccatccccccagactaccgcctggaggaggtgaaggacaaggatggcaagcccctgctgcccaaggagagcaaggagcagctgccccccatgtctgaggacttcctgctggatgccctgtctgaggacttcagcggcccccagaatgccagcagcctgaagtttgaagatgccaagctggccgccgccatcagcgaggtggtgtcccagaccccagccagcaccacccaggccggggccccaccccgggacaccagccagagcgacaaggacctggatgatgccctggacaagctgagtgacagcctgggccagaggcagcctgaccctgatgagaacaagcccatggaggacaaggtgaaggagaaggccaaggccgagcaccgggacaagctgggggagagagatgacaccatccccccagagtaccgccacctgctggatgacaatggccaggacaagcctgtgaagccacccaccaagaagtctgaggacagcaagaagccagcagatgaccaggaccccattgatgccctgagcggggacctggacagctgccccagcaccacagagaccagccagaacacagccaaggacaagtgcaagaaggccgccagcagcagcaaggcccccaagaatggaggcaaggccaaggacagcgccaagaccacagaggagaccagcaagcccaaggatgactag

SEQ ID NO: 146010 - DNA, 2376 bp, Artificial Sequence
  Description of Artificial Sequence: Synthetic coding sequence
atgagccagcccggccagaagccagctgccagcccccggcccaggagagctgctgctgcccggaggacccatgagcacgtgtctgagaagaccagcgagagccccagcaagccaggagagaagaagggcagtgatgagaagaaggccgccagcctgggcagcagccagagcagcaggacctacgccggcggcacagccagcgccaccaaggtgtctgccagcagcggggccaccagcaagagcagctccatgaaccccacagagaccaaggccatccctgtgtcccagcagatggagggcccccacctgcccaacaagaagaagcacaagaagcaggccgtgaagacagagcctgagaagaagagccagagcaccaagctgtctgtggtgcatgagaagaagagccaggagggcaagcccaaggagcacacagagcccaagagcctgcccaagcaggccagtgacaccggcagcaatgatgcccacaacaagaaggctgtgagccgctctgctgagcagcagcccagcgagaagagcacagagcccaagaccaagccccaggacatgatctctgctggaggagagagcgtggccggcatcacagccatcagcggcaagccaggggacaagaagaaggagaagaagagcctgaccccagctgtgcctgtggagagcaagccagacaagcccagcggcaagagcggcatggatgctgccctggatgacctgattgacaccctgggcggccctgaggagacagaggaggagaacaccacctacacaggccctgaggtgtctgaccccatgagcagcacctacatcgaggagctgggcaagcgggaggtgaccatcccccccaagtaccgggagctgctggccaagaaggagggcatcactggacctcctgctgacagcagcaagcccatcggcccagatgatgccattgatgccctgagcagtgacttcacctgtggcagccccacagctgctgggaagaagacagagaaggaggagagcacagaggtgctgaaggcccagagcgctggcaccgtgcgctctgctgccccaccccaggagaagaagaggaaggtggagaaggacaccatgtctgaccaggccctggaggccctgagcgccagcctgggcacccggcaggccgagcctgagctggacctgcggagcatcaaggaggtggatgaggccaaggccaaggaggagaagctggagaagtgtggagaagatgatgagaccatccccagcgagtaccgcctgaagccagccacagacaaggatggcaagcccctgctgcctgagcctgaggagaagcccaagcccaggtctgagagcgagctgattgatgagctgtctgaagattttgacagaagtgagtgcaaggagaagcccagcaagcccacagagaagacagaggagagcaaggctgctgccccagcccctgtgtctgaggccgtgtgcaggacctccatgtgcagcatccagagcgcccctcctgagcccgccaccctgaagggcaccgtgcctgatgatgctgtggaggccctggccgacagcctgggcaagaaggaggccgaccctgaagatggcaagcctgtgatggacaaggtgaaggagaaggccaaggaggaggaccgggagaagctgggggagaaggaggagaccatccccccagactaccgcctggaggaggtgaaggacaaggatggcaagcccctgctgcccaaggagagcaaggagcagctgccccccatgtctgaggacttcctgctggatgccctgtctgaggacttcagcggcccccagaatgccagcagcctgaagtttgaagatgccaagctggccgccgccatcagcgaggtggtgtcccagaccccagccagcaccacccaggccggggccccaccccgggacaccagccagagcgacaaggacctggatgatgccctggacaagctgagtgacagcctgggccagaggcagcctgaccctgatgagaacaagcccatggaggacaaggtgaaggagaaggccaaggccgagcaccgggacaagctgggggagagagatgacaccatccccccagagtaccgccacctgctggatgacaatggccaggacaagcctgtgaagccacccaccaagaagtctgaggacagcaagaagccagcagatgaccaggaccccattgatgccctgagcggggacctggacagctgccccagcaccacagagaccagccagaacacagccaaggacaagtgcaagaaggccgccagcagcagcaaggcccccaagaatggaggcaaggccaaggacagcgccaagaccacagaggagaccagcaagcccaaggatgactag

SEQ ID NO: 146011 - DNA, 2265 bp, Artificial Sequence
  Description of Artificial Sequence: Synthetic coding sequence
atggcctttgcctcctggtggtacaagacccacgtgtctgagaagaccagcgagagccccagcaagccaggagagaagaagggcagtgatgagaagaaggccgccagcctgggcagcagccagagcagcaggacctacgccggcggcacagccagcgccaccaaggtgtctgccagcagcggggccaccagcaagagcagctccatgaaccccacagagaccaaggctgtgaagacagagcctgagaagaagagccagagcaccaagctgtctgtggtgcatgagaagaagagccaggagggcaagcccaaggagcacacagagcccaagagcctgcccaagcaggccagtgacaccggcagcaatgatgcccacaacaagaaggctgtgagccgctctgctgagcagcagcccagcgagaagagcacagagcccaagaccaagccccaggacatgatctctgctggaggagagagcgtggccggcatcacagccatcagcggcaagccaggggacaagaagaaggagaagaagagcctgaccccagctgtgcctgtggagagcaagccagacaagcccagcggcaagagcggcatggatgctgccctggatgacctgattgacaccctgggcggccctgaggagacagaggaggagaacaccacctacacaggccctgaggtgtctgaccccatgagcagcacctacatcgaggagctgggcaagcgggaggtgaccatcccccccaagtaccgggagctgctggccaagaaggagggcatcaccggccccccagctgacagcagcaagcccatcggcccagatgatgccattgatgccctgagcagtgacttcacctgtggcagccccacagctgctgggaagaagacagagaaggaggagagcacagaggtgctgaaggcccagagcgctggcaccgtgcgctctgctgccccaccccaggagaagaagaggaaggtggagaaggacaccatgtctgaccaggccctggaggccctgagcgccagcctgggcacccggcaggccgagcctgagctggacctgcggagcatcaaggaggtggatgaggccaaggccaaggaggagaagctggagaagtgtggggaggatgatgagaccatccccagcgagtaccgcctgaagccagccacagacaaggatggcaagcccctgctgcctgagcctgaggagaagcccaagcccaggtctgagagcgagctgattgatgagctgtctgaggactttgacagaagtgagtgcaaggagaagcccagcaagcccacagagaagacagaggagagcaaggccgccgccccagcccctgtgtctgaggccgtgtgcaggacctccatgtgcagcatccagagcgcccctcctgagcccgccaccctgaagggcaccgtgcctgatgatgctgtggaggccctggccgacagcctgggcaagaaggaggccgaccctgaagatggcaagcctgtgatggacaaggtgaaggagaaggccaaggaggaggaccgggagaagctgggggagaaggaggagaccatccccccagactaccgcctggaggaggtgaaggacaaggatggcaagcccctgctgcccaaggagagcaaggagcagctgccccccatgtctgaggacttcctgctggatgccctgtctgaggacttcagcggcccccagaatgccagcagcctgaagtttgaagatgccaagctggccgccgccatcagcgaggtggtgtcccagaccccagccagcaccacccaggccggggccccaccccgggacaccagccagagcgacaaggacctggatgatgccctggacaagctgagtgacagcctgggccagaggcagcctgaccctgatgagaacaagcccatggaggacaaggtgaaggagaaggccaaggccgagcaccgggacaagctgggggagagagatgacaccatccccccagagtaccgccacctgctggatgacaatggccaggacaagcctgtgaagccacccaccaagaagtctgaggacagcaagaagccagcagatgaccaggaccccattgatgccctgagcggggacctggacagctgccccagcaccacagagaccagccagaacacagccaaggacaagtgcaagaaggccgccagcagcagcaaggcccccaagaatggaggcaaggccaaggacagcgccaagaccacagaggagaccagcaagcccaaggatgactag

SEQ ID NO: 146012 - DNA, 2376 bp, Artificial Sequence; identical to SEQ ID NO: 146010
  Description of Artificial Sequence: Synthetic coding sequence

SEQ ID NO: 146013 - DNA, 1929 bp, Artificial Sequence
  Description of Artificial Sequence: Synthetic coding sequence
atgaaccccacagagaccaaggccatccctgtgtcccagcagatggagggcccccacctgcccaacaagaagaagcacaagaagcaggccgtgaagacagagcctgagaagaagagccagagcaccaagctgtctgtggtgcatgagaagaagagccaggagggcaagcccaaggagcacacagagcccaagagcctgcccaagcaggccagtgacaccggcagcaatgatgcccacaacaagaaggctgtgagccgctctgctgagcagcagcccagcgagaagagcacagagcccaagaccaagccccaggacatgatctctgctggaggagagagcgtggccggcatcacagccatcagcggcaagccaggggacaagaagaaggagaagaagagcctgaccccagctgtgcctgtggagagcaagccagacaagcccagcggcaagagcggcatggatgctgccctggatgacctgattgacaccctgggcggccctgaggagacagaggaggagaacaccacctacacaggccctgaggtgtctgaccccatgagcagcacctacatcgaggagctgggcaagcgggaggtgaccatcccccccaagtaccgggagctgctggccaagaaggagggcatcaccggccccccagctgacagcagcaagcccatcggcccagatgatgccattgatgccctgagcagtgacttcacctgtggcagccccacagctgctgggaagaagacagagaaggaggagagcacagaggtgctgaaggcccagagcgctggcaccgtgcgctctgctgccccaccccaggagaagaagaggaaggtggagaaggacaccatgtctgaccaggccctggaggccctgagcgccagcctgggcacccggcaggccgagcctgagctggacctgcggagcatcaaggaggtggatgaggccaaggccaaggaggagaagctggagaagtgtggggaggatgatgagaccatccccagcgagtaccgcctgaagccagccacagacaaggatggcaagcccctgctgcctgagcctgaggagaagcccaagcccaggtctgagagcgagctgattgatgagctgtctgaggactttgacagaagtgagtgcaaggagaagcccagcaagcccacagagaagacagaggagagcaaggccgccgccccagcccctgtgtctgaggccgtgtgcaggacctccatgtgcagcatccagagcgcccctcctgagcccgccaccctgaagggcaccgtgcctgatgatgctgtggaggccctggccgacagcctgggcaagaaggaggccgaccctgaagatggcaagcctgtgatggacaaggtgaaggagaaggccaaggaggaggaccgggagaagctgggggagaaggaggagaccatccccccagactaccgcctggaggaggtgaaggacaaggatggcaagcccctgctgcccaaggagagcaaggagcagctgccccccatgtctgaggacttcctgctggatgccctgtctgaggacttcagcggcccccagaatgccagcagcctgaagtttgaagatgccaagctggccgccgccatcagcgaggtggtgtcccagaccccagccagcaccacccaggccggggccccaccccgggacaccagccagagcgacaaggacctggatgatgccctggacaagctgagtgacagcctgggccagaggcagcctgaccctgatgagaacaagcccatggaggacaaggtgaaggagaaggccaaggccgagcaccgggacaagctgggggagagagatgacaccatccccccagagtaccgccacctgctggatgacaatggccaggacaagcctgtgaagccacccaccaagaagtctgaggacagcaagtag

SEQ ID NO: 146014 - DNA, 2085 bp, Artificial Sequence
  Description of Artificial Sequence: Synthetic coding sequence
atggagggcccccacctgcccaacaagaagaagcacaagaagcaggccgtgaagacagagcctgagaagaagagccagagcaccaagctgtctgtggtgcatgagaagaagagccaggagggcaagcccaaggagcacacagagcccaagagcctgcccaagcaggccagtgacaccggcagcaatgatgcccacaacaagaaggctgtgagccgctctgctgagcagcagcccagcgagaagagcacagagcccaagaccaagccccaggacatgatctctgctggaggagagagcgtggccggcatcacagccatcagcggcaagccaggggacaagaagaaggagaagaagagcctgaccccagctgtgcctgtggagagcaagccagacaagcccagcggcaagagcggcatggatgctgccctggatgacctgattgacaccctgggcggccctgaggagacagaggaggagaacaccacctacacaggccctgaggtgtctgaccccatgagcagcacctacatcgaggagctgggcaagcgggaggtgaccatcccccccaagtaccgggagctgctggccaagaaggagggcatcaccggccccccagctgacagcagcaagcccatcggcccagatgatgccattgatgccctgagcagtgacttcacctgtggcagccccacagctgctgggaagaagacagagaaggaggagagcacagaggtgctgaaggcccagagcgctggcaccgtgcgctctgctgccccaccccaggagaagaagaggaaggtggagaaggacaccatgtctgaccaggccctggaggccctgagcgccagcctgggcacccggcaggccgagcctgagctggacctgcggagcatcaaggaggtggatgaggccaaggccaaggaggagaagctggagaagtgtggggaggatgatgagaccatccccagcgagtaccgcctgaagccagccacagacaaggatggcaagcccctgctgcctgagcctgaggagaagcccaagcccaggtctgagagcgagctgattgatgagctgtctgaggactttgacagaagtgagtgcaaggagaagcccagcaagcccacagagaagacagaggagagcaaggccgccgccccagcccctgtgtctgaggccgtgtgcaggacctccatgtgcagcatccagagcgcccctcctgagcccgccaccctgaagggcaccgtgcctgatgatgctgtggaggccctggccgacagcctgggcaagaaggaggccgaccctgaagatggcaagcctgtgatggacaaggtgaaggagaaggccaaggaggaggaccgggagaagctgggggagaaggaggagaccatccccccagactaccgcctggaggaggtgaaggacaaggatggcaagcccctgctgcccaaggagagcaaggagcagctgccccccatgtctgaggacttcctgctggatgccctgtctgaggacttcagcggcccccagaatgccagcagcctgaagtttgaagatgccaagctggccgccgccatcagcgaggtggtgtcccagaccccagccagcaccacccaggccggggccccaccccgggacaccagccagagcgacaaggacctggatgatgccctggacaagctgagtgacagcctgggccagaggcagcctgaccctgatgagaacaagcccatggaggacaaggtgaaggagaaggccaaggccgagcaccgggacaagctgggggagagagatgacaccatccccccagagtaccgccacctgctggatgacaatggccaggacaagcctgtgaagccacccaccaagaagtctgaggacagcaagaagccagcagatgaccaggaccccattgatgccctgagcggggacctggacagctgccccagcaccacagagaccagccagaacacagccaaggacaagtgcaagaaggccgccagcagcagcaaggcccccaagaatggaggcaaggccaaggacagcgccaagaccacagaggagaccagcaagcccaaggatgactag

SEQ ID NO: 146015 - DNA, 2253 bp, Artificial Sequence
  Description of Artificial Sequence: Synthetic coding sequence
atgagccagcccggccagaagccagctgccagcccccggcccaggagagctgctgctgcccggaggacccatgagcacgtgtctgagaagaccagcgagagccccagcaagccaggagagaagaagggcagtgatgagaagaaggccgccagcctgggcagcagccagagcagcaggacctacgccggcggcacagccagcgccaccaaggtgtctgccagcagcggggccaccagcaagagcagctccatgaaccccacagagaccaaggctgtgaagacagagcctgagaagaagagccagagcaccaagcccaagagcctgcccaagcaggccagtgacaccggcagcaatgatgcccacaacaagaaggctgtgagccgctctgctgagcagcagcccagcgagaagagcacagagcccaagaccaagccccaggacatgatctctgctggaggagagagcgtggccggcatcacagccatcagcggcaagccaggggacaagaagaaggagaagaagagcctgaccccagctgtgcctgtggagagcaagccagacaagcccagcggcaagagcggcatggatgctgccctggatgacctgattgacaccctgggcggccctgaggagacagaggaggagaacaccacctacacaggccctgaggtgtctgaccccatgagcagcacctacatcgaggagctgggcaagcgggaggtgaccatcccccccaagtaccgggagctgctggccaagaaggagggcatcaccggccccccagctgacagcagcaagcccatcggcccagatgatgccattgatgccctgagcagtgacttcacctgtggcagccccacagctgctgggaagaagacagagaaggaggagagcacagaggtgctgaaggcccagagcgctggcaccgtgcgctctgctgccccaccccaggagaagaagaggaaggtggagaaggacaccatgtctgaccaggccctggaggccctgagcgccagcctgggcacccggcaggccgagcctgagctggacctgcggagcatcaaggaggtggatgaggccaaggccaaggaggagaagctggagaagtgtggggaggatgatgagaccatccccagcgagtaccgcctgaagccagccacagacaaggatggcaagcccctgctgcctgagcctgaggagaagcccaagcccaggtctgagagcgagctgattgatgagctgtctgaggactttgacagaagtgagtgcaaggagaagcccagcaagcccacagagaagacagaggagagcaaggccgccgccccagcccctgtgtctgaggccgtgtgcaggacctccatgtgcagcatccagagcgcccctcctgagcccgccaccctgaagggcaccgtgcctgatgatgctgtggaggccctggccgacagcctgggcaagaaggaggccgaccctgaagatggcaagcctgtgatggacaaggtgaaggagaaggccaaggaggaggaccgggagaagctgggggagaaggaggagaccatccccccagactaccgcctggaggaggtgaaggacaaggatggcaagcccctgctgcccaaggagagcaaggagcagctgccccccatgtctgaggacttcctgctggatgccctgtctgaggacttcagcggcccccagaatgccagcagcctgaagtttgaagatgccaagctggccgccgccatcagcgaggtggtgtcccagaccccagccagcaccacccaggccggggccccaccccgggacaccagccagagcgacaaggacctggatgatgccctggacaagctgagtgacagcctgggccagaggcagcctgaccctgatgagaacaagcccatggaggacaaggtgaaggagaaggccaaggccgagcaccgggacaagctgggggagagagatgacaccatccccccagagtaccgccacctgctggatgacaatggccaggacaagcctgtgaagccacccaccaagaagtctgaggacagcaagaagccagcagatgaccaggaccccattgatgccctgagcggggacctggacagctgccccagcaccacagagaccagccagaacacagccaaggacaagtgcaagaaggccgccagcagcagcaaggcccccaagaatggaggcaaggccaaggacagcgccaagaccacagaggagaccagcaagcccaaggatgactag

SEQ ID NO: 146016 - DNA, 1254 bp, Artificial Sequence
  Description of Artificial Sequence: Synthetic coding sequence
atgctgctgtctgtgcccctgctgctgggcctgctgggcctggccgtggccgagcctgctgtgtacttcaaggagcagttcctggatggagatggctggaccagccgctggattgagagcaagcacaagagtgactttgggaagtttgtgctgagcagcggcaagttctatggagatgaggagaaggacaagggcctgcagaccagccaggatgcccgcttctacgccctgagcgccagctttgagcccttcagcaacaagggccagaccctggtggtgcagttcaccgtgaagcatgagcagaacatcgactgtggcggcggctacgtgaagctgttccccaacagcctggaccagacagacatgcatggagacagcgagtacaacatcatgtttggaccagacatctgtggccctggcaccaagaaggtgcacgtgatcttcaactacaagggcaagaatgtgctgatcaacaaggacatccgctgcaaggatgatgagttcacccacctgtacaccctgattgtgcggccagacaacacctatgaggtgaagattgacaacagccaggtggagagcggcagcctggaggatgactgggacttcctgccccccaagaagatcaaggaccctgatgccagcaagccagaggactgggatgagcgggccaagattgatgaccccacagacagcaagccagaggactgggacaagccagagcacatcccagaccctgatgccaagaagccagaggactgggatgaggagatggatggagagtgggagccccctgtgatccagaaccctgagtacaagggggagtggaagccccggcagattgacaacccagactacaagggcacctggatccaccctgagattgacaaccctgagtacagcccagaccccagcatctatgcctatgacaactttggagtgctgggcctggacctgtggcaggtgaagagcggcaccatctttgacaacttcctgatcaccaatgatgaggcctatgcagaggagtttggaaatgagacctggggcgtgaccaaggctgctgagaagcagatgaaggacaagcaggatgaggagcagaggctgaaggaggaggaggaggacaagaagaggaaggaggaggaggaggccgaggacaaggaggatgatgaggacaaggatgaagatgaggaggatgaggaggacaaggaggaggatgaggaggaggatgtgcccggccaggccaaggatgagctgtag

SEQ ID NO: 146017 - DNA, 891 bp, Artificial Sequence
  Description of Artificial Sequence: Synthetic coding sequence
atgcacggggacagcgagtacaacatcatgtttggaccagacatctgtggccctggcaccaagaaggtgcacgtgatcttcaactacaagggcaagaatgtgctgatcaacaaggacatccgctgcaaggatgatgagttcacccacctgtacaccctcatcgtgcggccagacaacacctatgaggtgaagattgacaacagccaggtggagagcggcagcctggaggatgactgggacttcctgccccccaagaagatcaaggaccctgatgccagcaagccagaggactgggatgagcgggccaagattgatgaccccacagacagcaagccagaggactgggacaagccagagcacatcccagaccctgatgccaagaagccagaggactgggatgaggagatggatggagagtgggagccccctgtgatccagaaccctgagtacaagggggagtggaagccccggcagattgacaacccagactacaagggcacctggatccaccctgagattgacaaccctgagtacagcccagaccccagcatctatgcctatgacaactttggagtgctgggcctggacctgtggcaggtgaagagcggcaccatctttgacaacttcctgatcaccaatgatgaggcctatgcagaggagtttggaaatgagacctggggcgtgaccaaggctgctgagaagcagatgaaggacaagcaggatgaggagcagaggctgaaggaggaggaggaggacaagaagaggaaggaggaggaggaggccgaggacaaggaggatgatgaggacaaggatgaagatgaagaagatgaggaggacaaggaggaggatgaggaggaggatgtgcccggccaggccaaggatgagctgtag

SEQ ID NO: 146018 - DNA, 1155 bp, Artificial Sequence
  Description of Artificial Sequence: Synthetic coding sequence
atggcccgggccctggtgcagctgtgggccatctgcatgctgcgggtggccctggccaccgtgtacttccaggaggagttcctggatggagagcactggaggaaccgctggctgcagagcaccaatgacagccgcttcggccacttccggctgagcagcggcaagttctacggccacaaggagaaggacaagggcctgcagaccacccagaatggccgcttctacgccatcagcgcccgcttcaagcccttcagcaacaagggcaagaccctggtgatccagtacacagtgaagcatgagcagaagatggactgtggcggcggctacatcaaggtgtttcctgctgacatcgaccagaagaacctgaatggcaagagccagtactacatcatgtttggaccagacatctgtggctttgacatcaagaaggtgcacgtgatcctgcacttcaagaacaagtaccacgagaacaagaagctgatccgctgcaaggtggatggcttcacccacctgtacaccctcatcctgcggccagacctgtcctatgatgtgaagattgatggccagagcattgaaagtggcagcattgaatatgactggaacctgaccagcctgaagaaggagaccagccctgctgagagcaaggactgggagcagaccaaggacaacaaggcccaggactgggagaagcacttcctggatgccagcaccagcaagcagagcgactggaatggagacctggatggagactggccagcccccatgctgcagaagccaccctaccaggacggcctgaagccagagggcatccacaaggatgtgtggctgcacaggaagatgaagaacacagactacctgacccagtatgacctgtctgaatttgaaaatattggagccatcggcctggagctgtggcaggtgcgcagcggcaccatctttgacaacttcctgatcacagatgatgaggagtatgctgacaactttgggaaggccacctggggcgagaccaagggccctgagcgggagatggatgccatccaggccaaggaggagatgaagaaggcccgggaggaggaggaggaggagctgctgagcggcaagatcaacagacatgagcactacttcaaccagttccacagaagaaatgagctgtag

SEQ ID NO: 146019 - DNA, 1191 bp, Artificial Sequence
  Description of Artificial Sequence: Synthetic coding sequence
atgtctgccacagacaggatgggccccagggctgtgcccggcctgcggctggccctgctgctgctgctggtgctgggcacccccaagagcggcgtgcagggccaggagggcctggacttcccagaatatgatggagtggacagagtcatcaacgtgaatgccaagaactacaagaatgtgttcaagaagtatgaggtgctggccctgctgtaccacgagcccccagaagatgacaaggccagccagaggcagtttgagatggaggagctgatcctggagctggccgcccaggtgctggaggacaagggcgtgggcttcggcctggtggacagcgagaaggatgctgctgtggccaagaagctgggcctgacagaggtggacagcatgtatgtgttcaagggagatgaagtcatcgagtatgatggagagttctctgctgacaccatcgtggagttcctgctggatgtgctggaggaccctgtggagctgattgaaggagagcgggagctgcaggcctttgagaacattgaagatgagatcaagctgattggctacttcaagagcaaggacagcgagcactacaaggcctttgaagatgctgctgaggagttccacccctacatccccttctttgccacctttgacagcaaggtggccaagaagctgaccctgaagctgaatgaaattgacttctatgaggccttcatggaggagcctgtgaccatcccagacaagcccaacagcgaggaggagatcgtgaactttgtggaggagcaccggcgcagcaccctgaggaagctgaagccagagagcatgtatgagacctgggaggatgacatggatggcatccacatcgtggcctttgctgaggaggccgaccctgatggctttgagttcctggagaccctgaaggctgtggcccaggacaacacagagaacccagacctgagcatcatctggattgatcctgatgacttccccctgctggtgccctactgggagaagacctttgatattgacctgagcgccccccagatcggcgtggtgaatgtgacagatgctgacagcgtgtggatggagatggatgatgaggaggacctgcccagcgctgaggagctggaggactggctggaggatgtgctggagggggagatcaacacagaagatgatgatgatgatgatgatgactag

SEQ ID NO: 146020 - DNA, 1173 bp, Artificial Sequence
  Description of Artificial Sequence: Synthetic coding sequence
atgggccccagggctgtgcccggcctgcggctggccctgctgctgctgctggtgctgggcacccccaagagcggcgtgcagggccaggagggcctggacttcccagaatatgatggagtggacagagtcatcaacgtgaatgccaagaactacaagaatgtgttcaagaagtatgaggtgctggccctgctgtaccacgagcccccagaagatgacaaggccagccagaggcagtttgagatggaggagctgatcctggagctggccgcccaggtgctggaggacaagggcgtgggcttcggcctggtggacagcgagaaggatgctgctgtggccaagaagctgggcctgacagaggtggacagcatgtatgtgttcaagggagatgaagtcatcgagtatgatggagagttctctgctgacaccatcgtggagttcctgctggatgtgctggaggaccctgtggagctgattgaaggagagcgggagctgcaggcctttgagaacattgaagatgagatcaagctgattggctacttcaagagcaaggacagcgagcactacaaggcctttgaagatgctgctgaggagttccacccctacatccccttctttgccacctttgacagcaaggtggccaagaagctgaccctgaagctgaatgaaattgacttctatgaggccttcatggaggagcctgtgaccatcccagacaagcccaacagcgaggaggagatcgtgaactttgtggaggagcaccggcgcagcaccctgaggaagctgaagccagagagcatgtatgagacctgggaggatgacatggatggcatccacatcgtggcctttgctgaggaggccgaccctgatggctttgagttcctggagaccctgaaggctgtggcccaggacaacacagagaacccagacctgagcatcatctggattgatcctgatgacttccccctgctggtgccctactgggagaagacctttgatattgacctgagcgccccccagatcggcgtggtgaatgtgacagatgctgacagcgtgtggatggagatggatgatgaggaggacctgcccagcgctgaggagctggaggactggctggaggatgtgctggagggggagatcaacacagaagatgatgatgatgatgatgatgactag

SEQ ID NO: 146021 - DNA, 936 bp, Artificial Sequence
  Description of Artificial Sequence: Synthetic coding sequence
atgtccatgcagaggaccaccaggatgtgcagccgctccatgcgctgctggcacagcagcaccatgaacccccccaggatgacccggccccacaaggacaacagcctgggcctgacagaggtggacagcatgtatgtgttcaagggagatgaggtgattgaatatgatggagagttctctgctgacaccatcgtggagttcctgctggatgtgctggaggaccctgtggagctgattgaaggagagcgggagctgcaggcctttgaaaatattgaagatgagatcaagctgattggctacttcaagagcaaggacagcgagcactacaaggcctttgaagatgctgctgaggagttccacccctacatccccttctttgccacctttgacagcaaggtggccaagaagctgaccctgaagctgaatgaaattgacttctatgaggccttcatggaggagcctgtgaccatcccagacaagcccaacagcgaggaggagatcgtgaactttgtggaggagcacagaagaagcaccctgaggaagctgaagccagagagcatgtatgagacctgggaggatgacatggatggcatccacatcgtggcctttgctgaggaggccgaccctgatggctttgagttcctggagaccctgaaggctgtggcccaggacaacacagaaaatccagacctgagcatcatctggattgatcctgatgacttccccctgctggtgccctactgggagaagacctttgacatcgacctgagcgccccccagattggagtggtgaatgtgacagatgctgacagcgtgtggatggagatggatgatgaggaggacctgcccagcgctgaggagctggaggactggctggaggatgtgctggagggggagatcaacacagaagatgatgatgatgatgatgatgactag

SEQ ID NO: 146022 - DNA, 1200 bp, Artificial Sequence
  Description of Artificial Sequence: Synthetic coding sequence
atgaagaggacccacctgttcatcgtgggcatctacttcctgagcagctgcagagctgaggagggcctgaacttccccacctatgatggcaaggacagagtggtgtccctgtctgagaagaacttcaagcaggtgctgaagaagtatgacctgctgtgcctgtactaccacgagcctgtgtccagtgacaaggtgacccagaagcagttccagctgaaggagatcgtgctggagctggtggcccaggtgctggagcacaaggccatcggctttgtgatggtggatgccaagaaggaggccaagctggccaagaagctgggctttgatgaggagggcagcctgtacatcctgaagggggacaggaccattgaatttgatggagaatttgctgctgatgtgctggtggagttcctgctggacctgattgaagatcctgtggagatcatcagcagcaagctggaggtgcaggcctttgaaagaattgaggactacatcaagctgattggcttcttcaagtctgaggacagcgagtactacaaggcctttgaggaggccgctgagcacttccagccctacatcaagttctttgccacctttgataaaggagtggccaagaagctgagcctgaagatgaatgaggtggacttctatgagcccttcatggatgagcccatcgccatccccaacaagccctacacagaggaggagctggtggagtttgtgaaggagcaccagaggcccaccctgcggcggctgcggcctgaggagatgtttgagacctgggaggatgacctgaatggcatccacatcgtggcctttgctgagaagagtgaccctgatggctatgagttcctggagatcctgaagcaggtggcccgggacaacacagacaacccagacctgagcatcctgtggattgatcctgatgacttccccctgctggtggcctactgggagaagaccttcaagattgacctcttccggccccagattggagtggtgaatgtgacagatgctgacagcgtgtggatggagatcccagatgatgatgacctgcccacagctgaggagctggaggactggattgaagatgtgctgagcggcaagatcaacacagaagatgatgatgaagatgatgatgatgatgacaacagtgatgaggaggacaatgatgacagtgatgatgatgatgatgaatag

SEQ ID NO: 146023 - DNA, 1062 bp, Artificial Sequence
  Description of Artificial Sequence: Synthetic coding sequence
atgaagaggacccacctgttcatcgtgggcatctacttcctgagcagctgcagagctgaggagggcctgaacttccccacctatgatggcaaggacagagtggtgtccctgtctgagaagaacttcaagcaggtgctgaagaagtatgacctgctgtgcctgtactaccacgagcctgtgtccagtgacaaggtgacccagaagcagttccagctgaaggagatcgtgctggagctggtggcccaggtgctggagcacaaggccatcggctttgtgatggtggatgccaagaaggaggccaagctggccaagaagctgggctttgatgaggagggcagcctgtacatcctgaagggggacaggaccattgaatttgatggagaatttgctgctgatgtgctggtggagttcctgctggacctgattgaagatcctgtggagatcatcagcagcaagctggaggtgcaggcctttgaaagaattgaggactacatcaagctgattggcttcttcaagtctgaggacagcgagtactacaaggcctttgaggaggccgctgagcacttccagccctacatcaagttctttgccacctttgataaaggagtggccaagaagctgagcctgaagatgaatgaggtggacttctatgagcccttcatggatgagcccatcgccatccccaacaagccctacacagatggctatgagttcctggagatcctgaagcaggtggcccgggacaacacagacaacccagacctgagcatcctgtggattgatcctgatgacttccccctgctggtggcctactgggagaagaccttcaagattgacctcttccggccccagattggagtggtgaatgtgacagatgctgacagcgtgtggatggagatcccagatgatgatgacctgcccacagctgaggagctggaggactggattgaagatgtgctgagcggcaagatcaacacagaagatgatgatgaagatgatgatgatgatgacaacagtgatgaggaggacaatgatgacagtgatgatgatgatgatgaatag

SEQ ID NO: 146024 - DNA, 987 bp, Artificial Sequence
  Description of Artificial Sequence: Synthetic coding sequence
atgaagaggacccacctgttcatcgtgggcatctacttcctgagcagctgcagagctgaggagggcctgaacttccccacctatgatggcaaggacagagtggtgtccctgtctgagaagaacttcaagcaggtgctgaagaagtatgacctgctgtgcctgtactaccacgagcctgtgtccagtgacaaggtgacccagaagcagttccagctgaaggagatcgtgctggagctggtggcccaggtgctggagcacaaggccatcggctttgtgatggtggatgccaagaaggaggccaagctggccaagaagctggactacaaggcctttgaggaggccgctgagcacttccagccctacatcaagttctttgccacctttgacaagggcgtggccaagaagctgagcctgaagatgaatgaggtggacttctatgagcccttcatggatgagcccatcgccatccccaacaagccctacacagaggaggagctggtggagtttgtgaaggagcaccagaggcccaccctgcggcggctgcggcctgaggagatgtttgagacctgggaggatgacctgaatggcatccacatcgtggcctttgctgagaagagtgaccctgatggctatgagttcctggagatcctgaagcaggtggcccgggacaacacagacaacccagacctgagcatcctgtggattgatcctgatgacttccccctgctggtggcctactgggagaagaccttcaagattgacctcttccggccccagatcggcgtggtgaatgtgacagatgctgacagcgtgtggatggagatcccagatgatgatgacctgcccacagctgaggagctggaggactggattgaagatgtgctgagcggcaagatcaacacagaagatgatgatgaagatgatgatgatgatgacaacagtgatgaagaagataatgatgacagtgatgatgatgatgatgaatag

SEQ ID NO: 146025 - DNA, 948 bp, Artificial Sequence
  Description of Artificial Sequence: Synthetic coding sequence
atggacctgcggcagttcctgatgtgcctgagcctgtgcacagcctttgccctgagcaagcccacagagaagaaggacagagtgcaccacgagccccagctgagtgacaaggtgcacaatgatgcccagagctttgattatgaccatgatgccttcctgggcgctgaggaggccaagacctttgaccagctgaccccagaggagagcaaggagcggctgggcaagatcgtgtccaagattgatggagacaaggatggctttgtgacagtggatgagctgaaggactggatcaagtttgcccagaagcgctggatctatgaagatgtggagcggcagtggaagggccatgacctgaatgaagatggcctggtgtcctgggaggagtacaagaatgccacctacggctacgtgctggatgatcctgaccctgatgatggcttcaactacaagcagatgatggtgagagatgagcggcgcttcaagatggctgacaaggatggagacctgattgccaccaaggaggagttcaccgccttcctgcaccctgaggagtatgactacatgaaggacatcgtggtgcaggagaccatggaggacatcgacaagaatgctgatggcttcatcgacctggaggagtacatcggggacatgtacagccatgatggcaacacagatgagcctgagtgggtgaagacagagcgggagcagtttgtggagttccgggacaagaacagagatggcaagatggacaaggaggagaccaaggactggatcctgcccagcgactatgaccacgccgaggccgaggcccggcacctggtgtatgaaagtgaccagaacaaggatggcaagctgaccaaggaggagatcgtggacaagtatgacctgtttgtgggcagccaggccacagactttggagaggccctggtgagacatgatgagttctag

SEQ ID NO: 146026 - DNA, 465 bp, Artificial Sequence
  Description of Artificial Sequence: Synthetic coding sequence
atggacctgcggcagttcctgatgtgcctgagcctgtgcacagcctttgccctgagcaagcccacagagaagaaggacagagtgcaccacgagccccagctgagtgacaaggtgcacaatgatgcccagagctttgattatgaccatgatgccttcctgggcgctgaggaggccaagacctttgaccagctgaccccagaggagagcaaggagcggctgggcaagatcgtgtccaagattgatggagacaaggatggctttgtgacagtggatgagctgaaggactggatcctgcccagcgactatgaccatgctgaggccgaggcccggcacctggtgtatgaaagtgaccagaacaaggatggcaagctgaccaaggaggagatcgtggacaagtatgacctgtttgtgggcagccaggccacagactttggagaggccctggtgagacatgatgagttctag

SEQ ID NO: 146027 - DNA, 948 bp, Artificial Sequence
  Description of Artificial Sequence: Synthetic coding sequence
atggacctgcggcagttcctgatgtgcctgagcctgtgcacagcctttgccctgagcaagcccacagagaagaaggacagagtgcaccacgagccccagctgagtgacaaggtgcacaatgatgcccagagctttgattatgaccatgatgccttcctgggcgctgaggaggccaagacctttgaccagctgaccccagaggagagcaaggagcggctgggcatgattgtggacaagattgatgctgacaaggatggctttgtgacagaaggagagctgaagtcctggatcaagcacgcccagaagaagtacatctatgacaacgtggagaaccagtggcaggagtttgacatgaaccaggacggcctcatctcctgggatgagtacagaaatgtgacctacggcacctacctggatgatcctgaccctgatgatggcttcaactacaagcagatgatggtgagagatgagcggcgcttcaagatggctgacaaggatggagacctgattgccaccaaggaggagttcaccgccttcctgcaccctgaggagtatgactacatgaaggacatcgtggtgcaggagaccatggaggacatcgacaagaatgctgatggcttcatcgacctggaggagtacatcggggacatgtacagccatgatggcaacacagatgagcctgagtgggtgaagacagagcgggagcagtttgtggagttccgggacaagaacagagatggcaagatggacaaggaggagaccaaggactggatcctgcccagcgactatgaccacgccgaggccgaggcccggcacctggtgtatgaaagtgaccagaacaaggatggcaagctgaccaaggaggagatcgtggacaagtatgacctgtttgtgggcagccaggccacagactttggagaggccctggtgagacatgatgagttctag

SEQ ID NO: 146028 - DNA, 972 bp, Artificial Sequence
  Description of Artificial Sequence: Synthetic coding sequence
atgaaggagacagacctgatcatcatggacctgcggcagttcctgatgtgcctgagcctgtgcacagcctttgccctgagcaagcccacagagaagaaggacagagtgcaccacgagccccagctgagtgacaaggtgcacaatgatgcccagagctttgattatgaccatgatgccttcctgggcgctgaggaggccaagacctttgaccagctgaccccagaggagagcaaggagcggctgggcaagatcgtgtccaagattgatggagacaaggatggctttgtgacagtggatgagctgaaggactggatcaagtttgcccagaagcgctggatctatgaagatgtggagcggcagtggaagggccatgacctgaatgaagatggcctggtgtcctgggaggagtacaagaatgccacctacggctacgtgctggatgatcctgaccctgatgatggcttcaactacaagcagatgatggtgagagatgagcggcgcttcaagatggctgacaaggatggagacctgattgccaccaaggaggagttcaccgccttcctgcaccctgaggagtatgactacatgaaggacatcgtggtgcaggagaccatggaggacatcgacaagaatgctgatggcttcatcgacctggaggagtacatcggggacatgtacagccatgatggcaacacagatgagcctgagtgggtgaagacagagcgggagcagtttgtggagttccgggacaagaacagagatggcaagatggacaaggaggagaccaaggactggatcctgcccagcgactatgaccacgccgaggccgaggcccggcacctggtgtatgaaagtgaccagaacaaggatggcaagctgaccaaggaggagatcgtggacaagtatgacctgtttgtgggcagccaggccacagactttggagaggccctggtgagacatgatgagttctag

SEQ ID NO: 146029 - DNA, 444 bp, Artificial Sequence
  Description of Artificial Sequence: Synthetic coding sequence
tgaattgccaccaaggaggagttcaccgccttcctgcaccctgaggagtatgactacatgaaggacatcgtggtgcaggagaccatggaggacatcgacaagaatgctgatggcttcatcgacctggaggagtacatcggggacatgtacagccatgatggcaacacagatgagcctgagtgggtgaagacagagcgggagcagtttgtggagttccgggacaagaacagagatggcaagatggacaaggaggagaccaaggactggatcctgcccagcgactatgaccacgccgaggccgaggcccggcacctggtgtatgaaagtgaccagaacaaggatggcaagctgaccaaggaggagatcgtggacaagtatgacctgtttgtgggcagccaggccacagactttggagaggccctggtgagacatgatgagttctag

SEQ ID NO: 146030 - DNA, 675 bp, Artificial Sequence
  Description of Artificial Sequence: Synthetic coding sequence
atggacctgcggcagttcctgatgtgcctgagcctgtgcacagcctttgccctgagcaagcccacagagaagaaggacagagtgcaccacgagccccagctgagtgacaaggtgcacaatgatgcccagagctttgattatgaccatgatgccttcctgggcgctgaggaggccaagacctttgaccagctgaccccagaggagagcaaggagcggctgggcaagatcgtgtccaagattgatggagacaaggatggctttgtgacagtggatgagctgaaggactggatcaagtttgcccagaagcgctggatctatgaagatgtggagcggcagtggaagggccatgacctgaatgaagatggcctggtgtcctgggaggagtacaagaatgccacctacggctacgtgctggatgatcctgaccctgatgatggcttcaactacaagcagatgatggtgagagatgagcggcgcttcaagatggctgacaaggatggagacctgattgccaccaaggaggagttcaccgccttcctgcaccctgaggagtatgactacatgaaggacatcgtggtgcaggagaccatggaggacatcgacaagaatgctgatggcttcatcgacctggaggagtacatcggctggcaggcctaccagggcggggacagatag

SEQ ID NO: 146031 - DNA, 444 bp, Artificial Sequence
  Description of Artificial Sequence: Synthetic coding sequence
atgaaggagacagacctgatcatcatggacctgcggcagttcctgatgtgcctgagcctgtgcacagcctttgccctgagcaagcccacagagaagaaggacagagtgcaccacgagccccagctgagtgacaaggtgcacaatgatgcccagagctttgattatgaccatgatgccttcctgggcgctgaggaggccaagacctttgaccagctgaccccagaggagagcaaggagcggctgggcaagatcgtgtccaagattgatggagacaaggatggctttgtgacagtggatgagctgaaggactggatcaagtttgcccagaagcgctggatctatgaagatgtggagcggcagtggaagggccatgacctgaatgaagatggcctggtgtcctgggaggagtacaagaatgccacctacggctacgtgctggagtag

SEQ ID NO: 146032 - DNA, 513 bp, Artificial Sequence
  Description of Artificial Sequence: Synthetic coding sequence
atggacctgcggcagttcctgatgtgcctgagcctgtgcacagcctttgccctgagcaagcccacagagaagaaggacagagtgcaccacgagccccagctgagtgacaaggtgcacaatgatgcccagagctttgattatgaccatgatgccttcctgggcgctgaggaggccaagacctttgaccagctgaccccagaggagagcaaggagcggctgggcatgattgtggacaagattgatgctgacaaggatggctttgtgacagaaggagagctgaagtcctggatcaagcacgcccagaagaagtacatctatgacaacgtggagaaccagtggcaggagtttgacatgaaccaggacggcctcatctcctgggatgagtacagaaatgtgacctacggcacctacctggatgatcctgaccctgatgatggcttcaactacaagcagatgatggtgagagatgagcggcgcttcaagatggctgaccgggcccgggctgtgtgctag

SEQ ID NO: 146033 - DNA, 606 bp, Artificial Sequence
  Description of Artificial Sequence: Synthetic coding sequence
atggacctgcggcagttcctgatgtgcctgagcctgtgcacagcctttgccctgagcaagcccacagagaagaaggacagagtgcaccacgagccccagctgagtgacaaggtgcacaatgatgcccagagctttgattatgaccatgatgccttcctgggcgctgaggaggccaagacctttgaccagctgaccccagaggagagcaaggagcggctgggcatgattgtggacaagattgatgctgacaaggatggctttgtgacagaaggagagctgaagtcctggatcaagcacgcccagaagaagtacatctatgacaacgtggagaaccagtggcaggagtttgacatgaaccaggacggcctcatctcctgggatgagtacagaaatgtgacctacggcacctacctggatgatcctgaccctgatgatggcttcaactacaagcagatgatggtgagagatgagcggcgcttcaagatggctgacaaggatggagacctgattgccaccaaggaggagatcgtggacaagtatgacctgtttgtgggcagccaggccacagactttggagaggccctggtgagacatgatgagttctag

SEQ ID NO: 146034 - DNA, 798 bp, Artificial Sequence
  Description of Artificial Sequence: Synthetic coding sequence
atggacctgcggcagttcctgatgtgcctgagcctgtgcacagcctttgccctgagcaagcccacagagaagaaggacagagtgcaccacgagccccagctgagtgacaaggtgcacaatgatgcccagagctttgattatgaccatgatgccttcctgggcgctgaggaggccaagacctttgaccagctgaccccagaggagagcaaggagcggctgggcaagatcgtgtccaagattgatggagacaaggatggctttgtgacagtggatgagctgaaggactggatcaagtttgcccagaagcgctggatctatgaagatgtggagcggcagtggaagggccatgacctgaatgaagatggcctggtgtcctgggaggagtacaagaatgccacctacggctacgtgctggatgatcctgaccctgatgatggcttcaactacaagcagatgatggtgagagatgagcggcgcttcaagatggctgacaaggatggagacctgattgccaccaaggaggagttcaccgccttcctgcaccctgaggagtatgactacatgaaggacatcgtggtgcaggagaccatggaggacatcgacaagaatgctgatggcttcatcgacctggaggagtacatcggggacatgtacagccatgatggcaacacagatgaaagtgaccagaacaaggatggcaagctgaccaaggaggagatcgtggacaagtatgacctgtttgtgggcagccaggccacagactttggagaggccctggtgagacatgatgagttctag

SEQ ID NO: 146035 - DNA, 495 bp, Artificial Sequence
  Description of Artificial Sequence: Synthetic coding sequence
atgatggtgagagatgaaagacgcttcaagatggctgacaaggatggagacctgattgccaccaaggaggagttcaccgccttcctgcaccctgaggagtatgactacatgaaggacatcgtggtgcaggagaccatggaggacatcgacaagaatgctgatggcttcatcgacctggaggagtacatcggggacatgtacagccatgatggcaacacagatgagcctgagtgggtgaagacagagcgggagcagtttgtggagttccgggacaagaacagagatggcaagatggacaaggaggagaccaaggactggatcctgcccagcgactatgaccatgctgaggccgaggcccggcacctggtgtatgaaagtgaccagaacaaggatggcaagctgaccaaggaggagatcgtggacaagtatgacctgtttgtgggcagccaggccacagactttggagaggccctggtgagacatgatgagttctag

SEQ ID NO: 146036 - DNA, 972 bp, Artificial Sequence
  Description of Artificial Sequence: Synthetic coding sequence
atgaaggagacagacctgatcatcatggacctgcggcagttcctgatgtgcctgagcctgtgcacagcctttgccctgagcaagcccacagagaagaaggacagagtgcaccacgagccccagctgagtgacaaggtgcacaatgatgcccagagctttgattatgaccatgatgccttcctgggcgctgaggaggccaagacctttgaccagctgaccccagaggagagcaaggagcggctgggcatgattgtggacaagattgatgctgacaaggatggctttgtgacagaaggagagctgaagtcctggatcaagcacgcccagaagaagtacatctatgacaacgtggagaaccagtggcaggagtttgacatgaaccaggacggcctcatctcctgggatgagtacagaaatgtgacctacggcacctacctggatgatcctgaccctgatgatggcttcaactacaagcagatgatggtgagagatgagcggcgcttcaagatggctgacaaggatggagacctgattgccaccaaggaggagttcaccgccttcctgcaccctgaggagtatgactacatgaaggacatcgtggtgcaggagaccatggaggacatcgacaagaatgctgatggcttcatcgacctggaggagtacatcggggacatgtacagccatgatggcaacacagatgagcctgagtgggtgaagacagagcgggagcagtttgtggagttccgggacaagaacagagatggcaagatggacaaggaggagaccaaggactggatcctgcccagcgactatgaccacgccgaggccgaggcccggcacctggtgtatgaaagtgaccagaacaaggatggcaagctgaccaaggaggagatcgtggacaagtatgacctgtttgtgggcagccaggccacagactttggagaggccctggtgagacatgatgagttctag

SEQ ID NO: 146037 - DNA, 1116 bp, Artificial Sequence
  Description of Artificial Sequence: Synthetic coding sequence
atggagctggagctggatgctggggaccaggacctgctggccttcctgctggaggagagcggggacctgggcacagccccagatgaggccgtgcgggcccccctggactgggccctgcccctgtctgaggtgcccagcgactgggaggtggatgacctgctgtgcagcctgctgagccccccagccagcctgaacatcctgagcagcagcaacccctgcctggtgcaccacgaccacacctacagcctgccccgggagaccgtgtccatggacctggagagcgagagctgcaggaaggagggcacccagatgaccccccagcacatggaggagctggccgagcaggagatcgcccggctggtgctgacagatgaggagaagagcctgctggagaaggagggcctcatcctgcctgagaccctgcccctgaccaagacagaggagcagatcctgaagagggtgcggaggaagatccggaacaagaggtctgcccaggagagcaggaggaagaagaaggtgtatgtgggcggcctggagagccgggtgctgaagtacacagcccagaacatggagctgcagaacaaggtgcagctgctggaggagcagaacctgagcctgctggaccagctgaggaagctgcaggccatggtgattgagatcagcaacaagaccagcagcagcagcacctgcatcctggtgctgctggtgtccttctgcctgctgctggtgcctgccatgtacagcagtgacacccggggcagcctgcctgctgagcacggcgtgctgagccggcagctgcgggccctgcccagcgaggacccctaccagctggagctgcctgccctgcagagcgaggtgcccaaggacagcacccaccagtggctggatggcagtgactgtgtgctgcaggcccctggcaacaccagctgcctgctgcactacatgccccaggcccccagcgctgagccccccctggagtggcccttcccagacctcttcagcgagcccctgtgccggggccccatcctgcccctgcaggccaacctgaccaggaagggcggctggctgcccaccggcagccccagcgtcatcctgcaggaccgctacagcggctag

SEQ ID NO: 146038 - DNA, 1386 bp, Artificial Sequence
  Description of Artificial Sequence: Synthetic coding sequence
atgaacacagacctggccgccggcaagatggccagcgctgcctgcagcatggaccccatcgacagctttgagctgctggacctgctgtttgaccggcaggacggcatcctgcggcacgtggagctgggggagggctggggccacgtgaaggaccagcaggtgctgcccaacccagacagtgatgacttcctgagcagcatcctgggcagcggggacagcctgcccagcagccccctgtggagccctgagggcagtgacagcggcatcagcgaggacctgcccagcgacccccaggacaccccacccaggagcggccctgccaccagccctgctggctgccacccagcccagcccgggaagggcccctgcctgagctaccaccctggcaacagctgcagcaccaccaccccaggccctgtgatccaggtgcctgaggcctctgtgaccatcgacctggagatgtggagccctgggggccgcatctgtgccgagaagccagctgaccctgtggacctgagcccccgctgcaacctgactgtgaaggacctgctgctgagcggcagcagcggggacctgcagcagcaccacctgggcgccagctacctgctgcggcctggagctggccactgccaggagctggtgctgacagaagatgagaagaagctgctggccaaggagggcatcaccctgcccacccagctgcccctgaccaagtatgaggagcgggtgctgaagaagatccggaggaagatccggaacaagcagagcgcccaggagagcaggaagaagaagaaggagtacattgatggcctggagaccaggatgtctgcctgcacagcccagaaccaggagctgcagaggaaggtgctgcacctggagaagcagaacctgagcctgctggagcagctgaagaagctgcaggccatcgtggtgcagagcaccagcaagagcgcccagacaggcacctgtgtggccgtgctgctgctgagctttgccctgatcatcctgcccagcatcagccccttcggccccaacaagacagagagccctggggactttgcccctgtgcgggtcttcagcaggaccctgcacaatgatgctgccagccgggtggccgcagatgctgtgcccggcagcgaggcccctggccccaggcctgaggccgacaccacccgggaggagagccctggcagccctggagctgactggggcttccaggacacagccaacctgaccaacagcacagaggagctggacaatgccaccctggtgctgagaaatgccacagagggcctgggccaggtggccctgctggactgggtggcccctggccccagcactggaagtggccgggccggcctggaggccgctggagatgagctgtag

SEQ ID NO: 146039 - DNA, 900 bp, Artificial Sequence
  Description of Artificial Sequence: Synthetic coding sequence
atggccagcgctgcctgcagcatggaccccatcgacagctttgagctgctggacctgctgtttgaccggcaggacggcatcctgcggcacgtggagctgggggagggctggggccacgtgaaggaccaggtgctgcccaacccagacagtgatgacttcctgagcagcatcctgggcagcggggacagcctgcccagcagccccctgtggagccctgagggcagtgacagcggcatcagcgaggacctgcccagcgacccccaggacaccccacccaggagcggccctgccaccagccctgctggctgccacccagcccagcccgggaagggcccctgcctgagctaccaccctggcaacagctgcagcaccaccaccccaggccctgtgatccagcagcagcaccacctgggcgccagctacctgctgcggcctggagctggccactgccaggagctggtgctgacagaagatgagaagaagctgctggccaaggagggcatcaccctgcccacccagctgcccctgaccaagtatgaggagcgggtgctgaagaagatccggaggaagatccggaacaagcagagcgcccaggagagcaggaagaagaagaaggagtacattgatggcctggagaccaggagctgctgctgccccctgcccagcagcagcagcccccccagcgccctgctggcccccaccaagccccgggccctgggcaccctgcggctgtatgagtgcagccctgagctgtgcaccaccatgctgcccccagcctggctgctgatgctgtgccaggccccccggccccaggaccctgacccccggctgacccagcctgagaagagcctgcaggaggcccctggccagacaggagccagcaggacccccaggacatag

SEQ ID NO: 146040 - DNA, 1260 bp, Artificial Sequence
  Description of Artificial Sequence: Synthetic coding sequence
atgaacacagacctggccgccggcaagatggccagcgctgcctgcagcatggaccccatcgacagctttgagctgctggacctgctgtttgaccggcaggacggcatcctgcggcacgtggagctgggggagggctggggccacgtgaaggaccagcaggtgctgcccaacccagacagtgatgacttcctgagcagcatcctgggcagcggggacagcctgcccagcagccccctgtggagccctgagggcagtgacagcggcatcagcgaggacctgcccagcgacccccaggacaccccacccaggagcggccctgccaccagccctgctggctgccacccagcccagcccgggaagggcccctgcctgagctaccaccctggcaacagctgcagcaccaccaccccaggccctgtgatccaggtgcctgaggcctctgtgaccatcgacctggagatgtggagccctgggggccgcatctgtgccgagaagccagctgaccctgtggacctgagcccccgctgcaacctgactgtgaaggacctgctgctgagcggcagcagcggggacctgcagcagcaccacctgggcgccagctacctgctgcggcctggagctggccactgccaggagctggtgctgacagaagatgagaagaagctgctggccaaggagggcatcaccctgcccacccagctgcccctgaccaagtatgaggagcgggtgctgaagaagatccggaggaagatccggaacaagcagagcgcccaggagagcaggaagaagaagaaggccatcgtggtgcagagcaccagcaagagcgcccagacaggcacctgtgtggccgtgctgctgctgagctttgccctgatcatcctgcccagcatcagccccttcggccccaacaagacagagagccctggggactttgcccctgtgcgggtcttcagcaggaccctgcacaatgatgctgccagccgggtggccgcagatgctgtgcccggcagcgaggcccctggccccaggcctgaggccgacaccacccgggaggagagccctggcagccctggagctgactggggcttccaggacacagccaacctgaccaacagcacagaggagctggacaatgccaccctggtgctgagaaatgccacagagggcctgggccaggtggccctgctggactgggtggcccctggccccagcactggaagtggccgggccggcctggaggccgctggagatgagctgtag

SEQ ID NO: 146041 - DNA, 1188 bp, Artificial Sequence
  Description of Artificial Sequence: Synthetic coding sequence
atggacctgggcatcccagacctgctggatgcctggctggagcccccagaggacatcttcagcacaggctctgtgctggagctgggcctgcactgccccccacctgaggtgcctgtgacccggctgcaggagcagggcctgcagggctggaagagcggcggggaccggggctgcggcctgcaggagagcgagcctgaggacttcctgaagctgttcatcgaccccaatgaggtgtactgcagcgaggccagccctggcagtgacagcggcatcagcgaggacccctgccacccagacagccccccagccccccgggccaccagcagccccatgctgtatgaggtggtgtatgaagctggggccctggagaggatgcagggcgagaccggccccaacgtgggcctcatcagcatccagctggaccagtggagccctgccttcatggtgcctgacagctgcatggtgtctgagctgccctttgatgcccacgcccacatcctgccccgggccggcaccgtggcccctgtgccctgcaccaccctgctgccctgccagaccctcttcctgacagatgaggagaagaggctgctgggccaggagggcgtgtccctgcccagccacctgcccctgaccaaggccgaggagcgggtgctgaagaaggtgcggaggaagatccggaacaagcagagcgcccaggacagcagaagaaggaagaaggagtacattgatggcctggagagccgggtggccgcctgcagcgcccagaaccaggagctgcagaagaaggtgcaggagctggagcggcacaacatcagcctggtggcccagctgcggcagctgcagaccctcatcgcccagaccagcaacaaggccgcccagaccagcacctgtgtgctgatcctgctcttcagcctggccctgatcatcctgcccagcttcagccccttccagagcaggcctgaggccggcagcgaggactaccagccccacggcgtgaccagcaggaacatcctgacccacaaggatgtgacagagaacctggagacccaggtggtggagagccggctgcgggagcccccaggggccaaggatgccaacggcagcaccaggaccctgctggagaagatgggcggcaagccccggcccagcggccgcatccgctctgtgctgcacgcagatgagatgtag

SEQ ID NO: 146042 - DNA, 1128 bp, Artificial Sequence
  Description of Artificial Sequence: Synthetic coding sequence
atggacctgggcatcccagacctgctggatgcctggctggagcccccagaggacatcttcagcacaggctctgtgctggagctgggcctgcactgccccccacctgaggtgcccggcctgcaggagagcgagcctgaggacttcctgaagctgttcatcgaccccaatgaggtgtactgcagcgaggccagccctggcagtgacagcggcatcagcgaggacccctgccacccagacagccccccagccccccgggccaccagcagccccatgctgtatgaggtggtgtatgaagctggggccctggagaggatgcagggcgagaccggccccaacgtgggcctcatcagcatccagctggaccagtggagccctgccttcatggtgcctgacagctgcatggtgtctgagctgccctttgatgcccacgcccacatcctgccccgggccggcaccgtggcccctgtgccctgcaccaccctgctgccctgccagaccctcttcctgacagatgaggagaagaggctgctgggccaggagggcgtgtccctgcccagccacctgcccctgaccaaggccgaggagcgggtgctgaagaaggtgcggaggaagatccggaacaagcagagcgcccaggacagcagaagaaggaagaaggagtacattgatggcctggagagccgggtggccgcctgcagcgcccagaaccaggagctgcagaagaaggtgcaggagctggagcggcacaacatcagcctggtggcccagctgcggcagctgcagaccctcatcgcccagaccagcaacaaggccgcccagaccagcacctgtgtgctgatcctgctcttcagcctggccctgatcatcctgcccagcttcagccccttccagagcaggcctgaggccggcagcgaggactaccagccccacggcgtgaccagcaggaacatcctgacccacaaggatgtgacagagaacctggagacccaggtggtggagagccggctgcgggagcccccaggggccaaggatgccaacggcagcaccaggaccctgctggagaagatgggcggcaagccccggcccagcggccgcatccgctctgtgctgcacgcagatgagatgtag

SEQ ID NO: 146043 - DNA, 654 bp, Artificial Sequence
  Description of Artificial Sequence: Synthetic coding sequence
atggacctgggcatcccagacctgctggatgcctggctggagcccccagaggacatcttcagcacaggctctgtgctggagctgggcctgcactgccccccacctgaggtgcctgtgacccggctgcaggagcagggcctgcagggctggaagagcggcggggaccggggctgcggcctgcaggagagcgagcctgaggacttcctgaagctgttcatcgaccccaatgaggtgtactgcagcgaggccagccctggcagtgacagcggcatcagcgaggacccctgccacccagacagccccccagccccccgggccaccagcagccccatgctgtatgaggtggtgtatgaagctggggccctggagaggatgcagggcgagaccggccccaacgtgggcctcatcagcatccagctggaccagtggagccctgccttcatggtgcctgacagctgcatggtgtctgagctgccctttgatgcccacgcccacatcctgccccgggccggcaccgtggcccctgtgccctgcaccaccctgctgccctgccagaccctcttcctgacagatgaggagaagaggctgctgggccaggagggcgtgtccctgcccagccacctgcccctgaccaaggtgacctgcttcccctag

SEQ ID NO: 146044 - DNA, 1188 bp, Artificial Sequence; identical to SEQ ID NO: 146041
  Description of Artificial Sequence: Synthetic coding sequence

SEQ ID NO: 146045 - DNA, 1188 bp, Artificial Sequence; identical to SEQ ID NO: 146041
  Description of Artificial Sequence: Synthetic coding sequence

SEQ ID NO: 146046 - DNA, 747 bp, Artificial Sequence
  Description of Artificial Sequence: Synthetic coding sequence
atggtgcctgacagctgcatggtgtctgagctgccctttgatgcccacgcccacatcctgcccagggctggcaccgtggcccctgtgccctgcaccaccctgctgccctgccagaccctcttcctgacagatgaggagaagaggctgctgggccaggagggcgtgtccctgcccagccacctgcccctgaccaaggccgaggagcgggtgctgaagaaggtgcggaggaagatccggaacaagcagagcgcccaggacagcagaagaaggaagaaggagtacattgatggcctggagagccgggtggccgcctgcagcgcccagaaccaggagctgcagaagaaggtgcaggagctggagcggcacaacatcagcctggtggcccagctgcggcagctgcagaccctgattgcccagaccagcaacaaggccgcccagaccagcacctgtgtgctgatcctgctcttcagcctggccctgatcatcctgcccagcttcagccccttccagagcaggcctgaggccggcagcgaggactaccagccccatggagtgaccagcaggaacatcctgacccacaaggatgtgacagagaacctggagacccaggtggtggagagccggctgcgggagcccccaggggccaaggatgccaacggcagcaccaggaccctgctggagaagatgggcggcaagccccggcccagcggccgcatccgctctgtgctgcatgctgatgagatgtag

SEQ ID NO: 146047 - DNA, 549 bp, Artificial Sequence
  Description of Artificial Sequence: Synthetic coding sequence
atggacctgggcatcccagacctgctggatgcctggctggagcccccagaggacatcttcagcacaggctctgtgctggagctgggcctgcactgccccccacctgaggtgcctgtgacccggctgcaggagcagggcctgcagggctggaagagcggcggggaccggggctgcggcctgcaggagagcgagcctgaggacttcctgaagctgttcatcgaccccaatgaggtgtactgcagcgaggccagccctggcagtgacagcggcatcagcgaggacccctgccacccagacagccccccagccccccgggccaccagcagccccatgctgtatgaggtggtgtatgaagctggggccctggagaggatgcagggcgagaccggccccaacgtgggcctcatcagcatccagctggaccagtggagccctgccttcatggtgcctgacagctgcatggtgtctgagctgccctttgatgcccacgcccacatcctgccccgggccggcaccgtggcccctgtgccctgcaccaccctggtgtag

SEQ ID NO: 146048 - DNA, 687 bp, Artificial Sequence
  Description of Artificial Sequence: Synthetic coding sequence
atggacctgggcatcccagacctgctggatgcctggctggagcccccagaggacatcttcagcacaggctctgtgctggagctgggcctgcactgccccccacctgaggtgcccggcctgcaggagagcgagcctgaggacttcctgaagctgttcatcgaccccaatgaggtgtactgcagcgaggccagccctggcagtgacagcggcatcagcgaggacccctgccacccagacagccccccagccccccgggccaccagcagccccatgctgtatgaggtggtgtatgaagctggggccctggagaggatgcagggcgagaccggccccaacgtgggcctcatcagcatccagctggaccagtggagccctgccttcatggtgcctgacagctgcatggtgtctgagctgccctttgatgcccacgcccacatcctgccccgggccggcaccgtggcccctgtgccctgcaccaccctgctgccctgccagaccctcttcctgacagatgaggagaagaggctgctgggccaggagggcgtgtccctgcccagccacctgcccctgaccaaggccgaggagcgggtgctgaagaaggtgcggaggaagatccggaacaagcagagcgcccaggacagcagaagaaggaagaaggagtacattgatggcctggagagcaggtag

SEQ ID NO: 146049 - DNA, 1047 bp, Artificial Sequence
  Description of Artificial Sequence: Synthetic coding sequence
atgagcaaatgtgccaggaagaagtacatcaagaccaacccccggcagatgaccatggagaccgtggagagccagcatgatggcagcatcacagccagcctgacagagagcaagagcgcccacgtgcagacccagacaggccagaacagcatcccagccctggcccaggtgtctgtggccggcagcggcacccggcggggcagccctgctgtgaccctggtgcagctgcccagcggccagaccatccacgtgcagggcgtcatccagaccccccagccctgggtgatccagagcagcgagatccacacagtgcaggtggccgccatcgccgagacagatgaatctgctgagagcgagggcgtcatcgacagccacaagagaagagagatcctgagcagaagacccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacatcgccatcgcccagggcggcaccatccagatcagcaaccctggcagtgatggagtgcagggcctgcaggccctgaccatgaccaacagcggggcccctcctcctggggccaccatcgtgcagtatgctgcccagagcgcagatggcacccagcagttctttgtgcccggcagccaggtggtggtgcaggccgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgcccgggagtgcaggaggaagaagaaggagtatgtgaagtgcctggagaacagagtggccgtgctggagaaccagaacaagaccctgattgaggagctgaaggccctgaaggacctgtactgccacaaggtggagtag

SEQ ID NO: 146050 - DNA, 900 bp, Artificial Sequence
  Description of Artificial Sequence: Synthetic coding sequence
atgagcaaatgtgccaggaagaagtacatcaagaccaacccccggcagatgaccatggagaccgtggagagccagcatgatggcagcatcacagccagcctgacagagagcaagagcgcccacgtgcagacccagacaggccagaacagcatcccagccctggcccaggtggccgccatcgccgagacagatgagagcgctgagagcgagggcgtgattgacagccacaagaggcgggagatcctgagccggcggcccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacatcgccatcgcccagggcggcaccatccagatcagcaaccctggcagtgatggagtgcagggcctgcaggccctgaccatgaccaacagcggggcccctcctcctggggccaccatcgtgcagtatgctgcccagagcgcagatggcacccagcagttctttgtgcccggcagccaggtggtggtgcaggccgccaccggggacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccagagaatgtagaaggaagaagaaggagtatgtgaagtgcctggagaacagagtggccgtgctggagaaccagaacaagaccctcatcgaggagctgaaggccctgaaggacctgtactgccacaaggtggagtag

SEQ ID NO: 146051 - DNA, 738 bp, Artificial Sequence
  Description of Artificial Sequence: Synthetic coding sequence
atggtggccgccatcgccgagacagatgaatctgctgagagcgagggcgtcatcgacagccacaagagaagagagatcctgagcagaagacccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacatcgccatcgcccagggcggcaccatccagatcagcaaccctggcagtgatggagtgcagggcctgcaggccctgaccatgaccaacagcggggcccctcctcctggggccaccatcgtgcagtatgctgcccagagcgcagatggcacccagcagttctttgtgcccggcagccaggtggtggtgcaggccgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggagtgcagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146052 - DNA, 288 bp, Artificial Sequence
  Description of Artificial Sequence: Synthetic coding sequence
atgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccagagaatgtagaaggaagaagaaggagtatgtgaagtgcctggagaacagagtggccgtgctggagaaccagaacaagaccctcatcgaggagctgaaggccctgaaggacctgtactgccacaaggtggagtag

SEQ ID NO: 146053 - DNA, 903 bp, Artificial Sequence
  Description of Artificial Sequence: Synthetic coding sequence
atgagcaaatgtgccaggaagaagtacatcaagaccaacccccggcagatgaccatggagaccgtggagagccagcatgatggcagcatcacagccagcctgacagagagcaagagcgcccacgtgcagacccagacaggccagaacagcatcccagccctggcccaggtggccgccatcgccgagacagatgagagcgctgagagcgagggcgtgattgacagccacaagaggcgggagatcctgagccggcggcccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacatcgccatcgcccagggcggcaccatccagatcagcaaccctggcagtgatggagtgcagggcctgcaggccctgaccatgaccaacagcggggcccctcctcctggggccaccatcgtgcagtatgctgcccagagcgcagatggcacccagcagttctttgtgcccggcagccaggtggtggtgcaggccgccaccggggacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggaatgtagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146054 - DNA, 666 bp, Artificial Sequence
  Description of Artificial Sequence: Synthetic coding sequence
atgaccatggagaccgtggagagccagcatgatggcagcatcacagccagcctgacagagagcaagagcgcccacgtgcagacccagacaggccagaacagcatcccagccctggcccaggtggccgccatcgccgagacagatgagagcgctgagagcgagggcgtgattgacagccacaagaggcgggagatcctgagccggcggcccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacacagccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggagtgcagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146055 - DNA, 747 bp, Artificial Sequence
  Description of Artificial Sequence: Synthetic coding sequence
atgagcaaatgtgccaggaagaagtacatcaagaccaacccccggcagatgaccatggagaccgtggagagccagcatgatggcagcatcacagccagcctgacagagagcaagagcgcccacgtgcagacccagacaggccagaacagcatcccagccctggcccaggtggccgccatcgccgagacagatgagagcgctgagagcgagggcgtgattgacagccacaagaggcgggagatcctgagccggcggcccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacaatgaggagacagagctggcccccagccacatggctgctgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgcccgggagtgcaggaggaagaagaaggagtatgtgaagtgcctggagaacagagtggccgtgctggagaaccagaacaagaccctgattgaggagctgaaggccctgaaggacctgtactgccacaaggtggagtag

SEQ ID NO: 146056 - DNA, 327 bp, Artificial Sequence
  Description of Artificial Sequence: Synthetic coding sequence
atggctgtgactggagatgacacagctgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgcccgggagtgcaggaggaagaagaaggagtatgtgaagtgcctggagaacagagtggccgtgctggagaaccagaacaagaccctgattgaggagctgaaggccctgaaggacctgtactgccacaaggtggagtag

SEQ ID NO: 146057 - DNA, 813 bp, Artificial Sequence
  Description of Artificial Sequence: Synthetic coding sequence
atgtggtggcaccagcacaacctgtgcttcagaagacccatcgaggaggactacagcagtggagatgtggaggagaaggtggccgccatcgccgagacagatgagagcgctgagagcgagggcgtgattgacagccacaagaggcgggagatcctgagccggcggcccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacatcgccatcgcccagggcggcaccatccagatcagcaaccctggcagtgatggagtgcagggcctgcaggccctgaccatgaccaacagcggggcccctcctcctggggccaccatcgtgcagtatgctgcccagagcgcagatggcacccagcagttctttgtgcccggcagccaggtggtggtgcaggccgccaccggggacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggaatgtagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146058 - DNA, 999 bp, Artificial Sequence
  Description of Artificial Sequence: Synthetic coding sequence
atgaccatggagaccgtggagagccagcatgatggcagcatcacagccagcctgacagagagcaagagcgcccacgtgcagacccagacaggccagaacagcatcccagccctggcccaggtgtctgtggccggcagcggcacccggcggggcagccctgctgtgaccctggtgcagctgcccagcggccagaccatccacgtgcagggcgtcatccagaccccccagccctgggtgatccagagcagcgagatccacacagtgcaggtggccgccatcgccgagacagatgaatctgctgagagcgagggcgtcatcgacagccacaagagaagagagatcctgagcagaagacccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacatcgccatcgcccagggcggcaccatccagatcagcaaccctggcagtgatggagtgcagggcctgcaggccctgaccatgaccaacagcggggcccctcctcctggggccaccatcgtgcagtatgctgcccagagcgcagatggcacccagcagttctttgtgcccggcagccaggtggtggtgcaggccgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgcccgggagtgcaggaggaagaagaaggagtatgtgaagtgcctggagaacagagtggccgtgctggagaaccagaacaagaccctgattgaggagctgaaggccctgaaggacctgtactgccacaaggtggagtag

SEQ ID NO: 146059 - DNA, 1002 bp, Artificial Sequence
  Description of Artificial Sequence: Synthetic coding sequence
atgaccatggagaccgtggagagccagcatgatggcagcatcacagccagcctgacagagagcaagagcgcccacgtgcagacccagacaggccagaacagcatcccagccctggcccaggtgtctgtggccggcagcggcacccggcggggcagccctgctgtgaccctggtgcagctgcccagcggccagaccatccacgtgcagggcgtcatccagaccccccagccctgggtgatccagagcagcgagatccacacagtgcaggtggccgccatcgccgagacagatgaatctgctgagagcgagggcgtcatcgacagccacaagagaagagagatcctgagcagaagacccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacatcgccatcgcccagggcggcaccatccagatcagcaaccctggcagtgatggagtgcagggcctgcaggccctgaccatgaccaacagcggggcccctcctcctggggccaccatcgtgcagtatgctgcccagagcgcagatggcacccagcagttctttgtgcccggcagccaggtggtggtgcaggccgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggagtgcagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146060 - DNA, 414 bp, Artificial Sequence
  Description of Artificial Sequence: Synthetic coding sequence
atgaccatggagaccgtggagagccagcatgatggcagcatcacagccagcctgacagagagcaagagcgcccacgtgcagacccagacaggccagaacagcatcccagccctggcccaggtggccgccatcgccgagacagatgagagcgctgagagcgagggcgtgattgacagccacaagaggcgggagatcctgagccggcggcccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacagcatgtatgctgccatccgctatgacacagtgctggccctgagcctgctgtag

SEQ ID NO: 146061 - DNA, 666 bp, Artificial Sequence; identical to SEQ ID NO: 146054
  Description of Artificial Sequence: Synthetic coding sequence

SEQ ID NO: 146062 - DNA, 711 bp, Artificial Sequence
  Description of Artificial Sequence: Synthetic coding sequence
atgagcaaatgtgccaggaagaagtacatcaagaccaacccccggcagatgaccatggagaccgtggagagccagcatgatggcagcatcacagccagcctgacagagagcaagagcgcccacgtgcagacccagacaggccagaacagcatcccagccctggcccaggtggccgccatcgccgagacagatgagagcgctgagagcgagggcgtgattgacagccacaagaggcgggagatcctgagccggcggcccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacacagccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgcccgggagtgcaggaggaagaagaaggagtatgtgaagtgcctggagaacagagtggccgtgctggagaaccagaacaagaccctgattgaggagctgaaggccctgaaggacctgtactgccacaaggtggagtag

SEQ ID NO: 146063 - DNA, 849 bp, Artificial Sequence
  Description of Artificial Sequence: Synthetic coding sequence
atgtggtggcaccagcacaacctgtgcttcagaagacccatcgaggaggactacagcagtggagatgtggaggagaaggtggccgccatcgccgagacagatgagagcgctgagagcgagggcgtgattgacagccacaagaggcgggagatcctgagccggcggcccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacatcgccatcgcccagggcggcaccatccagatcagcaaccctggcagtgatggagtgcagggcctgcaggccctgaccatgaccaacagcggggcccctcctcctggggccaccatcgtgcagtatgctgcccagagcgcagatggcacccagcagttctttgtgcccggcagccaggtggtggtgcaggatgaggagacagagctggcccccagccacatggccgccgccaccggggacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggaatgtagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146064 - DNA, 1086 bp, Artificial Sequence
  Description of Artificial Sequence: Synthetic coding sequence
atgagcaaatgtgccaggaagaagtacatcaagaccaacccccggcagatgaccatggagaccgtggagagccagcatgatggcagcatcacagccagcctgacagagagcaagagcgcccacgtgcagacccagacaggccagaacagcatcccagccctggcccaggtgtctgtggccggcagcggcacccggcggggcagccctgctgtgaccctggtgcagctgcccagcggccagaccatccacgtgcagggcgtcatccagaccccccagccctgggtgatccagagcagcgagatccacacagtgcaggtggccgccatcgccgagacagatgaatctgctgagagcgagggcgtcatcgacagccacaagagaagagagatcctgagcagaagacccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacatcgccatcgcccagggcggcaccatccagatcagcaaccctggcagtgatggagtgcagggcctgcaggccctgaccatgaccaacagcggggcccctcctcctggggccaccatcgtgcagtatgctgcccagagcgcagatggcacccagcagttctttgtgcccggcagccaggtggtggtgcaggatgaggagacagagctggcccccagccacatggctgctgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggagtgcagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146065 - DNA, 474 bp, Artificial Sequence
  Description of Artificial Sequence: Synthetic coding sequence
atgagcaaatgtgccaggaagaagtacatcaagaccaacccccggcagatgaccatggagaccgtggagagccagcatgatggcagcatcacagccagcctgacagagagcaagagcgcccacgtgcagacccagacaggccagaacagcatcccagccctggcccaggtggccgccatcgccgagacagatgagagcgctgagagcgagggcgtgattgacagccacaagaggcgggagatcctgagccggcggcccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacatcgccatcgcccagggcggcaccatccagatcagcaaccctggcagtgatggagtgcagggctag

SEQ ID NO: 146066 - DNA, 1038 bp, Artificial Sequence
  Description of Artificial Sequence: Synthetic coding sequence
atgaccatggagaccgtggagagccagcatgatggcagcatcacagccagcctgacagagagcaagagcgcccacgtgcagacccagacaggccagaacagcatcccagccctggcccaggtgtctgtggccggcagcggcacccggcggggcagccctgctgtgaccctggtgcagctgcccagcggccagaccatccacgtgcagggcgtcatccagaccccccagccctgggtgatccagagcagcgagatccacacagtgcaggtggccgccatcgccgagacagatgaatctgctgagagcgagggcgtcatcgacagccacaagagaagagagatcctgagcagaagacccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacatcgccatcgcccagggcggcaccatccagatcagcaaccctggcagtgatggagtgcagggcctgcaggccctgaccatgaccaacagcggggcccctcctcctggggccaccatcgtgcagtatgctgcccagagcgcagatggcacccagcagttctttgtgcccggcagccaggtggtggtgcaggatgaggagacagagctggcccccagccacatggctgctgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggagtgcagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146067 - DNA, 858 bp, Artificial Sequence
  Description of Artificial Sequence: Synthetic coding sequence
atgagcaaatgtgccaggaagaagtacatcaagaccaacccccggcagatgaccatggagaccgtggagagccagcatgatggcagcatcacagccagcctgacagagagcaagagcgcccacgtgcagacccagacaggccagaacagcatcccagccctggcccaggtgtctgtggccggcagcggcacccggcggggcagccctgctgtgaccctggtgcagctgcccagcggccagaccatccacgtgcagggcgtcatccagaccccccagccctgggtgatccagagcagcgagatccacacagtgcaggtggccgccatcgccgagacagatgaatctgctgagagcgagggcgtcatcgacagccacaagagaagagagatcctgagcagaagacccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacacagccaccggggacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccagagaatgtagaaggaagaagaaggagtatgtgaagtgcctggagaacagagtggccgtgctggagaaccagaacaagaccctcatcgaggagctgaaggccctgaaggacctgtactgccacaaggtggagtag

SEQ ID NO: 146068 - DNA, 288 bp, Artificial Sequence; identical to SEQ ID NO: 146052
  Description of Artificial Sequence: Synthetic coding sequence

SEQ ID NO: 146069 - DNA, 810 bp, Artificial Sequence
  Description of Artificial Sequence: Synthetic coding sequence
atgaccatggagaccgtggagagccagcatgatggcagcatcacagccagcctgacagagagcaagagcgcccacgtgcagacccagacaggccagaacagcatcccagccctggcccaggtgtctgtggccggcagcggcacccggcggggcagccctgctgtgaccctggtgcagctgcccagcggccagaccatccacgtgcagggcgtcatccagaccccccagccctgggtgatccagagcagcgagatccacacagtgcaggtggccgccatcgccgagacagatgaatctgctgagagcgagggcgtcatcgacagccacaagagaagagagatcctgagcagaagacccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacacagccaccggggacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccagagaatgtagaaggaagaagaaggagtatgtgaagtgcctggagaacagagtggccgtgctggagaaccagaacaagaccctcatcgaggagctgaaggccctgaaggacctgtactgccacaaggtggagtag

SEQ ID NO: 146070 - DNA, 585 bp, Artificial Sequence
  Description of Artificial Sequence: Synthetic coding sequence
atggtggccgccatcgccgagacagatgaatctgctgagagcgagggcgtcatcgacagccacaagagaagagagatcctgagcagaagacccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacaatgaggagacagagctggcccccagccacatggccgccgccaccggggacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggaatgtagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146071 - DNA, 363 bp, Artificial Sequence
  Description of Artificial Sequence: Synthetic coding sequence
atggctgtgactggagatgacacagatgaggagacagagctggcccccagccacatggctgctgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgcccgggagtgcaggaggaagaagaaggagtatgtgaagtgcctggagaacagagtggccgtgctggagaaccagaacaagaccctgattgaggagctgaaggccctgaaggacctgtactgccacaaggtggagtag

SEQ ID NO: 146072 - DNA, 291 bp, Artificial Sequence
  Description of Artificial Sequence: Synthetic coding sequence
atgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggaatgtagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146073 - DNA, 339 bp, Artificial Sequence
  Description of Artificial Sequence: Synthetic coding sequence
atgaacagaacccaggagctgagcggccagctgtctgctgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgcccgggagtgcaggaggaagaagaaggagtatgtgaagtgcctggagaacagagtggccgtgctggagaaccagaacaagaccctgattgaggagctgaaggccctgaaggacctgtactgccacaaggtggagtag

SEQ ID NO: 146074 - DNA, 939 bp, Artificial Sequence
  Description of Artificial Sequence: Synthetic coding sequence
atgagcaaatgtgccaggaagaagtacatcaagaccaacccccggcagatgaccatggagaccgtggagagccagcatgatggcagcatcacagccagcctgacagagagcaagagcgcccacgtgcagacccagacaggccagaacagcatcccagccctggcccaggtggccgccatcgccgagacagatgagagcgctgagagcgagggcgtgattgacagccacaagaggcgggagatcctgagccggcggcccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacatcgccatcgcccagggcggcaccatccagatcagcaaccctggcagtgatggagtgcagggcctgcaggccctgaccatgaccaacagcggggcccctcctcctggggccaccatcgtgcagtatgctgcccagagcgcagatggcacccagcagttctttgtgcccggcagccaggtggtggtgcaggatgaggagacagagctggcccccagccacatggccgccgccaccggggacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggaatgtagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146075 - DNA, 660 bp, Artificial Sequence
  Description of Artificial Sequence: Synthetic coding sequence
atgtggtggcaccagcacaacctgtgcttcagaagacccatcgaggaggactacagcagtggagatgtggaggagaaggtggccgccatcgccgagacagatgagagcgctgagagcgagggcgtgattgacagccacaagaggcgggagatcctgagccggcggcccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacaatgaggagacagagctggcccccagccacatggctgctgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggagtgcagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146076 - DNA, 366 bp, Artificial Sequence
  Description of Artificial Sequence: Synthetic coding sequence
atggctgtgactggagatgacacagatgaggagacagagctggcccccagccacatggctgctgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggagtgcagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146077 - DNA, 330 bp, Artificial Sequence
  Description of Artificial Sequence: Synthetic coding sequence
atggctgtgactggagatgacacagctgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggagtgcagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146078 - DNA, 309 bp, Artificial Sequence
  Description of Artificial Sequence: Synthetic coding sequence
atggctgctgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgcccgggagtgcaggaggaagaagaaggagtatgtgaagtgcctggagaacagagtggccgtgctggagaaccagaacaagaccctgattgaggagctgaaggccctgaaggacctgtactgccacaaggtggagtag

SEQ ID NO: 146079 - DNA, 414 bp, Artificial Sequence; identical to SEQ ID NO: 146060
  Description of Artificial Sequence: Synthetic coding sequence

SEQ ID NO: 146080 - DNA, 618 bp, Artificial Sequence
  Description of Artificial Sequence: Synthetic coding sequence
atgaccatggagaccgtggagagccagcatgatggcagcatcacagccagcctgacagagagcaagagcgcccacgtgcagacccagacaggccagaacagcatcccagccctggcccaggtggtggccatcgcccagggcggcaccatccagatcagcaaccctggcagtgatggagtgcagggcctgcaggccctgaccatgaccaacagcggggcccctcctcctggggccaccatcgtgcagtatgctgcccagagcgcagatggcacccagcagttctttgtgcccggcagccaggtggtggtgcaggccgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggagtgcagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146081 - DNA, 813 bp, Artificial Sequence
  Description of Artificial Sequence: Synthetic coding sequence
atgaccatggagaccgtggagagccagcatgatggcagcatcacagccagcctgacagagagcaagagcgcccacgtgcagacccagacaggccagaacagcatcccagccctggcccaggtgtctgtggccggcagcggcacccggcggggcagccctgctgtgaccctggtgcagctgcccagcggccagaccatccacgtgcagggcgtcatccagaccccccagccctgggtgatccagagcagcgagatccacacagtgcaggtggccgccatcgccgagacagatgaatctgctgagagcgagggcgtcatcgacagccacaagagaagagagatcctgagcagaagacccagctacaggaagatcctgaatgagctgagcagtgatgtgcctggggtgcccaagattgaggaggagaggtctgaggaggagggcaccccacccagcatcgccaccatggctgtgcccaccagcatctaccagaccagcacaggccagtacacagccaccggggacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggaatgtagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146082 - DNA, 342 bp, Artificial Sequence
  Description of Artificial Sequence: Synthetic coding sequence
atgaacagaacccaggagctgagcggccagctgtctgctgccactggagacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggagtgcagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146083 - DNA, 465 bp, Artificial Sequence
  Description of Artificial Sequence: Synthetic coding sequence
atgaccatggagaccgtggagagccagcatgatggcagcatcacagccagcctgacagagagcaagagcgcccacgtgcagacccagacaggccagaacagcatcccagccctggcccaggtggatgaggagacagagctggcccccagccacatggccgccgccaccggggacatgcccacctaccagatccgggcccccacagctgccctgccccagggcgtggtgatggccgccagccctggcagcctgcacagcccccagcagctggccgaggaggccaccaggaagcgggagctgcggctgatgaagaaccgggaggccgccaaggaatgtagaagaaggaagaaggagtatgtgaagtgcctggagagccgggtggccgtgctggaggtgcagaacaagaagctgattgaggagctggagaccctgaaggacatctgcagccccaagacagactactag

SEQ ID NO: 146084 - DNA, 339 bp, Artificial Sequence
  Description of Artificial Sequence: Synthetic coding sequence
atgtctgctgaggtgcctgaggccgccagcgctgaggagcagaaggagatggaggacaaggtgaccagccctgagaaggccgaggaggccaagctgaaggcccgctacccccacctgggccagaagccaggcggcagtgacttcctgaggaagaggctgcagaagggccagaagtactttgacagcggggactacaacatggccaaggccaagatgaagaacaagcagctgcccacagctgccccagacaagacagaggtgactggagaccacatccccaccccccaggacctgccccagaggaagcccagcctggtggccagcaagctggccggctag

SEQ ID NO: 146085 - DNA, 1926 bp, Artificial Sequence
  Description of Artificial Sequence: Synthetic coding sequence
atgacagagaagccagagttccagagccaggtgtacaactatgccaaggacaacaacatcaagcaggacagcttcaaggaggagaaccccatggagacctctgtgtctgccaacacagaccagctgggcaatgagtacttccggcagcccccacccaggagccccccactcatccactgcagcggggagatgctgaagttcacagagaagagcctggccaagagcatcgccaaggagagcgccctgaaccccagccagcccccatccttcctgtgcaagacagctgtgcccagcaaggagatccagaactacggggagatccctgagatgtctgtgtcctatgagaaggaggtgacagctgagggcgtggagaggcctgagatcgtgtccacctggagcagcgctggcatctcctggaggtctgaggcctgccgggagaactgtgagatgccagactgggagcagagcgctgagagcctgcagcctgtgcaggaggacatggccctgaatgaggtgctgcagaagctgaagcacaccaacaggaagcaggaggtgcgcatccaggagctgcagtgcagcaacctgtacctggagaagagggtgaaggagctgcagatgaagatcaccaagcagcaggtgttcattgatgtgatcaacaagctgaaggaaaatgtggaggagctgattgaggacaagtacaagatcatcctggagaagaatgacaccaagaagaccctgcagaacctggaggaggtgctggccaacacccagaagcacctgcaggagagcagaaatgacaaggagatgctgcagctgcagttcaagaagatcaaggccaactacgtgtgcctgcaggagcgctacatgacagagatgcagcagaagaacaagtctgtgtcccagtacctggagatggacaagaccctgagcaagaaggaggaggaggtggagcggctgcagcagctgaagaaggagctggagaaggccacagccagcgccctggacctgctgaagcgggagaaggaggcccaggagcaggagttcctgagcctgcaggaggagttccagaagctggagaaggagaacctggaggagcggcagaagctgaagagccggctggagaagctgctgacccaggtgaggaacctgcagttcatgtctgaaaatgaaagaaccaagaacatcaagctgcagcagcagatcaatgaggtgaagaatgaaaatgccaagctgaagcagcaggtggcccggtctgaggagcagaactacgtgcccaagtttgaaacagcccagctgaaggaccagctggaggaggtgctgaagagtgacatcaccaaggacaccaagaccacccacagcaacctgctgcctgactgcagcccctgtgaggagcggctgaacccagctgacatcaagagggccagccagctggccagcaagatgcacagcctgctggccctgatggtgggcctgctgacctgccaggacatcatcaacagtgatgctgagcacttcaaggagagcgagaaggtgtctgacatcatgctgcagaagctgaagagcctgcacctgaagaagaagaccctggacaaggaggtgattgactgtgacagtgatgaggccaagagcatcagagatgtgcccaccctgctgggcgccaagctggacaagtaccacagcctgaatgaggagctggacttcctggtgaccagctatgaggagatcattgaatgtgccgaccagaggctggccatcagccacagccagatcgcccacctggaggagaggaacaagcacctggaggacctgatcaggaagccccgggagaaggccaggaagcccaggagcaagagcctggagaaccaccccaagtccatgaccatgatgcctgccctcttcaaggaaaatagaaatgacctggactag

SEQ ID NO: 146086 - DNA, 2475 bp, Artificial Sequence
  Description of Artificial Sequence: Synthetic coding sequence
atgaacaaggactaccagaagttctggagcagccccagcgaccctgtgcactttgaggtggacaccagccatgagaaggtggagagcatgtctgagagtgacaccatgaatgtgagcaacctgagccagggcgtgatgctgagccacagccccatctgcatggagaccaccggcaccacctgtgacctgccccagaatgagatcaagaactttgagcgggagaatgaatatgagagcaccctgtgtgaagatgcctacggcaccctggacaacctgctgaatgacaacaacatcgagaactacagcaccaatgccctgatccagcctgtggacaccatcagcatcagcagcctgcggcagtttgaaacagtgtgcaagttccactgggtggaggcctttgatgatgagatgacagagaagccagagttccagagccaggtgtacaactatgccaaggacaacaacatcaagcaggacagcttcaaggaggagaaccccatggagacctctgtgtctgccaacacagaccagctgggcaatgagtacttccggcagcccccacccaggagccccccactcatccactgcagcggggagatgctgaagttcacagagaagagcctggccaagagcatcgccaaggagagcgccctgaaccccagccagcccccatccttcctgtgcaagacagctgtgcccagcaaggagatccagaactacggggagatccctgagatgtctgtgtcctatgagaaggaggtgacagctgagggcgtggagaggcctgagatcgtgtccacctggagcagcgctggcatctcctggaggtctgaggcctgccgggagaactgtgagatgccagactgggagcagagcgctgagagcctgcagcctgtgcaggaggacatggccctgaatgaggtgctgcagaagctgaagcacaccaacaggaagcaggaggtgcgcatccaggagctgcagtgcagcaacctgtacctggagaagagggtgaaggagctgcagatgaagatcaccaagcagcaggtgttcattgatgtgatcaacaagctgaaggaaaatgtggaggagctgattgaggacaagtacaagatcatcctggagaagaatgacaccaagaagaccctgcagaacctggaggaggtgctggccaacacccagaagcacctgcaggagagcagaaatgacaaggagatgctgcagctgcagttcaagaagatcaaggccaactacgtgtgcctgcaggagcgctacatgacagagatgcagcagaagaacaagtctgtgtcccagtacctggagatggacaagaccctgagcaagaaggaggaggaggtggagcggctgcagcagctgaagaaggagctggagaaggccacagccagcgccctggacctgctgaagcgggagaaggaggcccaggagcaggagttcctgagcctgcaggaggagttccagaagctggagaaggagaacctggaggagcggcagaagctgaagagccggctggagaagctgctgacccaggtgaggaacctgcagttcatgtctgaaaatgaaagaaccaagaacatcaagctgcagcagcagatcaatgaggtgaagaatgaaaatgccaagctgaagcagcaggtggcccggtctgaggagcagaactacgtgcccaagtttgaaacagcccagctgaaggaccagctggaggaggtgctgaagagtgacatcaccaaggacaccaagaccacccacagcaacctgctgcctgactgcagcccctgtgaggagcggctgaacccagctgacatcaagagggccagccagctggccagcaagatgcacagcctgctggccctgatggtgggcctgctgacctgccaggacatcatcaacagtgatgctgagcacttcaaggagagcgagaaggtgtctgacatcatgctgcagaagctgaagagcctgcacctgaagaagaagaccctggacaaggagctgctgaagcacaaggaccgcatcaccaccttccgggagctgattgccaaggagaaggccttccaggaccacgccatcaaggtgattgactgtgacagtgatgaggccaagagcatcagagatgtgcccaccctgctgggcgccaagctggacaagtaccacagcctgaatgaggagctggacttcctggtgaccagctatgaggagatcattgaatgtgccgaccagaggctggccatcagccacagccagatcgcccacctggaggagaggaacaagcacctggaggacctgatcaggaagccccgggagaaggccaggaagcccaggagcaagagcctggagaaccaccccaagtccatgaccatgctggcctacaacctgtacatcttcatcggctaccgcctgggcgctgtggctgatgcctgcaaccccagcaccctgggcggccggggcggctggatcacctag

SEQ ID NO: 146087 - DNA, 2334 bp, Artificial Sequence
  Description of Artificial Sequence: Synthetic coding sequence
atgaacaaggactaccagaagttctggagcagccccagcgaccctgtgcactttgaggtggacaccagccatgagaaggtggagagcatgtctgagagtgacaccatgaatgtgagcaacctgagccagggcgtgatgctgagccacagccccatctgcatggagaccaccggcaccacctgtgacctgccccagaatgagatcaagaactttgagcgggagaatgaatatgagagcaccctgtgtgaagatgcctacggcaccctggacaacctgctgaatgacaacaacatcgagaactacagcaccaatgccctgatccagcctgtggacaccatcagcatcagcagcctgcggcagtttgaaacagtgtgcaagttccactgggtggaggcctttgatgatgagatgacagagaagccagagttccagagccaggtgtacaactatgccaaggacaacaacatcaagcaggacagcttcaaggaggagaaccccatggagacctctgtgtctgccaacacagaccagctgggcaatgagtacttccggcagcccccacccaggagccccccactcatccactgcagcggggagatgctgaagttcacagagaagagcctggccaagagcatcgccaaggagagcgccctgaaccccagccagcccccatccttcctgtgcaagacagctgtgcccagcaaggagatccagaactacggggagatccctgagatgtctgtgtcctatgagaaggaggtgacagctgagggcgtggagaggcctgagatcgtgtccacctggagcagcgctggcatctcctggaggtctgaggcctgccgggagaactgtgagatgccagactgggagcagagcgctgagagcctgcagcctgtgcaggaggacatggccctgaatgaggtgctgcagaagctgaagcacaccaacaggaagcaggaggtgcgcatccaggagctgcagtgcagcaacctgtacctggagaagagggtgaaggagctgcagatgaagatcaccaagcagcaggtgttcattgatgtgatcaacaagctgaaggaaaatgtggaggagctgattgaggacaagtacaagatcatcctggagaagaatgacaccaagaagaccctgcagaacctggaggaggtgctggccaacacccagaagcacctgcaggagagcagaaatgacaaggagatgctgcagctgcagttcaagaagatcaaggccaactacgtgtgcctgcaggagcgctacatgacagagatgcagcagaagaacaagtctgtgtcccagtacctggagatggacaagaccctgagcaagaaggaggaggaggtggagcggctgcagcagctgaagaaggagctggagaaggccacagccagcgccctggacctgctgaagcgggagaaggaggcccaggagcaggagttcctgagcctgcaggaggagttccagaagctggagaaggagaacctggaggagcggcagaagctgaagagccggctggagaagctgctgacccaggtgaggaacctgcagttcatgtctgaaaatgaaagaaccaagaacatcaagctgcagcagcagatcaatgaggtgaagaatgaaaatgccaagctgaagcagcaggtggcccggtctgaggagcagaactacgtgcccaagtttgaaacagcccagctgaaggaccagctggaggaggtgctgaagagtgacatcaccaaggacaccaagaccacccacagcaacctgctgcctgactgcagcccctgtgaggagcggctgaacccagctgacatcaagagggccagccagctggccagcaagatgcacagcctgctggccctgatggtgggcctgctgacctgccaggacatcatcaacagtgatgctgagcacttcaaggagagcgagaaggtgtctgacatcatgctgcagaagctgaagagcctgcacctgaagaagaagaccctggacaaggaggtgattgactgtgacagtgatgaggccaagagcatcagagatgtgcccaccctgctgggcgccaagctggacaagtaccacagcctgaatgaggagctggacttcctggtgaccagctatgaggagatcattgaatgtgccgaccagaggctggccatcagccacagccagatcgcccacctggaggagaggaacaagcacctggaggacctgatcaggaagccccgggagaaggccaggaagcccaggagcaagagcctggagaaccaccccaagtccatgaccatgatgcctgccctcttcaaggaaaatagaaatgacctggactag

SEQ ID NO: 146088 - DNA, 2103 bp, Artificial Sequence
  Description of Artificial Sequence: Synthetic coding sequence
atgaacaaggactaccagaagttctggagcagccccagcgaccctgtgcactttgaggtggacaccagccatgagaaggtggagagcatgtctgagagtgacaccatgaatgtgagcaacctgagccagggcgtgatgctgagccacagccccatctgcatggagaccaccggcaccacctgtgacctgccccagaatgagatcaagaactttgagcgggagaatgaatatgagagcaccctgtgtgaagatgcctacggcaccctggacaacctgctgaatgacaacaacatcgagaactacagcaccaatgccctgatccagcctgtggacaccatcagcatcagcagcctgcggcagtttgaaacagtgtgcaagttccactgggtggaggcctttgatgatgagatgacagagaagccagagttccagagccaggtgtacaactatgccaaggacaacaacatcaagcaggacagcttcaaggaggagaaccccatggagacctctgtgtctgccaacacagaccagctgggcaatgagtacttccggcagcccccacccaggagccccccactcatccactgcagcggggagatgctgaagttcacagagaagagcctggccaagagcatcgccaaggagagcgccctgaaccccagccagcccccatccttcctgtgcaagacagctgtgcccagcaaggagatccagaactacggggagatccctgagatgtctgtgtcctatgagaaggaggtgacagctgagggcgtggagaggcctgagatcgtgtccacctggagcagcgctggcatctcctggaggtctgaggcctgccgggagaactgtgagatgccagactgggagcagagcgctgagagcctgcagcctgtgcaggaggacatggccctgaatgaggtgctgcagaagctgaagcacaccaacaggaagcaggaggtgcgcatccaggagctgcagtgcagcaacctgtacctggagaagagggtgaaggagctgcagatgaagatcaccaagcagcaggtgttcattgatgtgatcaacaagctgaaggaaaatgtggaggagctgattgaggacaagtacaagatcatcctggagaagaatgacaccaagaagaccctgcagaacctggaggaggtgctggccaacacccagaagcacctgcaggagagcagaaatgacaaggagatgctgcagctgcagttcaagaagatcaaggccaactacgtgtgcctgcaggagcgctacatgacagagatgcagcagaagaacaagtctgtgtcccagtacctggagatggacaagaccctgagcaagaaggaggaggaggtggagcggctgcagcagctgaagaaggagctggagaaggccacagccagcgccctggacctgctgaagcgggagaaggaggcccaggagcaggagttcctgagcctgcaggaggagttccagaagctggagaaggagaacctggaggagcggcagaagctgaagagccggctggagaagctgctgacccaggtgaggaacctgcagttcatgtctgaaaatgaaagaaccaagaacatcaagctgcagcagcagatcaatgaggtgaagaatgaaaatgccaagctgaagcagcaggtggcccggtctgaggagcagaactacgtgcccaagtttgaaacagcccagctgaaggaccagctggaggaggtgctgaagagtgacatcaccaaggacaccaagaccacccacagcaacctgctgcctgactgcagcccctgtgaggagcggctgaacccagctgacatcaagagggccagccagctggccagcaagatgcacagcctgctggccctgatggtgggcctgctgacctgccaggacatcatcaacagtgatgctgagcacttcaaggagagcgagaaggtgtctgacatcatgctgcagaagctgaagagcctgcacctgaagaagaagaccctggacaaggagctgctgaagcacaaggaccgcatcaccaccttccgggagctgattgccaaggagaaggccttccaggaccacgccatcaaggtgttccagggcgtgtag

SEQ ID NO: 146089 - DNA, 2520 bp, Artificial Sequence
  Description of Artificial Sequence: Synthetic coding sequence
atgaacaaggactaccagaagttctggagcagccccagcgaccctgtgcactttgaggtggacaccagccatgagaaggtggagagcatgtctgagagtgacaccatgaatgtgagcaacctgagccagggcgtgatgctgagccacagccccatctgcatggagaccaccggcaccacctgtgacctgccccagaatgagatcaagaactttgagcgggagaatgaatatgagagcaccctgtgtgaagatgcctacggcaccctggacaacctgctgaatgacaacaacatcgagaactacagcaccaatgccctgatccagcctgtggacaccatcagcatcagcagcctgcggcagtttgaaacagtgtgcaagttccactgggtggaggcctttgatgatgagatgacagagaagccagagttccagagccaggtgtacaactatgccaaggacaacaacatcaagcaggacagcttcaaggaggagaaccccatggagacctctgtgtctgccaacacagaccagctgggcaatgagtacttccggcagcccccacccaggagccccccactcatccactgcagcggggagatgctgaagttcacagagaagagcctggccaagagcatcgccaaggagagcgccctgaaccccagccagcccccatccttcctgtgcaagacagctgtgcccagcaaggagatccagaactacggggagatccctgagatgtctgtgtcctatgagaaggaggtgacagctgagggcgtggagaggcctgagatcgtgtccacctggagcagcgctggcatctcctggaggtctgaggcctgccgggagaactgtgagatgccagactgggagcagagcgctgagagcctgcagcctgtgcaggaggacatggccctgaatgaggtgctgcagaagctgaagcacaccaacaggaagcaggaggtgcgcatccaggagctgcagtgcagcaacctgtacctggagaagagggtgaaggagctgcagatgaagatcaccaagcagcaggtgttcattgatgtgatcaacaagctgaaggaaaatgtggaggagctgattgaggacaagtacaagatcatcctggagaagaatgacaccaagaagaccctgcagaacctggaggaggtgctggccaacacccagaagcacctgcaggagagcagaaatgacaaggagatgctgcagctgcagttcaagaagatcaaggccaactacgtgtgcctgcaggagcgctacatgacagagatgcagcagaagaacaagtctgtgtcccagtacctggagatggacaagaccctgagcaagaaggaggaggaggtggagcggctgcagcagctgaagaaggagctggagaaggccacagccagcgccctggacctgctgaagcgggagaaggaggcccaggagcaggagttcctgagcctgcaggaggagttccagaagctggagaaggagaacctggaggagcggcagaagctgaagagccggctggagaagctgctgacccaggtgaggaacctgcagttcatgtctgaaaatgaaagaaccaagaacatcaagctgcagcagcagatcaatgaggtgaagaatgaaaatgccaagctgaagcagcaggtggcccggtctgaggagcagaactacgtgcccaagtttgaaacagcccagctgaaggaccagctggaggaggtgctgaagagtgacatcaccaaggacaccaagaccacccacagcaacctgctgcctgactgcagcccctgtgaggagcggctgaacccagctgacatcaagagggccagccagctggccagcaagatgcacagcctgctggccctgatggtgggcctgctgacctgccaggacatcatcaacagtgatgctgagcacttcaaggagagcgagaaggtgtctgacatcatgctgcagaagctgaagagcctgcacctgaagaagaagaccctggacaaggagctgctgaagcacaaggaccgcatcaccaccttccgggagctgattgccaaggagaaggccttccaggaccacgccatcaaggtgattgactgtgacagtgatgaggccaagagcatcagagatgtgcccaccctgctgggcgccaagctggacaagtaccacagcctgaatgaggagctggacttcctgatcaccaagctgggccacctgctggagagcaaagaaaaccactgcaacagactcatcgaggagaatgacaagtaccagaggcacctgggcaacctgatcaagaaggtgaccagctatgaggagatcattgaatgtgccgaccagaggctggccatcagccacagccagatcgcccacctggaggagaggaacaagcacctggaggacctgatcaggaagccccgggagaaggccaggaagcccaggagcaagagcctggagaaccaccccaagtccatgaccatgatgcctgccctcttcaaggaaaatagaaatgacctggactag

SEQ ID NO: 146090 - DNA, 2112 bp, Artificial Sequence
  Description of Artificial Sequence: Synthetic coding sequence
atggctgacagaagacggcagagggccagccaggacacagaagatgaggagagcggggccagcggcagtgacagcggcggcagccccctgcggggcggcggcagctgcagcggcagcgctgggggcggcggcagcggcagcctgcccagccagagaggaggccgcactggagccctgcacctgcggcgggtggagagcggcggggccaagtctgctgaggagagtgaatgtgagagtgaagatggcattgaaggagatgctgtgctgagtgactatgagagcgctgaggacagcgagggggaggagggggagtacagcgaggaggagaacagcaaggtggagctgaagtctgaggccaatgatgctgtgaacagcagcaccaaggaggagaagggggaggagaagccagacaccaagagcacagtgactggagagcggcagagcggagatggccaggagagcacagagcctgtggagaacaaggtgggcaagaagggccccaagcacctggatgatgatgaggacaggaagaacccagcctacatccccaggaagggcctcttctttgaacatgacctgcggggccagacccaggaggaggaggtgcggcccaagggccggcagaggaagctgtggaaggatgagggccgctgggagcatgacaagttcagagaagatgagcaggcccccaagagccggcaggagctgattgccctgtatggctatgacatccgcagcgcccacaacccagatgacatcaagccccggcgcatcaggaagcccaggtatggcagccccccccagagggaccccaactggaatggagagcggctgaacaagagccaccgccaccagggcctgggcggcaccctgccccccaggaccttcatcaacagaaatgctgctggcaccggccgcatgtctgcccccaggaactacagccgcagcggcggcttcaaggagggccgggccggcttccggcctgtggaggccggcggccagcacggcggccgctctggagagaccgtgaagcatgagatctcctaccgcagccggcggctggagcagacctctgtgcgggaccccagccctgaggctgatgcccctgtgctgggcagccctgagaaggaggaggccgccagcgagcccccagctgctgccccagatgctgcccctcctcctccagaccggcccatcgagaagaagagctacagccgggcccggaggaccaggaccaaggtgggagatgctgtgaagctggccgaggaggtgcccccacctcctgagggcctcatcccagcccctcctgtgcctgagaccacccccaccccacccaccaagacaggcacctgggaggcccctgtggacagcagcaccagcggcctggagcaggatgtggcccagctgaacattgctgagcagaactggagccctggccagcccagcttcctgcagccccgggagctgcggggcatgcccaaccacatccacatgggcgccggccccccaccccagttcaacaggatggaggagatgggcgtgcagggcggccgggccaagcgctacagcagccagaggcagaggcctgtgcctgagcccccagcccctcctgtgcacatcagcatcatggagggccactactatgaccccctgcagttccagggccccatctacacccacggggacagccctgcccccctgcccccccagggcatgctggtgcagcccggcatgaacctgccccaccctggcctgcacccccaccagaccccagcccccctgcccaaccctggcctgtacccacctcctgtgtccatgagccctggccagcccccaccccagcagctgctggcccccacctacttcagcgcccctggggtgatgaactttggaaaccccagctacccctatgcccctggggccctgcccccacctcctccaccccacctgtaccccaacacccaggcccccagccaggtgtatggaggagtgacctactacaacccagcccagcagcaggtgcagcccaagcccagcccccccaggaggaccccccagcctgtgaccatcaagcccccacctcctgaggtggtgtcccggggcagcagctag

SEQ ID NO: 146091 - DNA, 2112 bp, Artificial Sequence; identical to SEQ ID NO: 146090
  Description of Artificial Sequence: Synthetic coding sequence

SEQ ID NO: 146092 - DNA, 1926 bp, Artificial Sequence
  Description of Artificial Sequence: Synthetic coding sequence
atggctgacagaagacggcagagggccagccaggacacagaagatgaggagagcggggccagcggcagtgacagcggcggcagccccctgcggggcggcggcagctgcagcggcagcgctgggggcggcggcagcggcagcctgcccagccagagaggaggccgcactggagccctgcacctgcggcgggtggagagcggcggggccaagtctgctgaggagagtgaatgtgagagtgaagatggcattgaaggagatgctgtgctgagtgactatgagagcgctgaggacagcgagggggaggagggggagtacagcgaggaggagaacagcaaggtggagctgaagtctgaggccaatgatgctgtgaacagcagcaccaaggaggagaagggggaggagaagccagacaccaagagcacagtgactggagagcggcagagcggagatggccaggagagcacagagcctgtggagaacaaggtgggcaagaagggccccaagcacctggatgatgatgaggacaggaagaacccagcctacatccccaggaagggcctcttctttgaacatgacctgcggggccagacccaggaggaggaggtgcggcccaagggccggcagaggaagctgtggaaggatgagggccgctgggagcatgacaagttcagagaagatgagcaggcccccaagagccggcaggagctgattgccctgtatggctatgacatccgcagcgcccacaacccagatgacatcaagccccggcgcatcaggaagcccaggtatggcagccccccccagagggaccccaactggaatggagagcggctgaacaagagccaccgccaccagggcctgggcggcaccctgccccccaggaccttcatcaacagaaatgctgctggcaccggccgcatgtctgcccccaggaactacagccgcagcggcggcttcaaggagggccgggccggcttccggcctgtggaggccggcggccagcacggcggccgctctggagagaccgtgaagcatgagatctcctaccgcagccggcggctggagcagacctctgtgcgggaccccagccctgaggctgatgcccctgtgctgggcagccctgagaaggaggaggccgccagcgagcccccagctgctgccccagatgctgcccctcctcctccagaccggcccatcgagaagaagagctacagccgggcccggaggaccaggaccaaggtgggagatgctgtgaagctggccgaggaggtgcccccacctcctgagggcctcatcccagcccctcctgtgcctgagaccacccccaccccacccaccaagacaggcacctgggaggcccctgtggacagcagcaccagcggcctggagcaggatgtggcccagctgaacattgctgagcagaactggagccctggccagcccagcttcctgcagccccgggagctgcggggcatgcccaaccacatccacatgggcgccggccccccaccccagttcaacaggatggaggagatgggcgtgcagggcggccgggccaagcgctacagcagccagaggcagaggcctgtgcctgagcccccagcccctcctgtgcacatcagcatcatggagggccactactatgaccccctgcagttccagggccccatctacacccacggggacagccctgcccccctgcccccccagggcatgctggtgcagcccggcatgaacctgccccaccctggcctgcacccccaccagaccccagcctgcccagacagccagaccctgcggcactgtgagagctgcctgtgctggagcaccgtcttcagctgcaaggacttctccatgtgtggcggcgtcttctgctactgcttcaagggctgcccctttgtgatcagcatcgtgacctggaggtag

SEQ ID NO: 146093 - DNA, 543 bp, Artificial Sequence
  Description of Artificial Sequence: Synthetic coding sequence
atgcaggccgagggccggggcaccggcggcagcactggagatgctgatggccctgggggccctggcatcccagatggccctggaggaaatgccggcggccctggagaggccggggccaccggcggccggggccccaggggggccggggccgcccgggccagcggccctgggggcggggccccccggggcccccatggaggagctgccagcggcctgaatggctgctgccgctgtggggcccggggccctgagagccggctgctggagttctacctggccatgccctttgccacccccatggaggccgagctggcccggcgcagcctggcccaggatgccccacccctgcctgtgcctggggtgctgctgaaggagttcaccgtgtctggcaacatcctgaccatccggctgacagctgctgaccaccggcagctgcagctgagcatcagcagctgcctgcagcagctgagcctgctgatgtggatcacccagtgcttcctgcccgtcttcctggcccagccccccagcggccagaggaggtag

SEQ ID NO: 146094 - DNA, 570 bp, Artificial Sequence
  Description of Artificial Sequence: Synthetic coding sequence
atgacagacaagacagagaaggtggccgtggaccctgagaccgtcttcaagaggcccagagaatgtgacagccccagctaccagaagaggcagaggatggccctgctggccaggaagcagggcgctggggacagcctgattgctggcagcgccatgagcaaggccaagaagctgatgacaggccacgccatcccccccagccagctggacagccagattgatgacttcaccggcttcagcaaggacaggatgatgcagaagccaggcagcaatgcccctgtgggcggcaatgtgaccagcagcttctctggagatgacctggagtgccgggagacagccagcagccccaagagccagcgggagatcaatgctgacatcaagaggaagctggtgaaggagctgcgctgtgtgggccagaagtatgagaagatctttgagatgctggagggcgtgcagggccccacagctgtgaggaagcgcttctttgagagcatcatcaaggaggccgcccgctgcatgaggcgggactttgtgaagcacctgaagaagaagctgaagaggatgatctag

SEQ ID NO: 146095 - DNA, 570 bp, Artificial Sequence
  Description of Artificial Sequence: Synthetic coding sequence
atgacagacaagacagagaaggtggccgtggaccctgagaccgtcttcaagaggcccagagaatgtgacagccccagctaccagaagaggcagaggatggccctgctggccaggaagcagggcgctggggacagcctgattgctggcagcgccatgagcaaggagaagaagctgatgacaggccacgccatcccccccagccagctggacagccagattgatgacttcaccggcttcagcaaggacaggatgatgcagaagccaggcagcaatgcccctgtgggcggcaatgtgaccagcagcttctctggagatgacctggagtgccgggagacagccagcagccccaagagccagcaggagatcaatgctgacatcaagaggaagctggtgaaggagctgcgctgtgtgggccagaagtatgagaagatctttgagatgctggagggcgtgcagggccccacagctgtgaggaagcgcttctttgagagcatcatcaaggaggccgcccgctgcatgaggcgggactttgtgaagcacctgaagaagaagctgaagaggatgatctag

SEQ ID NO: 146096 - DNA, 570 bp, Artificial Sequence; identical to SEQ ID NO: 146095
  Description of Artificial Sequence: Synthetic coding sequence

SEQ ID NO: 146097 - DNA, 570 bp, Artificial Sequence
  Description of Artificial Sequence: Synthetic coding sequence
atgacagacaagacagagaaggtggccgtggaccctgagaccgtcttcaagaggcccagagaatgtgacagccccagctaccagaagaggcagaggatggccctgctggccaggaagcagggcgctggggacagcctgattgctggcagcgccatgagcaaggagaagaagctgatgacaggccacgccatcccccccagccagctggacagccagattgatgacttcaccggcttcagcaaggacaggatgatgcagaagccaggcagcaatgcccctgtgggcggcaatgtgaccagcagcttctctggagatgacctggagtgccgggagacagccagcagccccaagagccagcgggagatcaatgctgacatcaagaggaagctggtgaaggagctgcgctgtgtgggccagaagtatgagaagatctttgagatgctggagggcgtgcagggccccacagctgtgaggaagcgcttctttgagagcatcatcaaggaggccgcccgctgcatgaggcgggactttgtgaagcacctgaagaagaagctgaagaggatgatctag

SEQ ID NO: 146098 - DNA, 570 bp, Artificial Sequence; identical to SEQ ID NO: 146097
  Description of Artificial Sequence: Synthetic coding sequence

SEQ ID NO: 146099 - DNA, 570 bp, Artificial Sequence; identical to SEQ ID NO: 146095
  Description of Artificial Sequence: Synthetic coding sequence

SEQ ID NO: 146100 - DNA, 570 bp, Artificial Sequence
  Description of Artificial Sequence: Synthetic coding sequence
atgacagacaagacagagaaggtggccgtggaccctgagaccgtcttcaagaggcccagagaatgtgacagccccagctaccagaagaggcagaggatggccctgctggccaggaagcagggcgctggggacagcctgattgctggcagcgccatgagcaaggccaagaagctgatgacaggccacgccatcccccccagccagctggacagccagattgatgacttcaccggcttcagcaaggacaggatgatgcagaagccaggcagcaatgcccctgtgggcggcaatgtgaccagcagcttctctggagatgacctggagtgccgggagacagccagcagccccaagagccagcaggagatcaatgctgacatcaagaggaagctggtgaaggagctgcgctgtgtgggccagaagtatgagaagatctttgagatgctggagggcgtgcagggccccacagctgtgaggaagcgcttctttgagagcatcatcaaggaggccgcccgctgcatgaggcgggactttgtgaagcacctgaagaagaagctgaagaggatgatctag

SEQ ID NO: 146101 - DNA, 570 bp, Artificial Sequence; identical to SEQ ID NO: 146100
  Description of Artificial Sequence: Synthetic coding sequence

SEQ ID NO: 146102 - DNA, 570 bp, Artificial Sequence
  Description of Artificial Sequence: Synthetic coding sequence
atgacagacaagacagagaaggtggccgtggaccctgagaccgtcttcaagaggcccagagaatgtgacagccccagctaccagaagaggcagaggatggccctgctggccaggaagcagggcgctggggacagcctgattgctggcagcgccatgagcaaggagaagaagctgatgacaggccacgccatcccccccagccagctggacagccagattgatgacttcaccggcttcagcaaggatggcatgatgcagaagccaggcagcaatgcccctgtgggcggcaatgtgaccagcaacttctctggagatgacctggagtgccggggcatcgccagcagccccaagagccagcaggagatcaatgctgacatcaagtgccaggtggtgaaggagatccgctgcctgggcaggaaatatgagaagatctttgagatgctggagggcgtgcagggccccacagctgtgaggaagcgcttctttgagagcatcatcaaggaggccgcccgctgcatgaggcgggactttgtgaagcacctgaagaagaagctgaagaggatgatctag

SEQ ID NO: 146103 - DNA, 570 bp, Artificial Sequence; identical to SEQ ID NO: 146102
  Description of Artificial Sequence: Synthetic coding sequence

SEQ ID NO: 146104 - DNA, 570 bp, Artificial Sequence; identical to SEQ ID NO: 146100
  Description of Artificial Sequence: Synthetic coding sequence

SEQ ID NO: 146105 - DNA, 570 bp, Artificial Sequence; identical to SEQ ID NO: 146100
  Description of Artificial Sequence: Synthetic coding sequence

SEQ ID NO: 146106 - DNA, 867 bp, Artificial Sequence
  Description of Artificial Sequence: Synthetic coding sequence
atgtctgccaccggggacagacaccccacccagggcgaccaggaggcccctgtgtcccaggagggcgcccaggccgaggccgccggggccggcaaccaggagggcggggacagcggccctgacagcagtgatgtggtgcctgctgctgaggtggtgggcgtggccggccctgtggagggcctgggggaggaggagggggagcaggccgccggcctggccgctgtgccccggggcggcagcgcagaagaagattctgacatcggccctgccacagaggaggaggaggaggaggagggcaatgaggccgccaactttgacctggccgtggtggcccggcgctacccagccagcggcatccactttgtgctgctggacatggtgcacagcctgctgcaccggctgagccacaatgaccacatcctgattgaaaatcggcagctgagccggctgatggtgggcccccacgccgccgccaggaacctgtggggcaacctgccccccctgctgctgccccagaggctgggcgctggagctgctgcccgggccggggagggcctgggcctcatccaggaggccgcctctgtgcctgagcctgctgtgcctgctgacctggccgagatggcccgggagcctgctgaggaggccgctgaggagaagctgtctgaggaggccacagaggagccagatgctgaggagcccgccacagaggagcccacagcccaggaggccacagcccctgaggaggtgaccaagagccagcctgagaagtgggatgaggaggcccaggatgctgctggggaggaggagaaggagcaggagaaggagaaggatgctgagaacaaggtgaagaacagcaagggcacctag

SEQ ID NO: 146107 - DNA, 867 bp, Artificial Sequence; identical to SEQ ID NO: 146106
  Description of Artificial Sequence: Synthetic coding sequence

SEQ ID NO: 146108 - DNA, 867 bp, Artificial Sequence; identical to SEQ ID NO: 146106
  Description of Artificial Sequence: Synthetic coding sequence

SEQ ID NO: 146109 - DNA, 867 bp, Artificial Sequence; identical to SEQ ID NO: 146106
  Description of Artificial Sequence: Synthetic coding sequence

SEQ ID NO: 146110 - DNA, 867 bp, Artificial Sequence; identical to SEQ ID NO: 146106
  Description of Artificial Sequence: Synthetic coding sequence

SEQ ID NO: 146111 - DNA, 867 bp, Artificial Sequence; identical to SEQ ID NO: 146106
  Description of Artificial Sequence: Synthetic coding sequence

SEQ ID NO: 146112 - DNA, 867 bp, Artificial Sequence; identical to SEQ ID NO: 146106
  Description of Artificial Sequence: Synthetic coding sequence

SEQ ID NO: 146113 - DNA, 867 bp, Artificial Sequence; identical to SEQ ID NO: 146106
  Description of Artificial Sequence: Synthetic coding sequence

SEQ ID NO: 146114 - DNA, 867 bp, Artificial Sequence; identical to SEQ ID NO: 146106
  Description of Artificial Sequence: Synthetic coding sequence

SEQ ID NO: 146115 - DNA, 867 bp, Artificial Sequence; identical to SEQ ID NO: 146106
  Description of Artificial Sequence: Synthetic coding sequence

SEQ ID NO: 146116 - DNA, 867 bp, Artificial Sequence; identical to SEQ ID NO: 146106
  Description of Artificial Sequence: Synthetic coding sequence

SEQ ID NO: 146117 - DNA, 867 bp, Artificial Sequence; identical to SEQ ID NO: 146106
  Description of Artificial Sequence: Synthetic coding sequence

SEQ ID NO: 146118 - DNA, 867 bp, Artificial Sequence; identical to SEQ ID NO: 146106
  Description of Artificial Sequence: Synthetic coding sequence

SEQ ID NO: 146119 - DNA, 867 bp, Artificial Sequence; identical to SEQ ID NO: 146106
  Description of Artificial Sequence: Synthetic coding sequence

SEQ ID NO: 146120 - DNA, 900 bp, Artificial Sequence
  Description of Artificial Sequence: Synthetic coding sequence
atgtctgccaccggggacagacaccccacccagggcgaccaggaggcccctgtgtcccaggagggcgcccaggccgaggccgccggggccggcaaccaggagggcggggacagcggccctgacagcagtgacatggtgcctgctgctgaggtggtgggcgtggccggccctgtggagggcctgggggaggaggagggggagcaggccgccggcctggccgctgtgccccagggcggcagcgcagaagaagattctgacatcggccctgccacagaggaggaggaggaggaggaggagggcaatgaagctgccaactttgacctggccgtggccacccggcgctacccagctgctggcatcggctttgtgttcctgtacctggtgcacagcctgctgcggcggctgtaccacaatgaccacatccagatcgccaacagacacctgagccggctgatggtgggcccccatgctgctgtgcccaacctgtgggacaacccccccctgctgctgctgagccagaggctgggcgctggggccgccgcccctgagggggagggcctgggcctcatccaggaggccgcctctgtgcaggaggccgcctctgtgcctgagcctgctgtgcctgctgacctggccgagatggcccgggagcctgctgaggaggccgcagatgagaagcccccagaggaggccgctgaggagaagctgacagaggaggccacagaggagcctgctgctgaggagcccaccagcgaggaggccgtggcccctgaggaggtgaccaagagccagcctgagaagtgggatgaggaggcccaggatgctgctggggaggaggagaaggagcaggagaaggagaaggatgtggagaacaaggtgaagaacagcaagggcacctag

SEQ ID NO: 146121 - DNA, 1419 bp, Artificial Sequence
  Description of Artificial Sequence: Synthetic coding sequence
atgaagagcatcctggatggcctggccgacaccaccttccgcaccatcaccacagacctgctgtatgtgggcagcaatgacatccagtatgaggacatcaagggggacatggccagcaagctgggctacttcccccagaagttccccctgaccagcttccggggcagccccttccaggagaagatgacagctggggacaacccccagctggtgcctgctgaccaggtgaacatcacagagttctacaacaagagcctgagcagcttcaaggaaaatgaggagaacatccagtgtggggagaacttcatggacatcgagtgcttcatggtgctgaaccccagccagcagctggccatcgctgtgctgagcctgaccctgggcaccttcaccgtgctggagaacctgctggtgctgtgtgtgatcctgcacagccgcagcctgcgctgccggcccagctaccacttcatcggcagcctggccgtggccgacctgctgggcagcgtcatctttgtgtacagcttcatcgacttccacgtgttccacaggaaggacagcagaaatgtgttcctgttcaagctgggcggcgtgacagccagcttcaccgcctctgtgggcagcctcttcctgacagccatcgaccgctacatcagcatccaccggcccctggcctacaagagaattgtgacccggcccaaggctgtggtggccttctgcctgatgtggaccatcgccatcgtgattgctgtgctgcccctgctgggctggaactgtgagaagctgcagagcgtgtgcagcgacatcttcccccacattgatgagacctacctgatgttctggattggagtgacctctgtgctgctgctcttcatcgtgtatgcctacatgtacatcctgtggaaggcccacagccatgctgtgaggatgatccagaggggcacccagaagagcatcatcatccacaccagtgaagatggcaaggtgcaggtgaccaggccagaccaggccaggatggacatccggctggccaagaccctggtgctgatcctggtggtgctgatcatctgctggggccccctgctggccatcatggtgtatgatgtgtttgggaagatgaacaagctgatcaagacagtgtttgccttctgcagcatgctgtgcctgctgaacagcacagtgaaccccatcatctatgccctgcggagcaaggacctgcggcatgccttccgctccatgttccccagctgtgagggcacagcccagcccctggacaacagcatgggagacagcgactgcctgcacaagcacgccaacaatgctgcctctgtgcacagagctgctgagagctgcatcaagagcacagtgaagatcgccaaggtgaccatgtctgtgtccacagacaccagcgctgaggccctgtag

SEQ ID NO: 146122 - DNA, 1419 bp, Artificial Sequence; identical to SEQ ID NO: 146121
  Description of Artificial Sequence: Synthetic coding sequence

SEQ ID NO: 146123 - DNA, 1419 bp, Artificial Sequence; identical to SEQ ID NO: 146121
  Description of Artificial Sequence: Synthetic coding sequence

SEQ ID NO: 146124 - DNA, 1320 bp, Artificial Sequence
  Description of Artificial Sequence: Synthetic coding sequence
atgaagagcatcctggatggcctggccgacaccaccttccgcaccatcaccacagacctgctgggcagccccttccaggagaagatgacagctggggacaacccccagctggtgcctgctgaccaggtgaacatcacagagttctacaacaagagcctgagcagcttcaaggaaaatgaggagaacatccagtgtggggagaacttcatggacatcgagtgcttcatggtgctgaaccccagccagcagctggccatcgctgtgctgagcctgaccctgggcaccttcaccgtgctggagaacctgctggtgctgtgtgtgatcctgcacagccgcagcctgcgctgccggcccagctaccacttcatcggcagcctggccgtggccgacctgctgggcagcgtcatctttgtgtacagcttcatcgacttccacgtgttccacaggaaggacagcagaaatgtgttcctgttcaagctgggcggcgtgacagccagcttcaccgcctctgtgggcagcctcttcctgacagccatcgaccgctacatcagcatccaccggcccctggcctacaagagaattgtgacccggcccaaggctgtggtggccttctgcctgatgtggaccatcgccatcgtgattgctgtgctgcccctgctgggctggaactgtgagaagctgcagagcgtgtgcagcgacatcttcccccacattgatgagacctacctgatgttctggattggagtgacctctgtgctgctgctcttcatcgtgtatgcctacatgtacatcctgtggaaggcccacagccatgctgtgaggatgatccagaggggcacccagaagagcatcatcatccacaccagtgaagatggcaaggtgcaggtgaccaggccagaccaggccaggatggacatccggctggccaagaccctggtgctgatcctggtggtgctgatcatctgctggggccccctgctggccatcatggtgtatgatgtgtttgggaagatgaacaagctgatcaagacagtgtttgccttctgcagcatgctgtgcctgctgaacagcacagtgaaccccatcatctatgccctgcggagcaaggacctgcggcatgccttccgctccatgttccccagctgtgagggcacagcccagcccctggacaacagcatgggagacagcgactgcctgcacaagcacgccaacaatgctgcctctgtgcacagagctgctgagagctgcatcaagagcacagtgaagatcgccaaggtgaccatgtctgtgtccacagacaccagcgctgaggccctgtag

SEQ ID NO: 146125 - DNA, 1419 bp, Artificial Sequence; identical to SEQ ID NO: 146121
  Description of Artificial Sequence: Synthetic coding sequence

SEQ ID NO: 146126 - DNA, 1419 bp, Artificial Sequence; identical to SEQ ID NO: 146121
  Description of Artificial Sequence: Synthetic coding sequence

SEQ ID NO: 146127 - DNA, 1236 bp, Artificial Sequence
  Description of Artificial Sequence: Synthetic coding sequence
atggccctgcagatcccccccagcgcccccagccccctgaccagctgcacctgggcccagatgaccttcagcaccaagaccagcaaagaaaatgaggagaacatccagtgtggggagaacttcatggacatcgagtgcttcatggtgctgaaccccagccagcagctggccatcgctgtgctgagcctgaccctgggcaccttcaccgtgctggagaacctgctggtgctgtgtgtgatcctgcacagccgcagcctgcgctgccggcccagctaccacttcatcggcagcctggccgtggccgacctgctgggcagcgtcatctttgtgtacagcttcatcgacttccacgtgttccacaggaaggacagcagaaatgtgttcctgttcaagctgggcggcgtgacagccagcttcaccgcctctgtgggcagcctcttcctgacagccatcgaccgctacatcagcatccaccggcccctggcctacaagagaattgtgacccggcccaaggctgtggtggccttctgcctgatgtggaccatcgccatcgtgattgctgtgctgcccctgctgggctggaactgtgagaagctgcagagcgtgtgcagcgacatcttcccccacattgatgagacctacctgatgttctggattggagtgacctctgtgctgctgctcttcatcgtgtatgcctacatgtacatcctgtggaaggcccacagccatgctgtgaggatgatccagaggggcacccagaagagcatcatcatccacaccagtgaagatggcaaggtgcaggtgaccaggccagaccaggccaggatggacatccggctggccaagaccctggtgctgatcctggtggtgctgatcatctgctggggccccctgctggccatcatggtgtatgatgtgtttgggaagatgaacaagctgatcaagacagtgtttgccttctgcagcatgctgtgcctgctgaacagcacagtgaaccccatcatctatgccctgcggagcaaggacctgcggcatgccttccgctccatgttccccagctgtgagggcacagcccagcccctggacaacagcatgggagacagcgactgcctgcacaagcacgccaacaatgctgcctctgtgcacagagctgctgagagctgcatcaagagcacagtgaagatcgccaaggtgaccatgtctgtgtccacagacaccagcgctgaggccctgtag

SEQ ID NO: 146128 - DNA, 1419 bp, Artificial Sequence; identical to SEQ ID NO: 146121
  Description of Artificial Sequence: Synthetic coding sequence

SEQ ID NO: 146129 - DNA, 237 bp, Artificial Sequence
  Description of Artificial Sequence: Synthetic coding sequence
atgaagagcatcctggatggcctggccgacaccaccttccgcaccatcaccacagacctgctgtatgtgggcagcaatgacatccagtatgaggacatcaagggggacatggccagcaagctgggctacttcccccagaagttccccctgaccagcttccggggcagccccttccaggagaagatgacagctggggacaacccccagctggtgcctgctgaccaggtgaacatctag

SEQ ID NO: 146130 - DNA, 1083 bp, Artificial Sequence
  Description of Artificial Sequence: Synthetic coding sequence
atggaggagtgctgggtgacagaaattgccaacggcagcaaggatggcctggacagcaaccccatgaaggactacatgatcctgagcggcccccagaagacagctgtggccgtgctgtgcaccctgctgggcctgctgagcgccctggagaatgtggccgtgctgtacctgatcctgagcagccaccagctgcggaggaagcccagctacctgttcatcggcagcctggccggggctgacttcctggcctctgtggtgtttgcctgcagctttgtgaacttccacgtgttccacggcgtggacagcaaggctgtgttcctgctgaagattggctctgtgaccatgaccttcaccgcctctgtgggcagcctgctgctgacagccatcgaccgctacctgtgcctgcgctacccacccagctacaaggccctgctgacccggggccgggccctggtgaccctgggcatcatgtgggtgctgagcgccctggtgtcctacctgcccctgatgggctggacctgctgcccccggccctgcagcgagctgttccccctcatccccaatgactacctgctgtcctggctgctcttcatcgccttcctgttcagcggcatcatctacacctacggccacgtgctgtggaaggcccaccagcacgtggccagcctgagcggccaccaggaccggcaggtgcccggcatggccaggatgaggctggatgtgcggctggccaagaccctgggcctggtgctggccgtgctgctgatctgctggttccctgtgctggccctgatggcccacagcctggccaccaccctgagtgaccaggtgaagaaggcctttgccttctgcagcatgctgtgcctgatcaacagcatggtgaaccctgtgatctatgccctgcggtctggagagatccgcagcagcgcccaccactgcctggcccactggaagaagtgtgtgcggggcctgggcagcgaggccaaggaggaggcccccaggagctctgtgacagaaacagaagcagatggcaagatcaccccctggccagacagccgggacctggacctgagtgactgctag

SEQ ID NO: 146131 - DNA, 1083 bp, Artificial Sequence; identical to SEQ ID NO: 146130
  Description of Artificial Sequence: Synthetic coding sequence

SEQ ID NO: 146132 - DNA, 837 bp, Artificial Sequence
  Description of Artificial Sequence: Synthetic coding sequence
atggacagcatgcctgagcccgccagccgctgcctgctgctgctgcccctgctgctgctgctgctgctgctgctgcctgcccctgagctgggccccagccaggccggggctgaagaaaatgactgggtgcggctgcccagcaaatgtgaggtgtgcaagtatgtggccgtggagctgaagagcgcctttgaggagaccgggaagaccaaggaggtgattggaacaggctacggcatcctggaccagaaggccagcggcgtgaagtacaccaagagtgacctgcggctgattgaggtgacagagaccatctgcaagaggctgctggactacagcctgcacaaggagaggacaggcagcaacagatttgccaagggcatgtctgagacctttgagaccctgcacaacctggtgcacaagggcgtgaaggtggtgatggacatcccctatgagctgtggaatgagaccagcgctgaggtggccgacctgaagaagcagtgtgatgtgctggtggaggagtttgaggaggtgattgaggactggtacagaaaccaccaggaggaggacctgacagagttcctgtgtgccaaccacgtgctgaagggcaaggacaccagctgcctggccgagcagtggagcggcaagaagggggacacagctgccctgggcggcaagaagagcaagaagaagagcagccgggccaaggccgccggcggccgcagcagcagcagcaagcagaggaaggagctgggcggcctggagggggaccccagccctgaggaggatgagggcatccagaaggccagccccctgacccacagccccccagatgagctgtag

SEQ ID NO: 146133 - DNA, 165 bp, Artificial Sequence
  Description of Artificial Sequence: Synthetic coding sequence
atggacagcatgcctgagcccgccagccgctgcctgctgctgctgcccctgctgctgctgctgctgctgctgctgcctgcccctgagctgggccccagccaggccggggctgaagaaaatgactgggtgcggctgcccagcaaatgtgagggcacctgtggctag

SEQ ID NO: 146134 - DNA, 747 bp, Artificial Sequence
  Description of Artificial Sequence: Synthetic coding sequence
atgggccctgtgcggctgggcatcctgctcttcctgttcctggccgtgcatgaggcctgggccggcatgctgaaggaggaggatgatgacacagagcggctgcccagcaaatgtgaggtgtgcaagctgctgagcacagagctgcaggccgagctgagcaggacaggccgcagccgggaggtgctggagctgggccaggtgctggacaccgggaagaggaagagacatgtgccctacagcgtgtctgagacccggctggaggaggccctggagaacctgtgtgagcgcatcctggactacagcgtgcacgccgagaggaagggcagcctgcgctatgccaagggccagagccagaccatggccaccctgaagggcctggtgcagaagggcgtgaaggtggacctgggcatccccctggagctgtgggatgagcccagcgtggaggtgacctacctgaagaagcagtgtgagaccatgctggaggagtttgaggacatcgtgggggactggtacttccaccaccaggagcagcccctgcagaacttcctgtgtgagggccacgtgctgcctgctgctgagacagcctgcctgcaggagacctggacaggcaaggagatcacagatggagaggagaagacagaaggagaggaggagcaggaggaggaggaggaggaggaggaggaggagggcggggacaagatgaccaagacaggcagccaccccaagctggaccgggaggacctgtag

SEQ ID NO: 146135 - DNA, 798 bp, Artificial Sequence
  Description of Artificial Sequence: Synthetic coding sequence
atgagggaggagatgagcctgggctgccaggaggcctttgagatcttcaagagggaccatgctgacagcgtgaccattgatgacaacaagcagatcctgaagcagcgcttcagcgaggccaaggccctgggggagagcatcaatgaggcccggagcaagattggccacctgaaggaggagatcacccagaggcacatccagcaggtggccctgggcatcagcgagaacatggctgtgcccctgatgccagaccagcaggaggagaagctgcggagccagctggaggaggagaagaggcgctacaagaccatgttcacccggctgaaggccctgaaggtggagattgagcacctgcagctgctgatggacaaggccaaggtgaagctgcagaaggagtttgaggtgtggtgggccgaggaggccaccaacctgcaggtgaacagccctgctgtgaacagcctggaccacaccaagcccttcctgcagaccagtgacagccagcacgagtggagccagctgctgagcaacaagagcagcggcggctgggaggtgcaggaccagggcaccggccgctttgatgtgtgtgatgtgaatgccaggaagatcctgcccagcccctgccccagcccccacagccagaagcagagcagcaccagcacccccctggaggacagcatccccaagaggcctgtgagcagcatccccctgactggagacagccagacagacagcgacatcatcgccttcatcaaggcccggcagagcatcctgcagaagcagtgcctgggcagcaactag

SEQ ID NO: 146136 - DNA, 1185 bp, Artificial Sequence
  Description of Artificial Sequence: Synthetic coding sequence
atggccaacatgcagggcctggtggagcggctggagagagctgtgtcccggctggagagcctgtctgctgagagccaccggcccccaggcaactgtggggaggtgaatggagtgattgctggggtggcccccagcgtggaggcctttgacaagctgatggacagcatggtggccgagttcctgaagaacagccgcatcctggccggagatgtggagacccatgctgagatggtgcacagcgccttccaggcccagagggccttcctgctgatggccagccagtaccagcagccccatgaaaatgatgtggccgccctgctgaagcccatcagcgagaagatccaggagatccagaccttccgggagaggaacagaggcagcaacatgttcaaccacctgtctgctgtgtctgagagcatcccagccctgggctggattgctgtgagccccaagcccccacccctgcccccacctggccccccacccctgtttgaaaatgaaggcaagaaggaggagagcagccccagccgcagcgccctgtttgcccagctgaaccagggcgaggccatcaccaagggcctgcggcacgtgacagatgaccagaagacctacaagaaccccagcctgcgggcccagggcggccagacccagagccccaccaagagccacacccccagccccaccagccccaagagctaccccagccagaagcacgcccctgtgctggagctggagggcaagaagtggagggtggagtaccaggaggacagaaatgacctggtgatcagcgagacagagctgaagcaggtggcctacatcttcaagtgtgagaagagcaccatccagatcaagggcaaggtgaacagcatcatcatcgacaactgcaagaagctgggcctggtgtttgacaacgtggtgggcatcgtggaggtgatcaacagccaggacatccagatccaggtgatgggccgggtgcccaccatcagcatcaacaagacagagggctgccacatctacctgtctgaagatgccctggactgtgaaattgtgtctgccaagagcagcgagatgaacatcctgatcccccaggatggagactaccgggagttccccatccctgagcagttcaagacagcctgggatggcagcaagctgatcacagagcctgctgagatcatggcctag

SEQ ID NO: 146137 - DNA, 597 bp, Artificial Sequence
  Description of Artificial Sequence: Synthetic coding sequence
atgaagctgtacagcctgtctgtgctgtacaagggggaggccaaggtggtgctgctgaaggccgcctatgatgtgtcctccttctccttcttccagaggagctctgtgcaggagttcatgaccttcaccagccagctgattgtggagaggagcagcaagggcacccgggcctctgtgaaggagcaggactacctgtgccacgtgtatgtgagaaatgacagcctggccggcgtggtgattgctgacaatgagtaccccagccgggtggccttcaccctgctggagaaggtgctggatgagttcagcaagcaggtggacagaattgactggcctgtgggcagccctgccaccatccactacccagccctggatggccacctgagccgctaccagaacccccgggaggccgaccccatgaccaaggtgcaggccgagctggatgagaccaagatcatcctgcacaacaccatggagagcctgctggagcggggggagaagctggatgacctggtgtccaagtctgaggtgctgggcacccagagcaaggccttctacaagacagccaggaagcagaacagctgctgtgccatcatgtag

SEQ ID NO: 146138 - DNA, 3036 bp, Artificial Sequence
  Description of Artificial Sequence: Synthetic coding sequence
atgcagaagcccagcggcctgaagcccccaggccggggcggcaagcacagcagccccatgggccgcaccagcactggaagtgccagcagcagcgctgctgtggccgccagcagcaaggagggcagccccctgcacaagcagagcagcggccccagcagcagccctgctgctgctgctgcccctgagaagccaggccccaaggctgctgaggtgggagatgacttcctgggggactttgtggtgggggagcgggtgtgggtgaatggagtgaagccaggagtggtgcagtacctgggggagacccagtttgcccctggccagtgggccggcgtggtgctggatgatcctgtgggcaagaatgatggagctgtgggcggcgtgcgctactttgaatgtcctgccctgcagggcatcttcacccggcccagcaagctgacccggcagcccacagctgagggcagcggcagtgatgcccacagcgtggagagcctgacagcccagaacctgagcctgcacagcggcacagccaccccacccctgaccagcagggtcatccccctgcgggagagcgtgctgaacagctctgtgaagacaggaaatgaaagtggcagcaacctgagtgacagcggctctgtgaagagaggagagaaggacctgcggctgggggacagagtgctggtgggcggcaccaagacaggagtggtgcgctacgtgggggagacagactttgccaagggggagtggtgtggggtggagctggatgagcccctgggcaagaatgatggagctgtggccggcacccgctacttccagtgcccccccaagtttggcctgtttgcccccatccacaaggtgatccgcatcggcttccccagcaccagccctgccaaggccaagaagaccaagaggatggccatgggcgtgtctgccctgacccacagccccagcagcagcagcatcagctctgtgtcctctgtggccagctctgtgggcggccggcccagccgcagcggcctgctgacagagaccagcagccgctatgccaggaagatcagcggcaccacagccctgcaggaggccctgaaggagaagcagcagcacatcgagcagctgctggccgagcgggacctggagcgggcagaggtggccaaggccaccagccacatctgtgaggtggagaaggagatcgccctgctgaaggcccagcacgagcagtatgtggccgaggccgaggagaagctgcagagggcccggctgctggtggagagcgtgaggaaggagaaggtggacctgagcaaccagctggaggaggagaggaggaaggtggaggacctgcagttccgggtggaggaggagagcatcaccaagggggacctggagctgaccaccgtggccgagaagagccgggtgctgcagctggaggaggagctgaccctgcggcggggggagattgaggagctgcagcagtgcctgctgcacagcggccccccacctccagaccacccagatgctgctgagatcctgcggctgcgggagcggctgctgagcgccagcaaggagcaccagcgggagagcggcgtgctgcgggacaagtatgagaaggccctgaaggcctaccaggccgaggtggacaagctgcgggccgccaatgagaagtatgcccaggaggtggccggcctgaaggacaaggtgcagcaggccaccagcgagaacatgggcctgatggacaactggaagagcaagctggacagcctggccagtgaccaccagaagagcctggaggacctgaaggccaccctgaacagcggccctggggcccagcagaaggagattggagagctgaaggctgtgatggagggcatcaagatggagcaccagctggagctgggcaacctgcaggccaagcatgacctggagacagccatgcacgtgaaggagaaggaggccctgcgggagaagctgcaggaggcccaggaggagctggccggcctgcagaggcactggagggcccagctggaggtgcaggccagccagcaccggctggagctgcaggaggcccaggaccagaggagagatgctgagctgcgggtgcatgagctggagaagctggatgtggagtaccggggccaggcccaggccatcgagttcctgaaggagcagatcagcctggccgagaagaagatgctggactatgagcggctgcagagagctgaggcccagggcaagcaggaggtggagagcctgcgggagaagctgctggtggccgagaaccggctgcaggccgtggaggccctgtgcagcagccagcacacccacatgattgagagcaatgacatcagcgaggagaccatccgcaccaaggagaccgtggagggcctgcaggacaagctgaacaagagggacaaggaggtgacagccctgaccagccagacagagatgctgcgggcccaggtgtctgccctggagagcaagtgcaagtctggagagaagaaggtggatgccctgctgaaggagaagaggcggctggaggccgagctggagaccgtgtccaggaagacccatgatgccagcggccagctggtgctgatcagccaggagctgctgaggaaggagaggagcctgaatgagctgcgggtgctgctgctggaggccaacagacacagccctggccctgagcgggacctgagccgggaggtgcacaaggccgagtggaggatcaaggagcagaagctgaaggatgacatccggggcctgcgggagaagctgaccggcctggacaaggagaagagcctgagtgaccagaggcgctacagcctgattgacaggagcagcgcccctgagctgctgcggctgcagcaccagctgatgagcacagaagatgccctgagagatgccctggaccaggcccagcaggtggagaagctgatggaggccatgaggagctgcccagacaaggcccagaccatcggcaacagcggcagcgccaacggcatccaccagcaggacaaggcccagaagcaggaggacaagcactag

SEQ ID NO: 146139 - DNA, 3141 bp, Artificial Sequence
  Description of Artificial Sequence: Synthetic coding sequence
atgcagaagcccagcggcctgaagcccccaggccggggcggcaagcacagcagccccatgggccgcaccagcactggaagtgccagcagcagcgctgctgtggccgccagcagcaaggagggcagccccctgcacaagcagagcagcggccccagcagcagccctgctgctgctgctgcccctgagaagccaggccccaaggctgctgaggtgggagatgacttcctgggggactttgtggtgggggagcgggtgtgggtgaatggagtgaagccaggagtggtgcagtacctgggggagacccagtttgcccctggccagtgggccggcgtggtgctggatgatcctgtgggcaagaatgatggagctgtgggcggcgtgcgctactttgaatgtcctgccctgcagggcatcttcacccggcccagcaagctgacccggcagcccacagctgagggcagcggcagtgatgcccacagcgtggagagcctgacagcccagaacctgagcctgcacagcggcacagccaccccacccctgaccagcagggtcatccccctgcgggagagcgtgctgaacagctctgtgaagacaggaaatgaaagtggcagcaacctgagtgacagcggctctgtgaagagaggagagaaggacctgcggctgggggacagagtgctggtgggcggcaccaagacaggagtggtgcgctacgtgggggagacagactttgccaagggggagtggtgtggggtggagctggatgagcccctgggcaagaatgatggagctgtggccggcacccgctacttccagtgcccccccaagtttggcctgtttgcccccatccacaaggtgatccgcatcggcttccccagcaccagccctgccaaggccaagaagaccaagaggatggccatgggcgtgtctgccctgacccacagccccagcagcagcagcatcagctctgtgtcctctgtggccagctctgtgggcggccggcccagccgcagcggcctgctgacagagaccagcagccgctatgccaggaagatcagcggcaccacagccctgcaggaggccctgaaggagaagcagcagcacatcgagcagctgctggccgagcgggacctggagcgggcagaggtggccaaggccaccagccacatctgtgaggtggagaaggagatcgccctgctgaaggcccagcacgagcagtatgtggccgaggccgaggagaagctgcagagggcccggctgctggtggagagcgtgaggaaggagaaggtggacctgagcaaccagctggaggaggagaggaggaaggtggaggacctgcagttccgggtggaggaggagagcatcaccaagggggacctggagacccagacccagctggagcacgcccgcatcggggagctggagcagagcctgctgctggagaaggcccaggccgagcggctgctgcgggagctggccgacaaccggctgaccaccgtggccgagaagagccgggtgctgcagctggaggaggagctgaccctgcggcggggggagattgaggagctgcagcagtgcctgctgcacagcggccccccacctccagaccacccagatgctgctgagatcctgcggctgcgggagcggctgctgagcgccagcaaggagcaccagcgggagagcggcgtgctgcgggacaagtatgagaaggccctgaaggcctaccaggccgaggtggacaagctgcgggccgccaatgagaagtatgcccaggaggtggccggcctgaaggacaaggtgcagcaggccaccagcgagaacatgggcctgatggacaactggaagagcaagctggacagcctggccagtgaccaccagaagagcctggaggacctgaaggccaccctgaacagcggccctggggcccagcagaaggagatcggggagctgaaggctgtgatggagggcatcaagatggagcaccagctggagctgggcaacctgcaggccaagcatgacctggagacagccatgcacgtgaaggagaaggaggccctgcgggagaagctgcaggaggcccaggaggagctggccggcctgcagaggcactggagggcccagctggaggtgcaggccagccagcaccggctggagctgcaggaggcccaggaccagaggagagatgctgagctgcgggtgcatgagctggagaagctggatgtggagtaccggggccaggcccaggccatcgagttcctgaaggagcagatcagcctggccgagaagaagatgctggactatgaaaggctgcagagagctgaggcccagggcaagcaggaggtggagagcctgcgggagaagctgctggtggctgaaaatcggctgcaggccgtggaggccctgtgcagcagccagcacacccacatgattgagagcaatgacatcagcgaggagaccatccgcaccaaggagaccgtggagggcctgcaggacaagctgaacaagagggacaaggaggtgacagccctgaccagccagacagagatgctgcgggcccaggtgtctgccctggagagcaagtgcaagagcggggagaagaaggtggatgccctgctgaaggagaagaggcggctggaggccgagctggagaccgtgtccaggaagacccatgatgccagcggccagctggtgctgatcagccaggagctgctgaggaaggagaggagcctgaatgagctgcgggtgctgctgctggaggccaacagacacagccctggccctgagcgggacctgagccgggaggtgcacaaggccgagtggaggatcaaggagcagaagctgaaggatgacatccggggcctgcgggagaagctgaccggcctggacaaggagaagagcctgagtgaccagaggcgctacagcctgattgacaggagcagcgcccctgagctgctgcggctgcagcaccagctgatgagcacagaagatgccctgagagatgccctggaccaggcccagcaggtggagaagctgatggaggccatgaggagctgcccagacaaggcccagaccatcggcaacagcggcagcgccaacggcatccaccagcaggacaaggcccagaagcaggaggacaagcactag

SEQ ID NO: 146140 - DNA, 153 bp, Artificial Sequence
  Description of Artificial Sequence: Synthetic coding sequence
ctggaggaggagaggaggaaggtggaggacctgcagttccgggtggaggaggagagcatcaccaagggggacctggaggccgaggaccacctgagccctgagcccagcatgctgaccaccgtggccgagaagagccgggtgctgcagctgtag

SEQ ID NO: 146141 - DNA, 3141 bp, Artificial Sequence
  Description of Artificial Sequence: Synthetic coding sequence
atgcagaagcccagcggcctgaagcccccaggccggggcggcaagcacagcagccccatgggccgcaccagcactggaagtgccagcagcagcgctgctgtggccgccagcagcaaggagggcagccccctgcacaagcagagcagcggccccagcagcagccctgctgctgctgctgcccctgagaagccaggccccaaggctgctgaggtgggagatgacttcctgggggactttgtggtgggggagcgggtgtgggtgaatggagtgaagccaggagtggtgcagtacctgggggagacccagtttgcccctggccagtgggccggcgtggtgctggatgatcctgtgggcaagaatgatggagctgtgggcggcgtgcgctactttgaatgtcctgccctgcagggcatcttcacccggcccagcaagctgacccggcagcccacagctgagggcagcggcagtgatgcccacagcgtggagagcctgacagcccagaacctgagcctgcacagcggcacagccaccccacccctgaccagcagggtcatccccctgcgggagagcgtgctgaacagctctgtgaagacaggaaatgaaagtggcagcaacctgagtgacagcggctctgtgaagagaggagagaaggacctgcggctgggggacagagtgctggtgggcggcaccaagacaggagtggtgcgctacgtgggggagacagactttgccaagggggagtggtgtggggtggagctggatgagcccctgggcaagaatgatggagctgtggccggcacccgctacttccagtgcccccccaagtttggcctgtttgcccccatccacaaggtgatccgcatcggcttccccagcaccagccctgccaaggccaagaagaccaagaggatggccatgggcgtgtctgccctgacccacagccccagcagcagcagcatcagctctgtgtcctctgtggccagctctgtgggcggccggcccagccgcagcggcctgctgacagagaccagcagccgctatgccaggaagatcagcggcaccacagccctgcaggaggccctgaaggagaagcagcagcacatcgagcagctgctggccgagcgggacctggagcgggcagaggtggccaaggccaccagccacatctgtgaggtggagaaggagatcgccctgctgaaggcccagcacgagcagtatgtggccgaggccgaggagaagctgcagagggcccggctgctggtggagagcgtgaggaaggagaaggtggacctgagcaaccagctggaggaggagaggaggaaggtggaggacctgcagttccgggtggaggaggagagcatcaccaagggggacctggagacccagacccagctggagcacgcccgcatcggggagctggagcagagcctgctgctggagaaggcccaggccgagcggctgctgcgggagctggccgacaaccggctgaccaccgtggccgagaagagccgggtgctgcagctggaggaggagctgaccctgcggcggggggagattgaggagctgcagcagtgcctgctgcacagcggccccccacctccagaccacccagatgctgctgagatcctgcggctgcgggagcggctgctgagcgccagcaaggagcaccagcgggagagcggcgtgctgcgggacaagtatgagaaggccctgaaggcctaccaggccgaggtggacaagctgcgggccgccaatgagaagtatgcccaggaggtggccggcctgaaggacaaggtgcagcaggccaccagcgagaacatgggcctgatggacaactggaagagcaagctggacagcctggccagtgaccaccagaagagcctggaggacctgaaggccaccctgaacagcggccctggggcccagcagaaggagatcggggagctgaaggctgtgatggagggcatcaagatggagcaccagctggagctgggcaacctgcaggccaagcatgacctggagacagccatgcacgtgaaggagaaggaggccctgcgggagaagctgcaggaggcccaggaggagctggccggcctgcagaggcactggagggcccagctggaggtgcaggccagccagcaccggctggagctgcaggaggcccaggaccagaggagagatgctgagctgcgggtgcatgagctggagaagctggatgtggagtaccggggccaggcccaggccatcgagttcctgaaggagcagatcagcctggccgagaagaagatgctggactatgaaaggctgcagagagctgaggcccagggcaagcaggaggtggagagcctgcgggagaagctgctggtggctgaaaatcggctgcaggccgtggaggccctgtgcagcagccagcacacccacatgattgagagcaatgacatcagcgaggagaccatccgcaccaaggagaccgtggagggcctgcaggacaagctgaacaagagggacaaggaggtgacagccctgaccagccagacagagatgctgcgggcccaggtgtctgccctggagagcaagtgcaagagcggggagaagaaggtggatgccctgctgaaggagaagaggcggctggaggccgagctggagaccgtgtccaggaagacccatgatgccagcggccagctggtgctgatcagccaggagctgctgaggaaggagaggagcctgaatgagctgcgggtgctgctgctggaggccaacagacacagccctggccctgagcgggacctgagccgggaggtgcacaaggccgagtggaggatcaaggagcagaagctgaaggatgacatccggggcctgcgggagaagctgaccggcctggacaaggagaagagcctgagtgaccagaggcgctacagcctgattgacaggagcagcgcccctgagctgctgcggctgcagcaccagctgatgagcacagaagatgccctgagagatgccctggaccaggcccagcaggtggagaagctgatggaggccatgaggagctgcccagacaaggcccagaccatcggcaacagcggcagcgccaacggcatccaccagcaggacaaggcccagaagcaggagaacacccactag

SEQ ID NO: 146142 - DNA, 4827 bp, Artificial Sequence
  Description of Artificial Sequence: Synthetic coding sequence
atgtacagcgcccaccggcccctgatgcctgccagcagcgctgccagccggggcctgggcatgtttgtgtggaccaacgtggagcccaggtctgtggccgtgttcccctggcacagcctggtgcccttcctggcccccagccagcctgaccccagcgtgcagcccagcgaggcccagcagcctgccagccaccctgtggccagcaaccagagcaaggagcctgctgagagcgctgctgtggcccacgagaggcctcctgggggcactggatctgctgaccctgagaggcctcctggggccacctgcccagagagccctggccctggccccccccaccccctgggcgtggtggagagcgggaaaggacctccacccaccacagaggaggaggccagcggccccccaggagagccccggctggacagcgagacagaaagtgaccatgatgatgccttcctgagcatcatgagccctgagatccagctgcccctgcccccaggcaagaggaggacccagagcctgagcgccctgcccaaggagcgggacagcagcagcgagaaggatggccgcagccccaacaagcgggagaaggaccacatcagaagacccatgaatgccttcatgatcttcagcaagaggcaccgggccctggtgcaccagaggcaccccaaccaggacaacagaacagtgtccaagatcctgggggagtggtggtacgccctgggccccaaggagaagcagaagtaccatgacctggccttccaggtgaaggaggcccacttcaaggcccacccagactggaagtggtgcaacaaggacaggaagaagagcagcagcgaggccaagcccaccagcctgggcctggccggcggccacaaggagacccgggagaggtccatgtctgaaacaggaacagctgctgcccctggggtgtcctctgagctgctgtctgtggccgcccagaccctgctgagcagtgacaccaaggcccctggcagcagcagctgtggggctgagcggctgcacacagtgggcggccctggcagcgcccggccccgggccttcagccacagcggcgtgcacagcctggatggaggagaggtggacagccaggccctgcaggagctgacccagatggtgtctggccctgccagctacagcggccccaagcccagcacccagtatggagcccctggcccctttgctgcccctggagagggcggggccctggccgccaccggccggccccccctgctgcccacccgggccagccgcagccagagagctgccagcgaggacatgaccagtgatgaggagaggatggtgatctgtgaggaggagggagatgatgatgtgattgctgatgatggcttcggcaccacagacatcgacctgaagtgcaaggagcgggtgacagacagcgagagcggggacagcagcggggaggaccctgagggcaacaagggcttcggcaggaaggtgttcagccctgtgatccgcagcagcttcacccactgccggccccccctggaccctgagcccccaggccccccagacccccctgtggccttcggcaagggctacggcagcgcccccagcagcagcgccagcagccctgccagcagcagcgccagcgctgccaccagcttcagcctgggcagcggcaccttcaaggcccaggagagcggccagggcagcacagctggccccctgcggcccccacctcctggggccggcggccctgccacccccagcaaggccacccgcttcctgcccatggaccctgccaccttccggaggaagaggcctgagagcgtgggcggcctggagcccccaggccccagcgtgattgctgccccacccagcggcggcggcaacatcctgcagaccctggtgctgccccccaacaaggaggagcaggagggcggcggggcccgggtgcccagcgccccagcccccagcctggcctatggagccccagctgcccccctgagcaggcctgctgccaccatggtgaccaacgtggtgcggcctgtgagcagcacccctgtgcccatcgccagcaagcccttccccaccagcggccgggcagaggccagccccaatgacacagctggggccaggacagagatgggcaccggcagccgggtgcctgggggcagccccctgggcgtgtccctggtgtacagcgacaagaagtctgctgctgccaccagccctgccccccacctggtggccggccccctgctgggcaccgtgggcaaggccccagccaccgtgaccaacctgctggtgggcaccccaggctacggggccccagcccctcctgctgtgcagttcatcgcccagggcgcccctgggggcggcaccacagctggcagcggggccggggccggcagcggccccaatggacctgtgcccctgggcatcctgcagcccggggccctgggcaaggccggcggcatcacccaggtgcagtacatcctgcccaccctgccccagcagctgcaggtggccccagccccagccccagcccctggcaccaaggctgctgcccccagcggccctgcccccaccaccagcatccgcttcaccctgcccccaggcaccagcaccaacgggaaggtgctggccgccacagcccccaccccaggcatccccatcctgcagagcgtgcccagcgcccccccacccaaggcccagagcgtgtcccctgtgcaggcccctcctcctgggggcagcgcccagctgctgcccgggaaggtgctggtgcccctggccgcccccagcatgtctgtgcggggcggcggggccggccagcccctgcccctggtgtccccacccttctctgtgcctgtgcagaatggagcccagccccccagcaagatcatccagctgacccctgtgcctgtgtccaccccatctggcctggtgccccccctgagccctgccaccctgcccggccccaccagccagccccagaaggtgctgctgcccagcagcacccgcatcacctacgtgcagagcgctgggggccacgccctgcccctgggcaccagccctgccagcagccaggccggcaccgtgaccagctatggccccaccagctctgtggccctgggcttcaccagcctgggccccagcggccctgcctttgtgcagcccctgctgtctgctggccaggcccccctgctggcccctggccaggtgggcgtgtcccctgtgcccagcccccagctgcccccagcctgtgccgcccctgggggccctgtgatcacagccttctacagcggcagccctgcccccaccagcagcgcccccctggcccagcccagccaggccccacccagcctggtgtacacagtggccaccagcaccaccccacctgctgccaccatcctgcccaagggccccccagccccagccacagccaccccagcccccaccagccccttccccagcgccacagctggctccatgacctacagcctggtggcccccaaggcccagaggcccagccccaaggccccccagaaggtgaaggccgccatcgccagcatccctgtgggcagctttgaggccggggccagcggccggcccggccctgccccccggcagcccctggagcccggccctgtgcgggagcccacagcccctgagagcgagctggagggccagcccaccccaccagcccccccacccctgcctgagacctggacccccacagcccggagcagcccccccctgcccccacctgctgaggagaggaccagcgccaagggccctgagaccatggccagcaagttccccagcagcagcagtgactggagggtgcccggccagggcctggagaacagaggagagccccccaccccacccagccctgccccagccccagctgtggcccctgggggcagcagcgagagcagcagcggccgggctgctggggacaccccagagaggaaggaggccgccggcaccgggaagaaggtgaaggtgcggcccccacccctgaagaagacctttgacagcgtggacaacagagtgctgtctgaggtggactttgaggagagatttgctgagctgcctgagttccggcctgaggaggtgctgcccagccccaccctgcagagcctggccaccagcccccgggccatcctgggcagctacaggaagaagaggaagaacagcacagacctggacagcgcccctgaggaccccaccagccccaagaggaagatgagaagaagaagcagctgcagcagcgagcccaacacccccaagagcgccaagtgtgagggggacatcttcacctttgacagaactggaacagaagcagaagatgtgctgggggagctggagtatgacaaggtgccctacagcagcctgcggaggaccctggaccagaggcgggccctggtgatgcagctgttccaggaccacggcttcttccccagcgcccaggccacagctgccttccaggcccgctatgctgacatcttccccagcaaggtgtgcctgcagctgaagatccgggaggtgcggcagaagatcatgcaggccgccacccccacagagcagcccccaggagctgaggcccccctgcctgtgcccccacccactggaacagctgctgccccagcccccacccccagccctgctgggggccctgaccccaccagccccagcagtgacagcggcacagcccaggccgccccacccctgcccccacctcctgagagcggccctggccagcccggctgggagggcgccccccagcccagccccccacctcctggccccagcacagctgccaccggccgctag

SEQ ID NO: 146143 - DNA, 1002 bp, Artificial Sequence
  Description of Artificial Sequence: Synthetic coding sequence
atgtacacagccatcccccagagcggcagccccttccctggctctgtgcaggaccccggcctgcacgtgtggagggtggagaagctgaagcctgtgcctgtggcccaggagaaccagggcgtcttcttcagcggggacagctacctggtgctgcacaatggacctgaggaggtgagccacctgcacctgtggattggccagcagagcagcagagatgagcagggcgcctgtgctgtgctggccgtgcacctgaacaccctgctgggggagaggcctgtgcagcaccgggaggtgcagggcaatgaaagtgacctcttcatgagctacttcccccggggcctgaagtaccaggagggcggcgtggagagcgccttccacaagaccagcactggagccccagctgccatcaagaagctgtaccaggtgaagggcaagaagaacatccgggccacagagcgggccctgaactgggacagcttcaacacaggagactgcttcatcctggacctgggccagaacatctttgcctggtgtggcggcaagagcaacatcctggagaggaacaaggcccgggacctggccctggccatccgggacagcgagcggcagggcaaggcccaggtgctgggccccaagccagccctgaaggagggcaaccctgaggaggacctgacagctgacaaggccaatgcccaggccgccgccctgtacaaggtgtctgatgccaccggccagatgaacctgaccaaggtggccgacagcagcccctttgccctggagctgctgatcagtgatgactgctttgtgctggacaatggcctgtgtgggaagatctacatctggaagggcaggaaggccaatgagaaggagcggcaggccgccctgcaggtggccgagggcttcatcagcaggatgcagtatgcccccaacacccaggtggagatcctgccccagggccacgagagccccatcttcaagcagttcttcaaggactggaagtag

SEQ ID NO: 146144 - DNA, 861 bp, Artificial Sequence
  Description of Artificial Sequence: Synthetic coding sequence
atggctgactttgatgacagagtgtctgatgaggagaaggtgagaattgctgccaagttcatcacccacgcccctcctggagagttcaatgaggtgttcaatgatgtgcggctgctgctgaacaatgacaacctgctgcgggagggcgccgcccacgcctttgcccagtacaacatggaccagttcacccctgtgaagattgagggctatgaggaccaggtgctgatcacagaacatggagacctgggcaacagccgcttcctggaccccaggaacaagatctccttcaagtttgaccacctgaggaaggaggccagtgacccccagcctgaggaggctgatggcggcctgaagtcctggagggagagctgtgacagcgccctgcgggcctacgtgaaggaccactacagcaatggcttctgcaccgtgtatgccaagaccattgatggccagcagaccatcatcgcctgcatcgagagccaccagttccagcccaagaacttctggaatggccgctggaggtctgagtggaagttcaccatcaccccacccacagcccaggtggtgggcgtgctgaagatccaggtgcactactatgaagatggaaatgtgcagctggtgagccacaaggatgtgcaggacagcctgactgtgtccaatgaggcccagacagccaaggagttcatcaagatcattgaaaatgcagaaaatgagtaccagacagccatcagcgagaactaccagaccatgtctgacaccaccttcaaggccctgcggcggcagctgcctgtgaccaggaccaagattgactggaacaagatcctgagctacaagattggcaaggagatgcagaatgcctag

SEQ ID NO: 146145 - DNA, 861 bp, Artificial Sequence
  Description of Artificial Sequence: Synthetic coding sequence
atggctgacctggaggagcagctgagtgatgaggagaaggtgagaattgctgccaagttcatcatccacgcccctcctggagagttcaatgaggtgttcaatgatgtgcggctgctgctgaacaatgacaacctgctgcgggagggcgccgcccacgcctttgcccagtacaacctggaccagttcacccctgtgaagattgagggctatgaggaccaggtgctgatcacagaacatggagacctgggcaatggcaagttcctggaccccaagaaccgcatctgcttcaagtttgaccacctgaggaaggaggccacagacccccggccctgtgaggtggagaatgctgtggagagctggaggacctctgtggagacagccctgcgggcctacgtgaaggagcactaccccaacggggtgtgcaccgtgtatggcaagaagattgatggccagcagaccatcatcgcctgcatcgagagccaccagttccaggccaagaacttctggaatggccgctggaggtctgagtggaagttcaccatcacccccagcaccacccaggtggtgggcatcctgaagatccaggtgcactactatgaagatggaaatgtgcagctggtgagccacaaggacatccaggacagcctgactgtgtccaatgaggtgcagacagccaaggagttcatcaagatcgtggaggccgcagaaaatgagtaccagacagccatcagcgagaactaccagaccatgtctgacaccaccttcaaggccctgcggcggcagctgcctgtgaccaggaccaagattgactggaacaagatcctgagctacaagattggcaaggagatgcagaatgcctag

SEQ ID NO: 146146 - DNA, 519 bp, Artificial Sequence
  Description of Artificial Sequence: Synthetic coding sequence
atggctgacctggaggagcagctgagtgatgaggagaaggtgagaattgctgccaagttcatcatccacgcccctcctggagagttcaatgaggtgttcaatgatgtgcggctgctgctgaacaatgacaacctgctgcgggagggcgccgcccacgcctttgcccagtacaacctggaccagttcacccctgtgaagattgagggctatgaggaccaggtgctgatcacagaacatggagacctgggcaatggcaagttcctggaccccaagaaccgcatctgcttcaagtttgaccacctgaggaaggaggccacagacccccggccctgtgaggtggagaatgctgtggagagctggaggacctctgtggagacagccctgcgggcctacgtgaaggagcactaccccaacggggtgtgcacagagtggagcctggaggtgaggatggaggtgtacaaccacagcttcaaccacagcagcggctggcacctggagaacagcggcagcctgctgtag

SEQ ID NO: 146147 - DNA, 900 bp, Artificial Sequence
  Description of Artificial Sequence: Synthetic coding sequence
atgaccctgtctgtgctgagcaggaaggacaaggagagggtcatccggcggctgctgctgcaggcccctcctggagaatttgtgaatgcctttgatgacctgtgcctgctgatcagagatgagaagctgatgcaccaccagggagaatgtgccggccaccagcactgccagaagtacagcgtgcccctgtgcattgatggcaaccctgtgctgctgagccaccacaacgtgatgggagactaccgcttctttgaccaccagagcaagctgtccttcaagtatgacctgctgcagaaccagctgaaggacatccagagccacggcatcatccagaatgaggccgagtacctgcgggtggtgctgctgtgtgccctgaagctgtatgtgaatgaccactaccccaagggcaactgcaacatgctgaggaagacagtgaagagcaaggagtacctgattgcctgcatcgaggaccacaactatgagaccggggagtgctggaatggcctgtggaagagcaagtggatcttccaggtgaaccccttcctgacccaggtgacaggccgcatctttgtgcaggcccacttcttccgctgtgtgaacctgcacatcgagatcagcaaggacctgaaggagagcctggagatcgtgaaccaggcccagctggccctgagctttgcccggctggtggaggagcaggagaacaagttccaggccgctgtgctggaggagctgcaggagctgagcaatgaggccctgaggaagatcctgcggcgggacctgcctgtgaccaggaccctgattgactggcaccgcatcctgagtgacctgaacctggtgatgtaccccaagctgggctacgtgatctacagccgctctgtgctgtgcaactggatcatctag

SEQ ID NO: 146148 - DNA, 834 bp, Artificial Sequence
  Description of Artificial Sequence: Synthetic coding sequence
atgtctgaccagcagctggactgtgccctggacctgatgaggcggctgcccccccagcagatcgagaagaacctgagtgacctgattgacctggtgcccagcctgtgtgaggacctgctgagctctgtggaccagcccctgaagatcgcccgggacaaggtggtgggcaaggactacctgctgtgtgactacaacagagatggagacagctaccgcagcccctggagcaacaagtatgacccccccctggaggatggagccatgcccagcgcccggctgaggaagctggaggtggaggccaacaatgcctttgaccagtacagagacctgtactttgagggcggcgtgtcctctgtgtacctgtgggacctggaccacggctttgctggggtcatcctgatcaagaaggctggagatggcagcaagaagatcaagggctgctgggacagcatccacgtggtggaggtgcaggagaagagcagcggccgcacagcccactacaagctgaccagcacagtgatgctgtggctgcagaccaacaagagcggcagcggcaccatgaacctgggcggcagcctgacccggcagatggagaaggatgagaccgtgtctgactgcagcccccacatcgccaacatcggccgcctggtggaggacatggagaacaagatccgcagcaccctgaatgagatctactttgggaagaccaaggacatcgtgaatggcctgcggagcattgatgccatcccagacaaccagaagttcaagcagctgcagcgggagctgagccaggtgctgacccagaggcagatctacatccagcctgacaactag

SEQ ID NO: 146149 - DNA, 783 bp, Artificial Sequence
  Description of Artificial Sequence: Synthetic coding sequence
atgccccggcagttccaggacaccggcttcagcaggcctggcctgggccagccccggcgctgtgaccctgagcccaggaagagtgaccagcagctggactgtgccctggacctgatgaggcggctgcccccccagcagatcgagaagaacctgagtgacctgattgacctggtgcccagcctgtgtgaggacctgctgagctctgtggaccagcccctgaagatcgcccgggacaaggtggtgggcaaggactacctgctgtgtgactacaacagagatggagacagctaccgcagcccctggagcaacaagtatgacccccccctggaggatggagccatgcccagcgcccggctgaggaagctggaggtggaggccaacaatgcctttgaccagtacagagacctgtactttgagggcggcgtgtcctctgtgtacctgtgggacctggaccacggctttgctggggtcatcctgatcaagaaggctggagatggcagcaagaagatcaagggctgctgggacagcatccacgtggtggaggtgcaggagaagagcagcggccgcacagcccactacaagctgaccagcacagtgatgctgtggctgcagaccaacaagagcggcagcggcaccatgaacctgggcggcagcctgacccggcagatggagaaggatgagaccgtgtctgactgcagcccccacatcgccaacatcggccgcctggtggaggtgtgtgccgacttctgccggcagatcaagaccaggagcagcgaggagtag

SEQ ID NO: 146150 - DNA, 834 bp, Artificial Sequence; identical to SEQ ID NO: 146148
  Description of Artificial Sequence: Synthetic coding sequence

SEQ ID NO: 146151 - DNA, 783 bp, Artificial Sequence
  Description of Artificial Sequence: Synthetic coding sequence
atgaggcggctgcccccccagcagatcgagaagaacctgagtgacctgattgacctggtgcccagcctgtgtgaggacctgctgagctctgtggaccagcccctgaagatcgcccgggacaaggtggtgggcaaggactacctgctgtgtgactacaacagagatggagacagctaccgcagcccctggagcaacaagtatgacccccccctggaggatggagccatgcccagcgcccggctgaggaagctggaggtggaggccaacaatgcctttgaccagtacagagacctgtactttgagggcggcgtgtcctctgtgtacctgtgggacctggaccacggctttgctggggtcatcctgatcaagaaggctggagatggcagcaagaagatcaagggctgctgggacagcatccacgtggtggaggtgcaggagaagagcagcggccgcacagcccactacaagctgaccagcacagtgatgctgtggctgcagaccaacaagagcggcagcggcaccatgaacctgggcggcagcctgacccggcagatggagaaggatgagaccgtgtctgactgcagcccccacatcgccaacatcggccgcctggtggaggacatggagaacaagatccgcagcaccctgaatgagatctactttgggaagaccaaggacatcgtgaatggcctgcggtctgtgcagacctttgctgacaagagcaagcaggaggccctgaagaatgacctggtggaggccctgaagaggaagcagcagtgctag

SEQ ID NO: 146152 - DNA, 1005 bp, Artificial Sequence
  Description of Artificial Sequence: Synthetic coding sequence
atgggcggcccccaggacaaggatgagaggaccatcgccctggtgcggccctggccctggggccaccaggccctggaccctgcctacggcctggacaccatgcaccccagccgccgcagcctgcccttccccctgaactgccagctggcccgggtgggcacagctgactatggcagccccagcgaccagagcgaccagcagctggactgtgccctggacctgatgaggcggctgcccccccagcagatcgagaagaacctgagtgacctgattgacctggtgcccagcctgtgtgaggacctgctgagctctgtggaccagcccctgaagatcgcccgggacaaggtggtgggcaaggactacctgctgtgtgactacaacagagatggagacagctaccgcagcccctggagcaacaagtatgacccccccctggaggatggagccatgcccagcgcccggctgaggaagctggaggtggaggccaacaatgcctttgaccagtacagagacctgtactttgagggcggcgtgtcctctgtgtacctgtgggacctggaccacggctttgctggggtcatcctgatcaagaaggctggagatggcagcaagaagatcaagggctgctgggacagcatccacgtggtggaggtgcaggagaagagcagcggccgcacagcccactacaagctgaccagcacagtgatgctgtggctgcagaccaacaagagcggcagcggcaccatgaacctgggcggcagcctgacccggcagatggagaaggatgagaccgtgtctgactgcagcccccacatcgccaacatcggccgcctggtggaggacatggagaacaagatccgcagcaccctgaatgagatctactttgggaagaccaaggacatcgtgaatggcctgcggtctgtgcagacctttgctgacaagagcaagcaggaggccctgaagaatgacctggtggaggccctgaagaggaagcagcagtgctag

SEQ ID NO: 146153 - DNA, 819 bp, Artificial Sequence
  Description of Artificial Sequence: Synthetic coding sequence
atgtctgaccagcagctggactgtgccctggacctgatgaggcggctgcccccccagcagatcgagaagaacctgagtgacctgattgacctggtgcccagcctgtgtgaggacctgctgagctctgtggaccagcccctgaagatcgcccgggacaaggtggtgggcaaggactacctgctgtgtgactacaacagagatggagacagctaccgcagcccctggagcaacaagtatgacccccccctggaggatggagccatgcccagcgcccggctgaggaagctggaggtggaggccaacaatgcctttgaccagtacagagacctgtactttgagggcggcgtgtcctctgtgtacctgtgggacctggaccacggctttgctggggtcatcctgatcaagaaggctggagatggcagcaagaagatcaagggctgctgggacagcatccacgtggtggaggtgcaggagaagagcagcggccgcacagcccactacaagctgaccagcacagtgatgctgtggctgcagaccaacaagagcggcagcggcaccatgaacctgggcggcagcctgacccggcagatggagaaggatgagaccgtgtctgactgcagcccccacatcgccaacatcggccgcctggtggaggacatggagaacaagatccgcagcaccctgaatgagatctactttgggaagaccaaggacatcgtgaatggcctgcggtctgtgcagacctttgctgacaagagcaagcaggaggccctgaagaatgacctggtggaggccctgaagaggaagcagcagtgctag

SEQ ID NO: 146154 - DNA, 621 bp, Artificial Sequence
  Description of Artificial Sequence: Synthetic coding sequence
atgaggcggctgcccccccagcagatcgagaagaacctgagtgacctgattgacctggtgcccagcctgtgtgaggacctgctgagctctgtggaccagcccctgaagatcgcccgggacaaggtggtgggcaaggactacctgctgtgtgactacaacagagatggagacagctaccgcagcccctggagcaacaagtatgacccccccctggaggatggagccatgcccagcgcccggctgaggaagctggaggtggaggccaacaatgcctttgaccagtacagagacctgtactttgagggcggcgtgtcctctgtgtacctgtgggacctggaccacggctttgctggggtcatcctgatcaagaaggctggagatggcagcaagaagatcaagggctgctgggacagcatccacgtggtggaggtgcaggagaagagcagcggccgcacagcccactacaagctgaccagcacagtgatgctgtggctgcagaccaacaagagcggcagcggcaccatgaacctgggcggcagcctgacccggcagatggagaaggatgagaccgtgtctgactgcagcccccacatcgccaacatcggccgcctggtggagtag

SEQ ID NO: 146155 - DNA, 906 bp, Artificial Sequence
  Description of Artificial Sequence: Synthetic coding sequence
atgcaccccagcagaagaagcctgcccttccccctgaactgccagctggcccgggtgggcacagctgactatggcagccccagcgaccagagcgaccagcagctggactgtgccctggacctgatgaggcggctgcccccccagcagatcgagaagaacctgagtgacctgattgacctggtgcccagcctgtgtgaggacctgctgagctctgtggaccagcccctgaagatcgcccgggacaaggtggtgggcaaggactacctgctgtgtgactacaacagagatggagacagctaccgcagcccctggagcaacaagtatgacccccccctggaggatggagccatgcccagcgcccggctgaggaagctggaggtggaggccaacaatgcctttgaccagtacagagacctgtactttgaaggaggagtgtcctctgtgtacctgtgggacctggaccacggctttgctggggtcatcctgatcaagaaggctggagatggcagcaagaagatcaagggctgctgggacagcatccacgtggtggaggtgcaggagaagagcagcggccgcacagcccactacaagctgaccagcacagtgatgctgtggctgcagaccaacaagagcggcagcggcaccatgaacctgggcggcagcctgacccggcagatggagaaggatgaaacagtgtctgactgcagcccccacatcgccaacatcggccgcctggtggaggacatggagaacaagatccgcagcaccctgaatgagatctactttgggaagaccaaggacatcgtgaatggcctgcggtctgtgcagacctttgctgacaagagcaagcaggaggccctgaagaatgacctggtggaggccctgaagaggaagcagcagtgctag

SEQ ID NO: 146156 - DNA, 366 bp, Artificial Sequence
  Description of Artificial Sequence: Synthetic coding sequence
atgctgaaggtgcccagcctgtgtgaggacctgctgagctctgtggaccagcccctgaagatcgcccgggacaaggtggtgggcaaggactacctgctgtgtgactacaacagagatggagacagctaccgcagcccctggagcaacaagtatgacccccccctggaggatggagccatgcccagcgcccggctgaggaagctggaggtggaggccaacaatgcctttgaccagtacagagacctgtactttgagggcggcgtgtcctctgtgtacctgtgggacctggaccacggctttgctggggtcatcctgatcaagaaggctggagatggcagcaagaagatcaagggctgctgggactag

SEQ ID NO: 146157 - DNA, 1047 bp, Artificial Sequence
  Description of Artificial Sequence: Synthetic coding sequence
atgtacacagccatcccccagagcggcagccccttccctggctctgtgcaggaccccggcctgcacgtgtggagggtggagaagctgaagcctgtgcctgtggcccaggagaaccagggcgtcttcttcagcggggacagctacctggtgctgcacaatggacctgaggaggtgagccacctgcacctgtggattggccagcagagcagcagagatgagcagggcgcctgtgctgtgctggccgtgcacctgaacaccctgctgggggagaggcctgtgcagcaccgggaggtgcagggcaatgaaagtgacctcttcatgagctacttcccccggggcctgaagtaccaggagggcggcgtggagagcgccttccacaagaccagcactggagccccagctgccatcaagaagctgtaccaggtgaagggcaagaagaacatccgggccacagagcgggccctgaactgggacagcttcaacacaggagactgcttcatcctggacctgggccagaacatctttgcctggtgtggcggcaagagcaacatcctggagaggaacaaggcccgggacctggccctggccatccgggacagcgagcggcagggcaaggcccaggtggagatcgtgacagatggagaggagcctgctgagatgatccaggtgctgggccccaagccagccctgaaggagggcaaccctgaggaggacctgacagctgacaaggccaatgcccaggccgccgccctgtacaaggtgtctgatgccaccggccagatgaacctgaccaaggtggccgacagcagcccctttgccctggagctgctgatcagtgatgactgctttgtgctggacaatggcctgtgtgggaagatctacatctggaagggcaggaaggccaatgagaaggagcggcaggccgccctgcaggtggccgagggcttcatcagcaggatgcagtatgcccccaacacccaggtggagatcctgccccagggccacgagagccccatcttcaagcagttcttcaaggactggaagtag

SEQ ID NO: 146158 - DNA, 657 bp, Artificial Sequence
  Description of Artificial Sequence: Synthetic coding sequence
atgtacacagccatcccccagagcggcagccccttccctggctctgtgcaggaccccggcctgcacgtgtggagggtggagaagctgaagcctgtgcctgtggcccaggagaaccagggcgtcttcttcagcggggacagctacctggtgctgcacaatggacctgaggaggtgagccacctgcacctgtggattggccagcagagcagcagagatgagcagggcgcctgtgctgtgctggccgtgcacctgaacaccctgctgggggagaggcctgtgcagcaccgggaggtgcagggcaatgaaagtgacctcttcatgagctacttcccccggggcctgaagtaccaggagggcggcgtggagagcgccttccacaagaccagcactggagccccagctgccatcaagaagctgtaccaggtgaagggcaagaagaacatccgggccacagagcgggccctgaactgggacagcttcaacacaggagactgcttcatcctggacctgggccagaacatctttgcctggtgtggcggcaagagcaacatcctggagaggaacaaggcccgggacctggccctggccatccgggacagcgagcggcagggcaaggcccaggtggagatcgtgacagatggagaggagcccgcctag

SEQ ID NO: 146159 - DNA, 1047 bp, Artificial Sequence; identical to SEQ ID NO: 146157
  Description of Artificial Sequence: Synthetic coding sequence

SEQ ID NO: 146160 - DNA, 1047 bp, Artificial Sequence; identical to SEQ ID NO: 146157
  Description of Artificial Sequence: Synthetic coding sequence

SEQ ID NO: 146161 - DNA, 762 bp, Artificial Sequence
  Description of Artificial Sequence: Synthetic coding sequence
atgtacacagccatcccccagagcggcagccccttccctggctctgtgcaggaccccggcctgcacgtgtggagggtggagaagctgaagcctgtgcctgtggcccaggagaaccagggcgtcttcttcagcggggacagctacctggtgctgcacaatggacctgaggaggtgagccacctgcacctgtggattggccagcagagcagcagagatgagcagggcgcctgtgctgtgctggccgtgcacctgaacaccctgctgggggagaggcctgtgcagcaccgggaggtgcagggcaatgaaagtgacctcttcatgagctacttcccccggggcctgaagtaccaggagggcggcgtggagagcgccttccacaagaccagcactggagccccagctgccatcaagaagctgtaccaggtgaagggcaagaagaacatccgggccacagagcgggccctgaactgggacagcttcaacacaggagactgcttcatcctggacctgggccagaacatctttgcctggtgtggcggcaagagcaacatcctggagaggaacaaggcccgggacctggccctggccatccgggacagcgagcggcagggcaaggcccaggtggagatcgtgacagatggagaggagcctgctgagatgatccaggtgctgggccccaagccagccctgaaggagggcaaccctgaggaggacctgacagctgacaaggccaatgcccaggccgccgccctgtacaagtag

SEQ ID NO: 146162 - DNA, 762 bp, Artificial Sequence; identical to SEQ ID NO: 146161
  Description of Artificial Sequence: Synthetic coding sequence

SEQ ID NO: 146163 - DNA, 762 bp, Artificial Sequence; identical to SEQ ID NO: 146161
  Description of Artificial Sequence: Synthetic coding sequence

SEQ ID NO: 146164 - DNA, 984 bp, Artificial Sequence
  Description of Artificial Sequence: Synthetic coding sequence
atgtacacagccatcccccagagcggcagccccttccctggctctgtgcaggaccccggcctgcacgtgtggagggtggagaagctgaagcctgtgcctgtggcccaggagaaccagggcgtcttcttcagcggggacagctacctggtgctgcacaatggacctgaggaggtgagccacctgcacctgaacaccctgctgggggagaggcctgtgcagcaccgggaggtgcagggcaatgaaagtgacctcttcatgagctacttcccccggggcctgaagtaccaggagggcggcgtggagagcgccttccacaagaccagcactggagccccagctgccatcaagaagctgtaccaggtgaagggcaagaagaacatccgggccacagagcgggccctgaactgggacagcttcaacacaggagactgcttcatcctggacctgggccagaacatctttgcctggtgtggcggcaagagcaacatcctggagaggaacaaggcccgggacctggccctggccatccgggacagcgagcggcagggcaaggcccaggtggagatcgtgacagatggagaggagcctgctgagatgatccaggtgctgggccccaagccagccctgaaggagggcaaccctgaggaggacctgacagctgacaaggccaatgcccaggccgccgccctgtacaaggtgtctgatgccaccggccagatgaacctgaccaaggtggccgacagcagcccctttgccctggagctgctgatcagtgatgactgctttgtgctggacaatggcctgtgtgggaagatctacatctggaagggcaggaaggccaatgagaaggagcggcaggccgccctgcaggtggccgagggcttcatcagcaggatgcagtatgcccccaacacccaggtggagatcctgccccagggccacgagagccccatcttcaagcagttcttcaaggactggaagtag

SEQ ID NO: 146165 - DNA, 654 bp, Artificial Sequence
  Description of Artificial Sequence: Synthetic coding sequence
atggagggcagcttcagtgatggaggagccctgcctgagggcctggccgaggaggccgagccccagggcgccgcctggagcggggacagcggcaccgtgtcccagagccacagcagcgccagcggcccctgggaggatgagggcgcagaagatggagcccctggccgggacctgcccctgctgcggcgggctgctgctggctatgctgcctgcctgctgcccggggccggggcccggcctgaggtggaggccctggatgccagcctggaggacctgctgaccagggtggatgaatttgtgggcatgctggacatgctgcggggggacagcagccacgtggtgtctgaaggagtgccccgcatccacgccaaggctgctgagatgaggcgcatctacagcagaattgaccggctggaggcctttgtgaggatggtgggcggccgggtggccaggatggaggagcaggtgaccaaggccgaggccgagctgggcaccttcccccgggccttcaagaagctgctgcacaccatgaatgtgcccagcctcttcagcaagagcgcccccagccggccccagcaggccggctatgaggcccctgtgctcttcagaacagaggactacttcccctgctgcagcgagcggccccagctgtag

SEQ ID NO: 146166 - DNA, 6678 bp, Artificial Sequence
  Description of Artificial Sequence: Synthetic coding sequence
atggccgccctggtgctggaggatggctctgtgctgcggggccagccctttggagctgctgtgtccacagctggggaggtggtgttccagacaggcatggtgggctacccagaggccctgacagaccccagctacaaggcccagatcctggtgctgacctaccccctgattggcaactacggcatccccccagatgagatggatgaatttggcctgtgcaagtggtttgagagcagcggcatccacgtggccgccctggtggtgggggagtgctgccccacccccagccactggagcgccaccaggaccctgcacgagtggctgcagcagcacggcatccctggcctgcagggcgtggacacccgggagctgaccaagaagctgcgggagcagggcagcctgctgggcaagctggtgcagaatggaacagagcccagcagcctgcccttcctggaccccaatgcccggcccctggtgcctgaggtgtccatcaagacccccagggtcttcaacacaggaggagccccccgcatcctggccctggactgtggcctgaagtacaaccagatccgctgcctgtgccagagaggagctgaggtgacagtggtgccctgggaccacgccctggacagccaggagtatgagggcctcttcctgagcaatggacctggggaccctgccagctaccccagcgtggtgtccaccctgagccgggtgctgtctgagcccaaccccaggcctgtgtttggcatctgcctgggccaccagctgctggccctggccatcggggccaagacctacaagatgagatatggcaacagaggccacaaccagccctgcctgctggtgggcagcggccgctgcttcctgaccagccagaaccacggctttgctgtggagacagacagcctgcctgctgactgggcccccctcttcaccaatgccaatgatggcagcaatgaaggaattgtgcacaacagcctgcccttcttctctgtgcagttccaccctgagcaccaggccggccccagcgacatggagctgctgtttgacatcttcctggagaccgtgaaggaggccacagctggcaaccctgggggccagacagtgcgggagcggctgacagagcggctgtgccccccaggcatccccaccccaggcagcggcctgcccccacccaggaaggtgctgatcctgggcagcggcggcctgagcatcggccaggccggggagtttgactacagcggcagccaggccatcaaggccctgaaggaggagaacatccagaccctgctgatcaaccccaacatcgccaccgtgcagaccagccagggcctggccgacaaggtgtacttcctgcccatcaccccccactacgtgacccaggtgatcagaaatgaaagaccagatggagtgctgctgaccttcggcggccagacagccctgaactgtggggtggagctgaccaaggccggcgtgctggcccgctatggagtgcgggtgctgggcacccctgtggagaccatcgagctgacagaagatagaagagcctttgctgccaggatggccgagattggagagcacgtggcccccagcgaggccgccaacagcctggagcaggcccaggccgctgctgagcggctgggctaccctgtgctggtgcgggccgcctttgccctgggcggcctgggcagcggctttgccagcaaccgggaggagctgagcgccctggtggccccagcctttgcccacaccagccaggtgctggtggacaagagcctgaagggctggaaggagattgaatatgaggtggtgagagatgcctacggcaactgtgtgacagtgtgcaacatggagaacctggaccccctgggcatccacactggagagagcatcgtggtggcccccagccagaccctgaatgaccgggagtaccagctgctgcggcagacagccatcaaggtgacccagcacctgggcatcgtgggggagtgcaatgtgcagtatgccctgaaccctgagagcgagcagtactacatcatcgaggtgaatgcccggctgagccgcagcagcgccctggccagcaaggccaccggctaccccctggcctacgtggccgccaagctggccctgggcatccccctgcctgagctgagaaattctgtgactggaggaacagctgcctttgagcccagcgtggactactgtgtggtgaagatcccccgctgggacctgagcaagttcctgcgggtgtccaccaagattggcagctgcatgaagtctgtgggggaggtgatgggcatcggccgcagctttgaggaggccttccagaaggccctgaggatggtggatgagaactgtgtgggctttgaccacacagtgaagcctgtgtctgacatggagctggagacccccacagacaagaggatctttgtggtggccgccgccctgtgggccggctacagcgtggaccggctgtatgagctgaccagaattgaccgctggttcctgcacaggatgaagaggatcatcgcccacgcccagctgctggagcagcaccggggccagcccctgcccccagacctgctgcagcaggccaagtgcctgggcttcagtgacaagcagatcgccctggccgtgctgagcacagagctggccgtgaggaagctgcggcaggagctgggcatctgcccagctgtgaagcagattgacacagtggccgctgagtggccagcccagaccaactacctgtacctgacctactggggcaccacccatgacctgaccttccgcaccccccacgtgctggtgctgggcagcggcgtgtacagaattggcagctctgtggagtttgactggtgtgctgtgggctgcatccagcagctgaggaagatgggctacaagaccatcatggtgaactacaaccctgagaccgtgtccacagattatgacatgtgtgaccggctgtactttgatgagatcagctttgaggtggtgatggacatctatgagctggagaaccctgagggcgtcatcctgtccatgggcggccagctgcccaacaacatggccatggccctgcaccggcagcagtgccgggtgctgggcaccagccctgaggccatcgacagcgctgagaaccgcttcaagttcagccggctgctggacaccatcggcatcagccagccccagtggagggagctgagtgacctggagagcgcccggcagttctgccagacagtgggctacccctgtgtggtgcggcccagctatgtgctgagcggggccgccatgaatgtggcctacacagatggagacctggagcgcttcctgagcagcgctgctgctgtgtccaaggagcaccctgtggtgatcagcaagttcatccaggaggccaaggagattgatgtggatgctgtggccagtgatggagtggtggccgccatcgccatcagcgagcacgtggagaatgctggggtgcacagcggagatgccaccctggtgaccccaccccaggacatcacagccaagaccctggagcgcatcaaggccatcgtgcatgctgtgggccaggagctgcaggtgacaggccccttcaacctgcagctgattgccaaggatgaccagctgaaggtgattgagtgcaatgtgcgggtgagccgctccttcccctttgtgtccaagaccctgggcgtggacctggtggccctggccaccagggtcatcatgggagaggaggtggagcctgtgggcctgatgacaggcagcggcgtggtgggcgtgaaggtgccccagttctccttcagccggctggccggggctgatgtggtgctgggcgtggagatgaccagcactggagaggtggccggctttggagagagccgctgtgaggcctacctgaaggccatgctgagcacaggcttcaagatccccaagaagaacatcctgctgaccatcggcagctacaagaacaagtctgagctgctgcccaccgtgcggctgctggagagcctgggctacagcctgtatgccagcctgggcacagctgacttctacacagaacatggagtgaaggtgacagctgtggactggcactttgaggaggccgtggatggagaatgtcctccccagaggagcatcctggagcagctggccgagaagaactttgagctggtgatcaacctgtccatgagaggagctgggggccgccgcctgagcagctttgtgaccaagggctaccgcacccggcggctggccgctgacttctctgtgcccctcatcatcgacatcaagtgcaccaagctgtttgtggaggccctgggccagatcggccctgccccacccctgaaggtgcacgtggactgcatgaccagccagaagctggtgcggctgcccggcctgattgatgtgcacgtgcacctgcgggagcccggcggcacccacaaggaggactttgccagcggcacagctgctgccctggccggcggcatcaccatggtgtgtgccatgcccaacacccggccccccatcattgatgccccagccctggccctggcccagaagctggccgaggccggggcccgctgtgactttgccctcttcctgggcgccagcagtgaaaatgccggcaccctgggcaccgtggccggcagcgctgctggcctgaagctgtacctgaatgagaccttcagcgagctgcggctggacagcgtggtgcagtggatggagcactttgagacctggcccagccacctgcccatcgtggcccatgctgagcagcagacagtggccgctgtgctgatggtggcccagctgacccagaggtctgtgcacatctgccacgtggccaggaaggaggagatcctgctgatcaaggccgccaaggcccggggcctgcctgtgacctgtgaggtggccccccaccacctgttcctgagccatgatgacctggagcggctgggccctggaaaaggagaggtgcggcctgagctgggcagccggcaggatgtggaggccctgtgggagaacatggccgtcatcgactgctttgccagtgaccacgccccccacaccctggaggagaagtgtggcagccggcccccacctggcttccctggcctggagaccatgctgcccctgctgctgacagctgtgtctgagggccgcctgagcctggatgacctgctgcagaggctgcaccacaacccccggcgcatcttccacctgcccccccaggaggacacctacgtggaggtggacctggagcacgagtggaccatccccagccacatgcccttcagcaaggcccactggaccccatttgagggccagaaggtgaagggcaccgtgcggcgggtggtgctgcggggggaggtggcctacattgatggccaggtgctggtgcccccaggctacggccaggatgtgaggaagtggccccagggcgctgtgccccagctgcccccatctgccccagccaccagcgagatgaccaccaccccagagcggccccggcggggcatccctggcctgcctgatggccgcttccacctgcccccacgcatccaccgggccagtgaccccggcctgcctgctgaggagcccaaggagaagagcagcaggaaggtggccgagcctgagctgatgggcaccccagatggcacctgctacccacctcctcctgtgccccggcaggccagcccccagaacctgggcaccccaggcctgctgcacccccagaccagccccctgctgcacagcctggtgggccagcacatcctgtctgtgcagcagttcaccaaggaccagatgagccacctgttcaacgtggcccacaccctgaggatgatggtgcagaaggagaggagcctggacatcctgaagggcaaggtgatggcctccatgttttatgaggtgtccaccaggaccagcagcagctttgctgctgccatggcccggctgggcggcgctgtgctgtccttcagcgaggccaccagctctgtgcagaagggggagagcctggccgacagcgtgcagaccatgagctgctacgcagatgtggtggtgctgcggcacccccagcccggggctgtggagctggccgccaagcactgcagaagacctgtgatcaatgctggagatggagtgggggagcaccccacccaggccctgctggacatcttcaccatccgggaggagctgggcaccgtgaatggcatgaccatcaccatggtgggggacctgaagcacggccgcacagtgcacagcctggcctgcctgctgacccagtacagagtgtccctgcgctacgtggccccacccagcctgaggatgccacccaccgtgcgggcctttgtggccagccggggcaccaagcaggaggagtttgagagcattgaggaggccctgcctgacacagatgtgctgtacatgacccgcatccagaaggagcgcttcggcagcacccaggagtatgaggcctgcttcggccagttcatcctgaccccccacatcatgacccgggccaagaagaagatggtggtgatgcaccccatgccccgggtgaatgagatctctgtggaggtggacagcgaccccagggctgcctacttccggcaggccgagaatggcatgtacatccgcatggccctgctggccaccgtgctgggccgcttctag

SEQ ID NO: 146167 - DNA, 1440 bp, Artificial Sequence
  Description of Artificial Sequence: Synthetic coding sequence
atggagaagggcctgaccctgccccaggactgccgggactttgtgcacagcctgaagatgaggagcaaatatgccctcttcctggtgtttgtggtgattgtgtttgtgttcatcgagaaggagaacaagatcatcagccgggtgtctgacaagctgaagcagatcccccaggccctggctgatgccaacagcacagatcctgccctgatcctggctgaaaatgccagcctgctgagcctgtctgagctggacagcgccttcagccagctgcagagccggctgaggaacctgagcctgcagctgggcgtggagcccgccatggaggccgccggggaggaggaggaggagcagaggaaggaggaggagccccccaggcctgctgtggccggcccccggcggcacgtgctgctgatggccaccaccaggacaggcagcagctttgtgggggagttcttcaaccagcagggcaacatcttctacctgtttgagcccctgtggcacatcgagaggacagtgtcctttgagcccggcggggccaatgctgctggcagcgccctggtgtacagagatgtgctgaagcagctgttcctgtgtgacctgtatgtgctggagcacttcatcacccccctgcctgaggaccacctgacccagttcatgttcagaagaggcagcagccgcagcctgtgtgaggaccctgtgtgcaccccatttgtgaagaaggtgtttgagaagtaccactgcaagaacagaagatgtggccccctgaatgtgaccctggccgctgaggcctgcaggaggaaggagcacatggccctgaaggctgtgcgcatccggcagctggagttcctgcagcccctggccgaggacccccggctggacctgcgggtcatccagctggtgcgggaccccagggctgtgctggccagcaggatggtggcctttgctgggaagtacaagacctggaagaagtggctggatgatgagggccaggacggcctgcgggaggaggaggtgcagaggctgcggggcaactgtgagagcatccggctgtctgctgagctgggcctgcggcagcctgcctggctgcggggccgctacatgctggtgcgctatgaagatgtggcccggggccccctgcagaaggcccgggagatgtacagatttgctggcatccccctgaccccccaggtggaggactggatccagaagaacacccaggccgcccatgatggcagcggcatctacagcacccagaagaacagcagcgagcagtttgagaagtggaggttctccatgcccttcaagctggcccaggtggtgcaggccgcctgtggccctgccatgaggctgtttggctacaagctggccagagatgctgctgccctgaccaacagatctgtgtccctgctggaggagcggggcaccttctgggtgacctag

SEQ ID NO: 146168 - DNA, 1236 bp, Artificial Sequence
  Description of Artificial Sequence: Synthetic coding sequence
atgcagtgctcctggaaggctgtgctgctgctggccctggccagcatcgccatccagtacacagccatccgcaccttcaccgccaagagcttccacacctgccccggcctggccgaggccggcctggccgagcggctgtgtgaggagagccccacctttgcctacaacctgagcaggaagacccacatcctgatcctggccaccaccaggagcggcagcagctttgtgggccagctgttcaaccagcacctggatgtgttctacctgtttgagcccctgtaccacgtgcagaacaccctcatcccccgcttcacccagggcaagagccctgctgacagaagagtgatgctgggcgccagccgggacctgctgcggagcctgtatgactgtgacctgtacttcctggagaactacatcaagcccccacctgtgaaccacaccacagaccgcatcttcagaagaggagccagccgggtgctgtgcagcaggcctgtgtgtgaccccccaggccctgctgacctggtgctggaggagggggactgtgtgaggaaatgtggcctgctgaacctgactgtggccgctgaggcctgccgggagaggagccacgtggccatcaagacagtgcgggtgcctgaggtgaatgacctgcgggccctggtggaggacccccggctgaacctgaaggtgatccagctggtgcgggacccccggggcatcctggccagccgctctgagaccttccgggacacctaccgcctgtggaggctgtggtacggcaccggcaggaagccctacaacctggatgtgacccagctgaccaccgtgtgtgaggacttcagcaacagcgtgtccacaggcctgatgaggcctccctggctgaagggcaagtacatgctggtgcgctatgaggacctggccaggaaccccatgaagaagacagaggagatctacggcttcctgggcatccccctggacagccacgtggcccgctggatccagaacaacaccaggggggaccccaccctgggcaagcacaagtatggaacagtgagaaattctgctgccacagctgagaagtggaggttccggctgtcctatgacatcgtggcctttgcccagaatgcctgccagcaggtgctggcccagctgggctacaagattgctgccagcgaggaggagctgaagaaccccagcgtgtccctggtggaggagcgggacttccggcccttctcctag

SEQ ID NO: 146169 - DNA, 1131 bp, Artificial Sequence
  Description of Artificial Sequence: Synthetic coding sequence
atgttcccccggcccctgacccccctggccgccccaaatggagctgagcccctgggccgggccctgcggcgggcccccctgggccgggcccgggccggcctgggcggcccccccctgctgctgcccagcatgctgatgtttgctgtgattgtggccagcagcggcctgctgctgatgattgaaagaggcatcctggccgagatgaagcccctgcccctgcaccccccaggccgggagggcacagcctggaggggcaaggcccccaagccaggcggcctgagcctgcgggctggagatgctgacctgcaggtgcggcaggatgtgaggaacagaaccctgcgggctgtgtgtggccagcccggcatgccccgggacccctgggacctgcctgtgggccagaggaggaccctgctgcggcacatcctggtgtctgaccgctaccgcttcctgtactgctacgtgcccaaggtggcctgcagcaactggaagagggtgatgaaggtgctggccggcgtgctggacagcgtggatgtgcggctgaagatggaccacagaagtgacctggtgttcctggccgacctgcggcctgaggagatccgctaccgcctgcagcactacttcaagttcctgtttgtgcgggagcccctggagcggctgctgagcgcctacagaaacaagtttggagagatccgggagtaccagcagagatatggagctgagatcgtgcggcgctacagagctggagctggccccagccctgctggagatgatgtgaccttccctgagttcctgcgctacctggtggatgaggaccctgagaggatgaatgagcactggatgcctgtgtaccacctgtgccagccctgtgctgtgcactatgactttgtgggcagctatgagcggctggaggctgatgccaaccaggtgctggagtgggtgcgggccccaccccacgtgcgcttccctgcccggcaggcctggtacagacctgccagccctgagagcctgcactaccacctgtgcagcgccccccgggccctgctgcaggatgtgctgcccaagtacatcctggacttcagcctgtttgcctaccccctgcccaacgtgaccaaggaggcctgccagcagtag

SEQ ID NO: 146170 - DNA, 1275 bp, Artificial Sequence
  Description of Artificial Sequence: Synthetic coding sequence
atgaccctgcggcccggcaccatgaggctggcctgcatgttcagcagcatcctgctgtttggagctgctggcctgctgctcttcatcagcctgcaggaccccacagagctggccccccagcaggtgcccggcatcaagttcaacatccggccccggcagccccaccacgacctgcccccaggcggcagccaggatggagacctgaaggagcccacagagcgggtgacccgggacctgagcagcggggccccccggggcaggaacctgcctgccccagaccagccccagccccccctgcagaggggcacccggctgcggctgcggcagaggagaagaaggctgctgatcaagaagatgcctgctgctgccaccatcccagccaacagcagtgatgcccccttcatccggcccggccctggcaccctggatggccgctgggtgtccctgcacaggagccagcaggagaggaagagggtgatgcaggaggcctgtgccaagtaccgggccagcagcagcagaagagctgtgacccccaggcatgtgagccgcatctttgtggaggacagacaccgggtgctgtactgtgaggtgcccaaggccggctgcagcaactggaagagggtgctgatggtgctggccggcctggccagcagcacagctgacatccagcacaacacagtgcactacggcagcgccctgaagaggctggacacctttgaccggcagggcatcctgcaccggctgagcacctacaccaagatgctgtttgtgcgggagccctttgagcggctggtgtctgccttccgggacaagtttgagcaccccaacagctactaccaccctgtgtttgggaaggccatcctggcccgctaccgggccaatgccagccgggaggccctgaggacaggcagcggcgtgcgcttccctgagtttgtgcagtacctgctggatgtgcacaggcctgtgggcatggacatccactgggaccacgtgtcccggctgtgcagcccctgcctgattgattatgactttgtgggcaagtttgagagcatggaggatgatgccaacttcttcctgagcctcatccgggcccccaggaacctgaccttcccccgcttcaaggacagacacagccaggaggcccggaccacagccagaattgcccaccagtactttgcccagctgagcgccctgcagaggcagaggacctatgacttctactacatggactacctgatgttcaactacagcaagccctttgctgacctgtactag

SEQ ID NO: 146171 - DNA, 1275 bp, Artificial Sequence; identical to SEQ ID NO: 146170
  Description of Artificial Sequence: Synthetic coding sequence

SEQ ID NO: 146172 - DNA, 1275 bp, Artificial Sequence; identical to SEQ ID NO: 146170
  Description of Artificial Sequence: Synthetic coding sequence

SEQ ID NO: 146173 - DNA, 1686 bp, Artificial Sequence
  Description of Artificial Sequence: Synthetic coding sequence
atgaggcactgcatcaactgctgcatccagctgctgcctgatggagcccacaagcagcaggtgaactgccagggcggcccccaccacggccaccaggcctgccccacctgcaagggggagaacaagatcctcttccgggtggacagcaagcagatgaacctgctggccgtgctggaggtgaggacagagggcaatgaaaactggggcggcttcctgcgcttcaagaagggcaagcgctgcagcctggtgtttggcctcatcatcatgaccctggtgatggccagctacatcctgagcggggcccaccaggagctgctgatcagcagccccttccactatggaggcttccccagcaaccccagcctgatggattctgagaaccccagcgacaccaaggagcaccaccaccagagctctgtgaacaacatctcctacatgaaggactaccccagcatcaagctgatcatcaacagcatcaccaccagaattgagttcaccacccggcagctgcctgacctggaggacctgaagaagcaggagctgcacatgttttctgtcatccccaacaagttcctgcccaacagcaagagcccctgctggtatgaggagttcagcggccagaacaccacagacccctacctgaccaacagctatgtgctgtacagcaagcgcttccgcagcacctttgatgccctgaggaaggccttctggggccacctggcccacgcccacggcaagcacttccggctgcgctgcctgccccacttctacatcatcggccagcccaagtgtggcaccacagacctgtatgaccggctgcggctgcaccctgaggtgaagttcagcgccatcaaggagccccactggtggaccaggaagagatttggaattgtgcggctgagagatggcctgcgggaccgctaccctgtggaggactacctggacctgtttgacctggccgcccaccagatccaccagggcctgcaggccagcagcgccaaggagcagagcaagatgaacaccatcatcatcggggaggccagcgccagcaccatgtgggacaacaatgcctggaccttcttctatgacaacagcacagatggagagccccccttcctgacccaggacttcatccacgccttccagcccaatgcccggctcatcgtgatgctgcgggaccctgtggagcggctgtacagcgactacctgtactttgccagcagcaacaagtctgcagatgacttccacgagaaggtgacagaggccctgcagctgtttgagaactgcatgctggactacagcctgcgggcctgtgtgtacaacaacaccctgaacaatgccatgcctgtgcggctgcaggtgggcctgtatgctgtgtacctgctggactggctgtctgtgtttgacaagcagcagttcctgatcctgcggctggaggaccacgccagcaatgtgaagtacaccatgcacaaggtgttccagttcctgaacctgggccccctgtctgagaagcaggaggccctgatgaccaagagccctgccagcaatgcccggcggccagaagatagaaacctgggccccatgtggcccatcacccagaagatcctgcgggacttctaccggcccttcaatgcccggctggcccaggtgctggctgatgaggcctttgcctggaagaccacctag

SEQ ID NO: 146174 - DNA, 1521 bp, Artificial Sequence
  Description of Artificial Sequence: Synthetic coding sequence
atgaggcactgcatcaactgctgcatccagctgctgcctgatggagcccacaagcagcaggtgaactgccagggcggcccccaccacggccaccaggcctgccccacctgcaagggggagaacaagatcctcttccgggtggacagcaagcagatgaacctgctggccgtgctggaggtgaggacagagggcaatgaaaactggggcggcttcctgcgcttcaagaagggcaagcgctgcagcctggtgtttggcctcatcatcatgaccctggtgatggccagctacatcctgagcggggcccaccaggagctgctgatcagcagccccttccactatggaggcttccccagcaaccccagcctgatggattctgagaaccccagcgacaccaaggagcaccaccaccagagctctgtgaacaacatctcctacatgaaggactaccccagcatcaagctgatcatcaacagcatcaccaccagaattgagttcaccacccggcagctgcctgacctggaggacctgaagaagcaggagctgcacatgttttctgtcatccccaacaagttcctgcccaacagcaagagcccctgctggtatgaggagttcagcggccagaacaccacagacccctacctgaccaacagctatgtgctgtacagcaagcgcttccgcagcacctttgatgccctgaggaaggccttctggggccacctggcccacgcccacggcaagcacttccggctgcgctgcctgccccacttctacatcatcggccagcccaagtgtggcaccacagacctgtatgaccggctgcggctgcaccctgaggtgaagttcagcgccatcaaggagccccactggtggaccaggaagagatttggaattgtgcggctgagagatggcctgcgggaccgctaccctgtggaggactacctggacctgtttgacctggccgcccaccagatccaccagggcctgcaggccagcagcgccaaggagcagagcaagatgaacaccatcatcatcggggaggccagcgccagcaccatgtgggacaacaatgcctggaccttcttctatgacaacagcacagatggagagccccccttcctgacccaggacttcatccacgccttccagcccaatgcccggctcatcgtgatgctgcgggaccctgtggagcggctgtacagcgactacctgtactttgccagcagcaacaagtctgcagatgacttccacgagaaggtgacagaggccctgcagctgtttgagaactgcatgctggactacagcctgcgggcctgtgtgtacaacaacaccctgaacaatgccatgcctgtgtgcaccccaccacccaggaccccccgggccggcccctggcagaaggagctggtgtgctgctactatgccagcggcatcgtgggcctgcgcttcagcattggaacagagaggtctgtgctgatgtgcaagtgctgcagccccctcttcatggatgtgaaggcagaaaattag

SEQ ID NO: 146175 - DNA, 624 bp, Artificial Sequence
  Description of Artificial Sequence: Synthetic coding sequence
atgaggcactgcatcaactgctgcatccagctgctgcctgatggagcccacaagcagcaggtgaactgccagggcggcccccaccacggccaccaggcctgccccacctgcaagggggagaacaagatcctcttccgggtggacagcaagcagatgaacctgctggccgtgctggaggtgaggacagagggcaatgaaaactggggcggcttcctgcgcttcaagaagggcaagcgctgcagcctggtgtttggcctcatcatcatgaccctggtgatggccagctacatcctgagcggggcccaccaggagctgctgatcagcagccccttccactatggaggcttccccagcaaccccagcctgatggattctgagaaccccagcgacaccaaggagcaccaccaccagagctctgtgaacaacatctcctacatgaaggactaccccagcatcaagctgatcatcaacagcatcaccaccagaattgagttcaccacccggcagctgcctgacctggaggacctgaagaagcaggagctgcacatgttttctgtcatccccaacaagttcctgcccaagcacaatgcccaggccgagctgggcctgaatgtggcctgctag

SEQ ID NO: 146176 - DNA, 1686 bp, Artificial Sequence; identical to SEQ ID NO: 146173
  Description of Artificial Sequence: Synthetic coding sequence

SEQ ID NO: 146177 - DNA, 1449 bp, Artificial Sequence
  Description of Artificial Sequence: Synthetic coding sequence
atgaggcactgcatcaactgctgcatccagctgctgcctgatggagcccacaagcagcaggtgaactgccagggcggcccccaccacggccaccaggcctgccccacctgcaagggggagaacaagatcctcttccgggtggacagcaagcagatgaacctgctggccgtgctggaggtgaggacagagggcaatgaaaactggggcggcttcctgcgcttcaagaagggcaagcgctgcagcctggtgtttggcctcatcatcatgaccctggtgatggccagctacatcctgagcggggcccaccaggagctgctgatcagcagccccttccactatggaggcttccccagcaaccccagcctgatggattctgagaaccccagcgacaccaaggagcaccaccaccagagctctgtgaacaacatctcctacatgaaggactaccccagcatcaagctgatcatcaacagcatcaccaccagaattgagttcaccacccggcagctgcctgacctggaggacctgaagaagcaggagctgcacatgttttctgtcatccccaacaagttcctgcccaacagcaagagcccctgctggtatgaggagttcagcggccagaacaccacagacccctacctgaccaacagctatgtgctgtacagcaagcgcttccgcagcacctttgatgccctgaggaaggccttctggggccacctggcccacgcccacggcaagcacttccggctgcgctgcctgccccacttctacatcatcggccagcccaagtgtggcaccacagacctgtatgaccggctgcggctgcaccctgaggtgaagttcagcgccatcaaggagccccactggtggaccaggaagagatttggaattgtgcggctgagagatggcctgcgggaccgctaccctgtggaggactacctggacctgtttgacctggccgcccaccagatccaccagggcctgcaggccagcagcgccaaggagcagagcaagatgaacaccatcatcatcggggaggccagcgccagcaccatgtgggacaacaatgcctggaccttcttctatgacaacagcacagatggagagccccccttcctgacccaggacttcatccacgccttccagcccaatgcccggctcatcgtgatgctgcgggaccctgtggagcggctgtacagcgactacctgtactttgccagcagcaacaagtctgcagatgacttccacgagaaggtgacagaggccctgcagctgtttgagaactgcatgctggactacagcctgcgggcctgtgtgtacaacaacaccctgaacaatgccatgcctgtgtgcaccccacctcctgtgcccccagagctggcccctggccgccgctcctggtttgtggtgatcatgcaggccgccctgtgggtgtgtgtgtctgcctag

SEQ ID NO: 146178 - DNA, 1236 bp, Artificial Sequence
  Description of Artificial Sequence: Synthetic coding sequence
atgggcatgagggcccgggtgcccaaggtggcccacagcaccaggaggcctcctgctgccaggatgtggctgccccgcttcagcagcaagacagtgacagtgctgctgctggcccagaccacctgcctgctgctcttcatcatcagcaggcctggccccagcagccctgctggaggagaggacagagtgcacgtgctggtgctgagctcctggaggagcggcagcagcttcctgggccagctgttcagccagcacccagatgtgttctacctgatggagcccgcctggcacgtgtggaccaccctgagccagggcagcgctgccaccctgcacatggctgtgcgggacctgatgaggagcatcttcctgtgtgacatggatgtgtttgatgcctacatgccccagagcaggaacctgagcgccttcttcaactgggccaccagccgggccctgtgcagccccccagcctgcagcgccttcccccggggcaccatcagcaagcaggatgtgtgcaagaccctgtgcacccggcagcccttcagcctggcccgggaggcctgccgcagctacagccacgtggtgctgaaggaggtgcgcttcttcaacctgcaggtgctgtaccccctgctgagtgaccctgccctgaacctgagaattgtgcacctggtgcgggaccccagggctgtgctgcggagccgggaggccgccggccccatcctggcccgggacaatggcatcgtgctgggcaccaacgggaagtgggtggaggccgacccccacctgcggctcatccgggaggtgtgccgcagccacgtgagaattgctgaggccgccaccctgaagcccccacccttcctgcggggccgctaccgcctggtgcgctttgaggacctggcccgggagcccctggccgagatccgggccctgtatgccttcaccggcctgaccctgaccccccagctggaggcctggatccacaacatcacccacggcagcggcatcggcaagcccatcgaggccttccacaccagcagcagaaatgccagaaatgtgtcccaggcctggaggcatgccctgcccttcaccaagatcctgcgggtgcaggaggtgtgtgccggggccctgcagctgctgggctacagacctgtgtacagcgctgaccagcagagggacctgaccctggacctggtgctgccccggggccctgaccacttctcctgggccagcccagactag

SEQ ID NO: 146179 - DNA, 1254 bp, Artificial Sequence
  Description of Artificial Sequence: Synthetic coding sequence
atgagccgccacctgccctggatctgtgaccagcgctgcagcagccccagcagccctggccgctggcccccagctgccaggatgtggctgccccgcttcagcagcaagacagtgacagtgctgctgctggcccagaccacctgcctgctgctcttcatcatcagcaggcctggccccagcagccctgctggaggagaggacagagtgcacgtgctggtgctgagctcctggaggagcggcagcagcttcctgggccagctgttcagccagcacccagatgtgttctacctgatggagcccgcctggcacgtgtggaccaccctgagccagggcagcgctgccaccctgcacatggctgtgcgggacctgatgaggagcatcttcctgtgtgacatggatgtgtttgatgcctacatgccccagagcaggaacctgagcgccttcttcaactgggccaccagccgggccctgtgcagccccccagcctgcagcgccttcccccggggcaccatcagcaagcaggatgtgtgcaagaccctgtgcacccggcagcccttcagcctggcccgggaggcctgccgcagctacagccacgtggtgctgaaggaggtgcgcttcttcaacctgcaggtgctgtaccccctgctgagtgaccctgccctgaacctgagaattgtgcacctggtgcgggaccccagggctgtgctgcggagccgggaggccgccggccccatcctggcccgggacaatggcatcgtgctgggcaccaacgggaagtgggtggaggccgacccccacctgcggctcatccgggaggtgtgccgcagccacgtgagaattgctgaggccgccaccctgaagcccccacccttcctgcggggccgctaccgcctggtgcgctttgaggacctggcccgggagcccctggccgagatccgggccctgtatgccttcaccggcctgaccctgaccccccagctggaggcctggatccacaacatcacccacggcagcggcatcggcaagcccatcgaggccttccacaccagcagcagaaatgccagaaatgtgtcccaggcctggaggcatgccctgcccttcaccaagatcctgcgggtgcaggaggtgtgtgccggggccctgcagctgctgggctacagacctgtgtacagcgctgaccagcagagggacctgaccctggacctggtgctgccccggggccctgaccacttctcctgggccagcccagactag

SEQ ID NO: 146180 - DNA, 1188 bp, Artificial Sequence
  Description of Artificial Sequence: Synthetic coding sequence
atgtggctgccccgggtgagcagcacagctgtgacagccctgctgctggcccagaccttcctgctgctcttcctggtgtccaggcctggccccagcagccctgctggaggagaggcccgggtgcacgtgctggtgctgagctcctggaggagcggcagcagctttgtgggccagctgttcaaccagcacccagatgtgttctacctgatggagcccgcctggcacgtgtggaccaccctgagccagggcagcgctgccaccctgcacatggctgtgcgggacctggtgcgcagcgtcttcctgtgtgacatggatgtgtttgatgcctacctgccctggaggaggaacctgagtgacctcttccagtgggccgtgtcccgggccctgtgcagccccccagcctgcagcgccttccccaggggggccatcagcagcgaggccgtgtgcaagcccctgtgtgcccggcagagcttcaccctggcccgggaggcctgccgcagctacagccacgtggtgctgaaggaggtgcgcttcttcaacctgcaggtgctgtaccccctgctgagtgaccctgccctgaacctgagaattgtgcacctggtgcgggaccccagggctgtgctgcggagccgggagcagacagccaaggccctggcccgggacaatggcatcgtgctgggcaccaacggcacctgggtggaggccgaccccggcctgcgggtggtgcgggaggtgtgccgcagccacgtgagaattgctgaggccgccaccctgaagcccccacccttcctgcggggccgctaccgcctggtgcgctttgaggacctggcccgggagcccctggccgagatccgggccctgtatgccttcaccggcctgagcctgaccccccagctggaggcctggatccacaacatcacccacggcagcggccctggggcccggcgggaggccttcaagaccagcagcagaaatgccctgaatgtgtcccaggcctggaggcatgccctgccctttgccaagatcagaagagtgcaggagctgtgtgccggggccctgcagctgctgggctacagacctgtgtacagtgaagatgagcagaggaacctggccctggacctggtgctgccccggggcctgaatggcttcacctgggccagcagcacagccagccaccccaggaactag

SEQ ID NO: 146181 - DNA, 1188 bp, Artificial Sequence; identical to SEQ ID NO: 146180
  Description of Artificial Sequence: Synthetic coding sequence

SEQ ID NO: 146182 - DNA, 1461 bp, Artificial Sequence
  Description of Artificial Sequence: Synthetic coding sequence
atgaagggcagaagaagaagaagaagagagtactgcaagtttgccctgctgctggtgctgtacaccctggtgctgctgctggtgcccagcgtgctggatggcggcagagatggagacaagggagctgagcactgccccggcctgcagaggagcctgggcgtgtggagcctggaggccgctgctgctggggagcgggagcagggcgctgaggcccgggctgctgaggagggcggggccaaccagagcccccgcttccccagcaacctgagcggggctgtgggggaggccgtgtcccgggagaagcagcacatctacgtgcacgccacctggaggacaggcagcagcttcctgggggagctgttcaaccagcacccagatgtgttctacctgtatgagcccatgtggcacctgtggcaggccctgtacccaggagatgctgagagcctgcagggcgccctgcgggacatgctgcggagcctcttccgctgtgacttctctgtgctgcggctgtatgcccctcctggggaccctgctgcccgggccccagacacagccaacctgaccacagctgccctcttccgctggaggaccaacaaggtgatctgcagcccccccctgtgccctggggccccccgggcccgggcagaggtgggcctggtggaggacacagcctgtgagaggagctgcccccctgtggccatccgggccctggaggccgagtgcaggaagtaccctgtggtggtgatcaaggatgtgcggctgctggacctgggcgtgctggtgcccctgctgcgggaccccggcctgaacctgaaggtggtgcagctgttccgggaccccagggctgtgcacaacagccggctgaagagccggcagggcctgctgcgggagagcatccaggtgctgcggacccggcagagaggagaccgcttccaccgggtgctgctggcccacggcgtgggcgcccggcctgggggccagagccgggccctgcctgctgcccccagggctgacttcttcctgaccggggccctggaggtgatctgtgaggcctggctgcgggacctgctgtttgcccggggggccccagcctggctgcggcggcgctacctgcggctgcgctatgaggacctggtgcggcagccccgggcccagctgcggcggctgctgcgcttcagcggcctgcgggccctggccgccctggatgcctttgccctgaacatgaccaggggggccgcctacggggctgaccggcccttccacctgagcgccagagatgcccgggaggccgtgcacgcctggagggagcggctgagccgggagcaggtgcggcaggtggaggccgcctgtgccccagccatgaggctgctggcctaccccaggtctggagaggagggagatgctgagcagccccgggagggggagacccccctggagatggatgctgatggagccacctag

SEQ ID NO: 146183 - DNA, 1593 bp, Artificial Sequence
  Description of Artificial Sequence: Synthetic coding sequence
atgagccgcagcccccagagggccctgcccccaggggccctgccccggctgctgcaggccgccccagctgctgccccccgggccctgctgccccagtggcccaggaggcctggaagacgctggccagccagccccctgggcatgaaggtgttccggaggaaggccctggtgctgtgtgccggctacgccctgctgctggtgctgaccatgctgaacctgctggactacaagtggcacaaggagcccctgcagcagtgcaacccagatggccccctgggcgctgctgctggagctgctgggggctcctggggccggcccggccccccacctgctggccccccccgggcccacgcccggctggacctgcggaccccctaccggcccccagctgctgctgtgggcgccgccccagctgctgctgctggcatggccggcgtggccgcccctcctggaaatggcacccggggcactggaggagtgggggacaagaggcagctggtgtatgtgttcaccacctggaggagcggcagcagcttcttcggggagctgttcaaccagaaccctgaggtgttcttcctgtatgagcctgtgtggcacgtgtggcagaagctgtacccaggagatgctgtgtccctgcagggcgccgcccgggacatgctgagcgccctgtaccgctgtgacctgtctgtgttccagctgtacagccctgctggcagcggcggcaggaacctgaccaccctgggcatctttggagctgccaccaacaaggtggtgtgcagcagccccctgtgcccagcctacaggaaggaggtggtgggcctggtggatgacagagtgtgcaagaagtgccccccccagaggctggccaggtttgaggaggagtgcaggaagtaccgcaccctggtgatcaagggcgtgcgggtgtttgatgtggccgtgctggcccccctgctgcgggaccctgccctggacctgaaggtgatccacctggtgcgggaccccagggctgtggccagcagccgcatccgcagccgccacggcctcatccgggagagcctgcaggtggtgcgcagccgggacccccgggcccacaggatgcccttcctggaggccgccggccacaagctgggcgccaagaaggagggcgtgggcggccctgctgactaccacgccctgggcgccatggaggtgatctgcaacagcatggccaagaccctgcagacagccctgcagcccccagactggctgcagggccactacctggtggtgcgctatgaggacctggtgggggaccctgtgaagaccctgcggcgggtgtatgactttgtgggcctgctggtgtccccagagatggagcagtttgccctgaacatgaccagcggcagcggcagcagcagcaagccctttgtggtgtctgccagaaatgccacccaggccgccaatgcctggaggacagccctgaccttccagcagatcaagcaggtggaggagttctgctaccagcccatggctgtgctgggctatgaaagagtgaacagccctgaggaggtgaaggacctgagcaagaccctgctgaggaagccccggctgtag

SEQ ID NO: 146184 - DNA, 1071 bp, Artificial Sequence
  Description of Artificial Sequence: Synthetic coding sequence
atgcaccaccagtggctgctgctggccgcctgcttctgggtgatcttcatgttcatggtggccagcaagttcatcaccctgaccttcaaggaccctgatgtgtacagcgccaagcaggagttcctgttcctgaccaccatgcctgaggtgaggaagctgcctgaggagaagcacatccctgaggagctgaagcccaccgggaaggagctgcctgacagccagctggtgcagcccctggtgtacatggagcggctggagctgatcagaaatgtgtgcagagatgatgccctgaagaacctgagccacacccctgtgtccaagtttgtgctggaccgcatctttgtgtgtgacaagcacaagatcctcttctgccagacccccaaggtgggcaacacccagtggaagaaggtgctgattgtgctgaatggagccttcagcagcattgaggagatcccagaaaatgtggtgcatgaccacgagaagaatggcctgccccggctgagcagcttcagtgatgctgagatccagaagaggctgaagacctacttcaagttcttcatcgtgcgggacccctttgagcggctcatcagcgccttcaaggacaagtttgtgcacaaccccaggtttgagccctggtacagacatgaaattgcccctggcatcatcaggaagtacagaagaaacagaacagagacccggggcatccagtttgaggactttgtgcgctacctgggggaccccaaccaccgctggctggacctgcagtttggagaccacatcatccactgggtgacctacgtggagctgtgtgccccctgtgagatcatgtacagcgtcatcggccaccacgagaccctggaggatgatgccccctacatcctgaaggaggccggcatcgaccacctggtgtcctaccccaccatccccccaggcatcaccgtgtacaacagaaccaaggtggagcactacttcctgggcatcagcaagagggacatccggcggctgtatgccaggtttgaaggagacttcaagctgtttggctaccagaagccagacttcctgctgaactag

SEQ ID NO: 146185 - DNA, 426 bp, Artificial Sequence
  Description of Artificial Sequence: Synthetic coding sequence
atgcaccaccagtggctgctgctggccgcctgcttctgggtgatcttcatgttcatggtggccagcaagttcatcaccctgaccttcaaggaccctgatgtgtacagcgccaagcaggagttcctgttcctgaccaccatgcctgaggtgaggaagctgcctgaggagaagcacatccctgaggagctgaagcccaccgggaaggagctgcctgacagccagctggtgcagcccctggtgtacatggagcggctggagctgatcagaaatgtgtgcagagatgatgccctgaagaacctgagccacacccctgtgtccaagtttgtgctggaccgcatctttgtgtgtgacaagcacaagatcctcttctgccagacccccaaggtgggcaacacccagtggaagaaggtgctgattgtgctgtag

SEQ ID NO: 146186 - DNA, 1071 bp, Artificial Sequence; identical to SEQ ID NO: 146184
  Description of Artificial Sequence: Synthetic coding sequence

SEQ ID NO: 146187 - DNA, 195 bp, Artificial Sequence
  Description of Artificial Sequence: Synthetic coding sequence
atgcaccaccagtggctgctgctggccgcctgcttctgggtgatcttcatgttcatggtggccagcaagttcatcaccctgaccttcaaggaccctgatgtgtacagcgccaagcaggagttcctgttcctgaccaccatgcctgaggtgaggaagctgcctgaggagaagcacatccctgaggagctgaagtag

SEQ ID NO: 146188 - DNA, 402 bp, Artificial Sequence
  Description of Artificial Sequence: Synthetic coding sequence
atgcaccaccagtggctgctgctggccgcctgcttctgggtgatcttcatgttcatggtggccagcaagttcatcaccctgaccttcaaggaccctgatgtgtacagcgccaagcaggagttcctgttcctgaccaccatgcctgaggtgaggaagctgcctgaggagaagcacatccctgaggagctgaagcccaccgggaaggagctgcctgacagccagctggtgcagcccctggtgtacatggagcggctggagctgatcagaaatgtgtgcagagatgatgccctgaagaacctgagccacacccctgtgtccaagtttgtgctggaccgcatctttgtgtgtgacaagcacaagatcctcttctgccagacccccaaggtgggcaacacccagtag

SEQ ID NO: 146189 - DNA, 258 bp, Artificial Sequence
  Description of Artificial Sequence: Synthetic coding sequence
atgcaccaccagtggctgctgctggccgcctgcttctgggtgatcttcatgttcatggtggccagcaagttcatcaccctgaccttcaaggaccctgatgtgtacagcgccaagcaggagttcctgttcctgaccaccatgcctgaggtgaggaagctgcctgaggagaagcacatccctgaggagctgaagcccaccgggaaggagctgcctgacagccagctggtgcagcccctggtgtacatggagcggctgtag

SEQ ID NO: 146190 - DNA, 102 bp, Artificial Sequence
  Description of Artificial Sequence: Synthetic coding sequence
atgcaccaccagtggctgctgctggccgcctgcttctgggtgatcttcatgttcatggtggccagcaagttcatcaccctgaccttcaaggaccctgactag

SEQ ID NO: 146191 - DNA, 1215 bp, Artificial Sequence
  Description of Artificial Sequence: Synthetic coding sequence
atgcagaggaaggccggcaagaaggagcacgtgcagctgcgggacaagaggaaccaggagccccagttccggggcaacacagccaggaaatgtgagccccaggccgctgagggccgggtgtctgagtggctgcgctgtgacaacatgcaccaccagtggctgctgctggccgcctgcttctgggtgatcttcatgttcatggtggccagcaagttcatcaccctgaccttcaaggaccctgatgtgtacagcgccaagcaggagttcctgttcctgaccaccatgcctgaggtgaggaagctgcctgaggagaagcacatccctgaggagctgaagcccaccgggaaggagctgcctgacagccagctggtgcagcccctggtgtacatggagcggctggagctgatcagaaatgtgtgcagagatgatgccctgaagaacctgagccacacccctgtgtccaagtttgtgctggaccgcatctttgtgtgtgacaagcacaagatcctcttctgccagacccccaaggtgggcaacacccagtggaagaaggtgctgattgtgctgaatggagccttcagcagcattgaggagatcccagaaaatgtggtgcatgaccacgagaagaatggcctgccccggctgagcagcttcagtgatgctgagatccagaagaggctgaagacctacttcaagttcttcatcgtgcgggacccctttgagcggctcatcagcgccttcaaggacaagtttgtgcacaaccccaggtttgagccctggtacagacatgaaattgcccctggcatcatcaggaagtacagaagaaacagaacagagacccggggcatccagtttgaggactttgtgcgctacctgggggaccccaaccaccgctggctggacctgcagtttggagaccacatcatccactgggtgacctacgtggagctgtgtgccccctgtgagatcatgtacagcgtcatcggccaccacgagaccctggaggatgatgccccctacatcctgaaggaggccggcatcgaccacctggtgtcctaccccaccatccccccaggcatcaccgtgtacaacagaaccaaggtggagcactacttcctgggcatcagcaagagggacatccggcggctgtatgccaggtttgaaggagacttcaagctgtttggctaccagaagccagacttcctgctgaactag

SEQ ID NO: 146192 - DNA, 786 bp, Artificial Sequence
  Description of Artificial Sequence: Synthetic coding sequence
atggccagcccagactggggctatgatgacaagaatggacctgagcagtggagcaagctgtaccccatcgccaatggaaacaaccagagccctgtggacatcaagaccagcgagaccaagcatgacaccagcctgaagcccatctctgtgtcctacaacccagccacagccaaggagatcatcaacgtgggccacagcttccacgtgaactttgaggacaatgacaacagatctgtgctgaagggcggccccttcagtgacagctaccgcctcttccagttccacttccactggggcagcaccaatgagcacggcagcgagcacacagtggatggagtgaagtacagcgctgagctgcacgtggcccactggaacagcgccaagtacagcagcctggccgaggccgccagcaaggcagatggcctggccgtgattggagtgctgatgaaggtgggggaggccaaccccaagctgcagaaggtgctggatgccctgcaggccatcaagaccaagggcaagagggcccccttcaccaactttgaccccagcaccctgctgcccagcagcctggacttctggacctacccaggcagcctgacccacccccccctgtatgaatctgtgacctggatcatctgcaaggagagcatctctgtgtcctctgagcagctggcccagttccgcagcctgctgagcaatgtggagggggacaatgctgtgcccatgcagcacaacaaccggcccacccagcccctgaagggccgcacagtgcgggccagcttctag

SEQ ID NO: 146193 - DNA, 786 bp, Artificial Sequence; identical to SEQ ID NO: 146192
  Description of Artificial Sequence: Synthetic coding sequence

SEQ ID NO: 146194 - DNA, 786 bp, Artificial Sequence; identical to SEQ ID NO: 146192
  Description of Artificial Sequence: Synthetic coding sequence

SEQ ID NO: 146195 - DNA, 531 bp, Artificial Sequence
  Description of Artificial Sequence: Synthetic coding sequence
atggccagcccagactggggctatgatgacaagaatggacctgagcagtggagcaagctgtaccccatcgccaatggaaacaaccagagccctgtggacatcaagaccagcgagaccaagcatgacaccagcctgaagcccatctctgtgtcctacaacccagccacagccaaggagatcatcaacgtgggccacagcttccacgtgaactttgaggacaatgacaacagatctgtgctgaagggcggccccttcagtgacagctaccgcctcttccagttccacttccactggggcagcaccaatgagcacggcagcgagcacacagtggatggagtgaagtacagcgctgagctgcacgtggcccactggaacagcgccaagtacagcagcctggccgaggccgccagcaaggcagatggcctggccgtgattggagtgctgatgaaggtgggggaggccaaccccaagctgcagaaggtgctggatgccctgcaggccatcaagaccaagggcaagagggccccctag

SEQ ID NO: 146196 - DNA, 756 bp, Artificial Sequence
  Description of Artificial Sequence: Synthetic coding sequence
atggccagcccagactggggctatgatgacaagaatggacctgagcagtggagcaagctgtaccccatcgccaatggaaacaaccagagccctgtggacatcaagaccagcgagaccaagcatgacaccagcctgaagcccatctctgtgtcctacaacccagccacagccaaggagatcatcaacgtgggccacagcttccacgtgaactttgaggacaatgacaacagatctgtgctgaagggcggccccttcagtgacagctaccgcctcttccagttccacttccactggggcagcaccaatgagcacggcagcgagcacacagtggatggagtgaagtacagcgctgagctgcacgtggcccactggaacagcgccaagtacagcagcctggccgaggccgccagcaaggcagatggcctggccgtgattggagtgctgatgaaggtgggggaggccaaccccaagctgcagaaggtgctggatgccctgcaggccatcaagaccaagggcaagagggcccccttcaccaactttgaccccagcaccctgctgcccagcagcctggacttctggacctacccaggcagcctgacccacccccccctgtatgaatctgtgacctggatcatctgcaaggagagcatctctgtgtcctctgagcagctggcccagttccgcagcctgctgagcaatgtggagggggacaatgctgtgcccatgcagcacaacaaccggcccacccagccctag

SEQ ID NO: 146197 - DNA, 69 bp, Artificial Sequence
  Description of Artificial Sequence: Synthetic coding sequence
atggccagcccagactggggctatgatgacaagaatggacctgagcagtggagcaagctgtacccctag

SEQ ID NO: 146198 - DNA, 450 bp, Artificial Sequence
  Description of Artificial Sequence: Synthetic coding sequence
atggccagcccagactggggctatgatgacaagaatggacctgagcagtggagcaagctgtaccccatcgccaatggaaacaaccagagccctgtggacatcaagaccagcgagaccaagcatgacaccagcctgaagcccatctctgtgtcctacaacccagccacagccaaggagatcatcaacgtgggccacagcttccacgtgaactttgaggacaatgacaacagatctgtgctgaagggcggccccttcagtgacagctaccgcctcttccagttccacttccactggggcagcaccaatgagcacggcagcgagcacacagtggatggagtgaagtacagcgctgagctgcacgtggcccactggaacagcgccaagtacagcagcctggccgaggccgccagcaaggcagatggcctggccgtgattggagtgctgatgtag

SEQ ID NO: 146199 - DNA, 450 bp, Artificial Sequence; identical to SEQ ID NO: 146198
  Description of Artificial Sequence: Synthetic coding sequence

SEQ ID NO: 146200 - DNA, 357 bp, Artificial Sequence
  Description of Artificial Sequence: Synthetic coding sequence
atggccagcccagactggggctatgatgacaagaatggacctgagcagtggagcaagctgtaccccatcgccaatggaaacaaccagagccctgtggacatcaagaccagcgagaccaagcatgacaccagcctgaagcccatctctgtgtcctacaacccagccacagccaaggagatcatcaacgtgggccacagcttccacgtgaactttgaggacaatgacaacagatctgtgctgaagggcggccccttcagtgacagctaccgcctcttccagttccacttccactggggcagcaccaatgagcacggcagcgagcacacagtggatggagtgaagtacagcgctgagtag

SEQ ID NO: 146201 - DNA, 447 bp, Artificial Sequence
  Description of Artificial Sequence: Synthetic coding sequence
atggccagcccagactggggctatgatgacaagaatggacctgagcagtggagcaagctgtaccccatcgccaatggaaacaaccagagccctgtggacatcaagaccagcgagaccaagcatgacaccagcctgaagcccatctctgtgtcctacaacccagccacagccaaggagatcatcaacgtgggccacagcttccacgtgaactttgaggacaatgacaacagatctgtgctgaagggcggccccttcagtgacagctaccgcctcttccagttccacttccactggggcagcaccaatgagcacggcagcgagcacacagtggatggagtgaagtacagcgctgagctgcacgtggcccactggaacagcgccaagtacagcagcctggccgaggccgccagcaaggcagatggcctggccgtgattggagtgctgtag

SEQ ID NO: 146202 - DNA, 786 bp, Artificial Sequence; identical to SEQ ID NO: 146192
  Description of Artificial Sequence: Synthetic coding sequence

SEQ ID NO: 146203 - DNA, 300 bp, Artificial Sequence
  Description of Artificial Sequence: Synthetic coding sequence
atggccagcccagactggggctatgatgacaagaatggacctgagcagtggagcaagctgtaccccatcgccaatggaaacaaccagagccctgtggacatcaagaccagcgagaccaagcatgacaccagcctgaagcccatctctgtgtcctacaacccagccacagccaaggagatcatcaacgtgggccacagcttccacgtgaactttgaggacaatgacaacagatctgtgctgaagggcggccccttcagtgacagctaccgcctcttccagttccacttccactggggctag

SEQ ID NO: 146204 - DNA, 786 bp, Artificial Sequence; identical to SEQ ID NO: 146192
  Description of Artificial Sequence: Synthetic coding sequence

SEQ ID NO: 146205 - DNA, 786 bp, Artificial Sequence; identical to SEQ ID NO: 146192
  Description of Artificial Sequence: Synthetic coding sequence

SEQ ID NO: 146206 - DNA, 783 bp, Artificial Sequence
  Description of Artificial Sequence: Synthetic coding sequence
atgagccaccactggggctacggcaagcacaatggacctgagcactggcacaaggacttccccatcgccaagggggagcggcagagccctgtggacatcgacacccacacagccaagtatgaccccagcctgaagcccctgtctgtgtcctatgaccaggccaccagcctgcgcatcctgaacaacggccacgccttcaacgtggagtttgatgacagccaggacaaggctgtgctgaagggcggccccctggatggcacctaccgcctcatccagttccacttccactggggcagcctggatggccagggcagcgagcacacagtggacaagaagaagtatgctgctgagctgcacctggtgcactggaacaccaagtatggagactttgggaaggctgtgcagcagccagatggcctggccgtgctgggcatcttcctgaaggtgggcagcgccaagccaggcctgcagaaggtggtggatgtgctggacagcatcaagaccaagggcaagtctgctgacttcaccaactttgacccccggggcctgctgcctgagagcctggactactggacctacccaggcagcctgaccaccccacccctgctggagtgtgtgacctggatcgtgctgaaggagcccatctctgtgtcctctgagcaggtgctgaagttcaggaagctgaacttcaatggagagggggagcctgaggagctgatggtggacaactggaggcctgcccagcccctgaagaaccggcagatcaaggccagcttcaagtag

SEQ ID NO: 146207 - DNA, 783 bp, Artificial Sequence
  Description of Artificial Sequence: Synthetic coding sequence
atggccaaggagtggggctacgccagccacaatggaccagaccactggcatgagctgttccccaatgccaagggggagaaccagagccctgtggagctgcacaccaaggacatcagacatgaccccagcctgcagccctggagcgtgtcctatgatggcggcagcgccaagaccatcctgaacaacgggaagacctgccgggtggtgtttgatgacacctatgaccgctccatgctgcggggcggccccctgcccggcccctaccgcctgcggcagttccacctgcactggggcagcagtgatgaccacggcagcgagcacacagtggatggagtgaagtatgctgctgagctgcacctggtgcactggaaccccaagtacaacaccttcaaggaggccctgaagcagagagatggcattgctgtgattggcatcttcctgaagattggacatgaaaatggagagttccagatcttcctggatgccctggacaagatcaagaccaagggcaaggaggcccccttcaccaagtttgaccccagctgcctcttccctgcctgccgggactactggacctaccagggcagcttcaccaccccaccctgtgaggagtgcatcgtgtggctgctgctgaaggagcccatgacagtgtccagtgaccagatggccaagctgcggagcctgctgagcagcgcagaaaatgagccccctgtgcccctggtgagcaactggaggcctccccagcccatcaacaacagagtggtgcgggccagcttcaagtag

SEQ ID NO: 146208 - DNA, 735 bp, Artificial Sequence
  Description of Artificial Sequence: Synthetic coding sequence
atggccaaggagtggggctacgccagccacaatggaccagaccactggcatgagctgttccccaatgccaagggggagaaccagagcccctggagcgtgtcctatgatggcggcagcgccaagaccatcctgaacaacgggaagacctgccgggtggtgtttgatgacacctatgaccgctccatgctgcggggcggccccctgcccggcccctaccgcctgcggcagttccacctgcactggggcagcagtgatgaccacggcagcgagcacacagtggatggagtgaagtatgctgctgagctgcacctggtgcactggaaccccaagtacaacaccttcaaggaggccctgaagcagagagatggcattgctgtgattggcatcttcctgaagattggacatgaaaatggagagttccagatcttcctggatgccctggacaagatcaagaccaagggcaaggaggcccccttcaccaagtttgaccccagctgcctcttccctgcctgccgggactactggacctaccagggcagcttcaccaccccaccctgtgaggagtgcatcgtgtggctgctgctgaaggagcccatgacagtgtccagtgaccagatggccaagctgcggagcctgctgagcagcgcagaaaatgagccccctgtgcccctggtgagcaactggaggcctccccagcccatcaacaacagagtggtgcgggccagcttcaagtag

SEQ ID NO: 146209 - DNA, 954 bp, Artificial Sequence
  Description of Artificial Sequence: Synthetic coding sequence
atggtggtgatgaacagcctgcgggtcatcctgcaggccagccctgggaagctgctgtggaggaagttccagatcccccgcttcatgcctgcccggccctgcagcctgtacacctgcacctacaagaccaggaacagagccctgcaccccctgtgggagagcgtggacctggtgcctggaggagaccggcagagccccatcaacatccgctggagggacagcgtgtatgaccccggcctgaagcccctgaccatctcctatgaccctgccacctgcctgcacgtgtggaacaacggctacagcttcctggtggagtttgaggacagcacagacaagagcgtcatcaagggcggccccctggagcacaactaccgcctgaagcagttccacttccactggggcgccattgatgcctggggcagcgagcacacagtggacagcaagtgcttccctgctgagctgcacctggtgcactggaatgctgtgcgctttgaaaattttgaagatgctgccctggaggagaatggcctggccgtcatcggggtcttcctgaagctgggcaagcaccacaaggagctgcagaagctggtggacaccctgcccagcatcaagcacaaggatgccctggtggagtttggcagctttgaccccagctgcctgatgcccacctgcccagactactggacctacagcggcagcctgaccaccccacccctgtctgagagcgtgacctggatcatcaagaagcagcctgtggaggtggaccatgaccagctggagcagttccgcaccctgctcttcaccagcgagggggagaaggagaagaggatggtggacaacttccggcccctgcagcccctgatgaacagaacagtgcgcagcagcttcagacatgactatgtgctgaatgtgcaggccaagcccaagccagccaccagccaggccaccccctag

SEQ ID NO: 146210 - DNA, 954 bp, Artificial Sequence; identical to SEQ ID NO: 146209
  Description of Artificial Sequence: Synthetic coding sequence

SEQ ID NO: 146211 - DNA, 411 bp, Artificial Sequence
  Description of Artificial Sequence: Synthetic coding sequence
atggtggtgatgaacagcctgcgggtcatcctgcaggccagccctgggaagctgctgtggaggaagttccagatcccccgcttcatgcctgcccggccctgcagcctgtacacctgcacctacaagaccaggaacagagccctgcaccccctgtgggagagcgtggacctggtgcctggaggagaccggcagagccccatcaacatccgctggagggacagcgtgtatgaccccggcctgaagcccctgaccatctcctatgaccctgccacctgcctgcacgtgtggaacaacggctacagcttcctggtggagtttgaggacagcacagacaagagcgtcatcaagggcggccccctggagcacaactaccgcctgaagcagttccacttccactggggcgccatctag

SEQ ID NO: 146212 - DNA, 231 bp, Artificial Sequence
  Description of Artificial Sequence: Synthetic coding sequence
atggtggtgatgaacagcctgcgggtcatcctgcaggccagccctgggaagctgctgtggaggaagttccagatcccccgcttcatgcctgcccggccctgcagcctgtacacctgcacctacaagaccaggaacagagccctgcaccccctgtgggagagcgtggacctggtgcctggaggagaccggcagagccccatcaacatccgctggagggacagcgtgtactag

SEQ ID NO: 146213 - DNA, 540 bp, Artificial Sequence
  Description of Artificial Sequence: Synthetic coding sequence
atgagggccctggtgctgctgctgagcctcttcctgctgggcggccaggcccagcacgtgtctgactggacctacagcgagggcgccctggatgaggcccactggccccagcactacccagcctgtggcggccagaggcagagccccatcaacctgcagaggaccaaggtgcgctacaaccccagcctgaagggcctgaacatgacaggctatgagacccaggccggggagttccccatggtgaacaacggccacacagactggcaggccgagctgttcctgcccagcctgagcagcccctgtggggagggcgccaagcacaagggccagaggcagtggctgtgcagccccagcctggacagctggtgggaggccatcattgatggcggcagcctgtgggccaccctggccgagtgtggcctgcgggcagagggccctgaggagggccgccacatggaggagaagagccctgccagccagggcgcctgcagcggcagccggctgcccatcagccggggcccctgcaccttcttcctgtag

SEQ ID NO: 146214 - DNA, 942 bp, Artificial Sequence
  Description of Artificial Sequence: Synthetic coding sequence
atgagggccctggtgctgctgctgagcctcttcctgctgggcggccaggcccagcacgtgtctgactggacctacagcgagggcgccctggatgaggcccactggccccagcactacccagcctgtggcggccagaggcagagccccatcaacctgcagaggaccaaggtgcgctacaaccccagcctgaagggcctgaacatgacaggctatgagacccaggccggggagttccccatggtgaacaacggccacacagtgcagatcagcctgcccagcaccatgaggatgacagtggctgatggcaccgtgtacatcgcccagcagatgcacttccactggggcggggccagcagcgagatcagcggcagcgagcacacagtggatggcatcagacatgtgattgagatccacatcgtgcactacaacagcaagtacaagagctatgacatcgcccaggatgccccagatggcctggccgtgctggccgcctttgtggaggtgaagaactacccagagaacacctactacagcaacttcatcagccacctggccaacatcaagtacccaggccagaggaccaccctgaccggcctggatgtgcaggacatgctgcccaggaacctgcagcactactacacctaccacggcagcctgaccaccccaccctgcacagaaaatgtgcactggtttgtgctggccgactttgtgaagctgagcaggacccaggtgtggaagctggagaacagcctgctggaccacaggaacaagaccatccacaatgactacagaaggacccagcccctgaaccaccgggtggtggagagcaacttccccaaccagggcaaaggacatggaggccaccggggccgcagccagaacccccgggtgcagcccaccagcaccaggcaccccctggccctgggcagcctggaggcctag

SEQ ID NO: 146215 - DNA, 927 bp, Artificial Sequence
  Description of Artificial Sequence: Synthetic coding sequence
atgagggccctggtgctgctgctgagcctcttcctgctgggcggccaggcccagcacgtgtctgactggacctacagcgagggcgccctggatgaggcccactggccccagcactacccagcctgtggcggccagaggcagagccccatcaacctgcagaggaccaaggtgcgctacaaccccagcctgaagggcctgaacatgacaggctatgagacccaggccggggagttccccatggtgaacaacggccacacagtgcagatcagcctgcccagcaccatgaggatgacagtggctgatggcaccgtgtacatcgcccagcagatgcacttccactggggcggggccagcagcgagatcagcggcagcgagcacacagtggatggcatcagacatgtgattgagatccacatcgtgcactacaacagcaagtacaagagctatgacatcgcccaggatgccccagatggcctggccgtgctggccgcctttgtggaggtgaagaactacccagagaacacctactacagcaacttcatcagccacctggccaacatcaagtacccaggccagaggaccaccctgaccggcctggatgtgcaggacatgctgcccaggaacctgcagcactactacacctaccacggcagcctgaccaccccaccctgcacagaaaatgtgcactggtttgtgctggccgactttgtgaagctgagcaggacccaggtgtggaagctggagaacagcctgctggaccacaggaacaagaccatccacaatgactacagaaggacccagcccctgaaccaccgggtggtggagagcaacttccccaaccaggagtacaccctgggcagcgagttccagttctacctgcacaagattgaggagatcctggactacctgcggcgggccctgaactag

SEQ ID NO: 146216 - DNA, 795 bp, Artificial Sequence
  Description of Artificial Sequence: Synthetic coding sequence
atgacaggccaccacggctggggctacggccaggatgatggccccagccactggcacaagctgtaccccatcgcccagggcgaccggcagagccccatcaacatcatcagcagccaggccgtgtacagccccagcctgcagcccctggagctgtcctatgaggcctgcatgagcctgagcatcaccaacaacggccacagcgtgcaggtggacttcaatgacagtgatgacagaacagtggtgactggaggccccctggagggcccctaccgcctgaagcagttccacttccactggggcaagaagcatgatgtgggcagcgagcacacagtggatggcaagagcttccccagcgagctgcacctggtgcactggaatgccaagaagtacagcacctttggagaggccgccagcgccccagatggcctggccgtggtgggcgtcttcctggagactggagatgagcaccccagcatgaaccggctgacagatgccctgtacatggtgcgcttcaagggcaccaaggcccagttcagctgcttcaaccccaagtgcctgctgcctgccagccgccactactggacctacccaggcagcctgaccaccccacccctgtctgagagcgtgacctggatcgtgctgcgggagcccatctgcatcagcgagcggcagatgggcaagttccgcagcctgctcttcaccagtgaagatgatgagcgcatccacatggtgaacaacttccggcccccccagcccctgaagggccgggtggtgaaggccagcttccgggcctag

SEQ ID NO: 146217 - DNA, 627 bp, Artificial Sequence
  Description of Artificial Sequence: Synthetic coding sequence
atgagcctgagcatcaccaacaacggccacagcgtgcaggtggacttcaatgacagtgatgacagaacagtggtgactggaggccccctggagggcccctaccgcctgaagcagttccacttccactggggcaagaagcatgatgtgggcagcgagcacacagtggatggcaagagcttccccagcgagctgcacctggtgcactggaatgccaagaagtacagcacctttggagaggccgccagcgccccagatggcctggccgtggtgggcgtcttcctggagactggagatgagcaccccagcatgaaccggctgacagatgccctgtacatggtgcgcttcaagggcaccaaggcccagttcagctgcttcaaccccaagtgcctgctgcctgccagccgccactactggacctacccaggcagcctgaccaccccacccctgtctgagagcgtgacctggatcgtgctgcgggagcccatctgcatcagcgagcggcagatgggcaagttccgcagcctgctcttcaccagtgaagatgatgagcgcatccacatggtgaacaacttccggcccccccagcccctgaagggccgggtggtgaaggccagcttccgggcctag

SEQ ID NO: 146218 - DNA, 873 bp, Artificial Sequence
  Description of Artificial Sequence: Synthetic coding sequence
atggctgacctgtccttcatcgaggacacagtggccttccctgagaaggaggaggatgaggaggaggaggaggagggcgtggagtggggctatgaggagggcgtggagtggggcctggtgtttcctgatgccaatggagagtaccagagccccatcaacctgaacagccgggaggcccgctatgaccccagcctgctggatgtgcggctgagccccaactacgtggtgtgccgggactgtgaggtgaccaatgatggccacaccatccaggtgatcctgaagagcaagtctgtgctgagcggcggccccctgccccagggccacgagtttgagctgtatgaggtgcgcttccactggggccgggagaaccagaggggcagcgagcacacagtgaacttcaaggccttccccatggagctgcacctgatccactggaacagcaccctgtttggcagcattgatgaggccgtgggcaagccccatggaattgccatcatcgccctgtttgtgcagatcggcaaggagcacgtgggcctgaaggctgtgacagagatcctgcaggacatccagtacaagggcaagagcaagaccatcccctgcttcaaccccaacaccctgctgcctgaccccctgctgcgggactactgggtgtatgagggcagcctgaccatccccccctgcagcgagggcgtgacctggatcctcttccgctaccccctgaccatcagccagctgcagatcgaggagttccggcggctgcggacccacgtgaagggagctgagctggtggagggctgtgatggcatcctgggggacaacttccggcccacccagcccctgagtgacagagtcatccgggccgccttccagtag

SEQ ID NO: 146219 - DNA, 987 bp, Artificial Sequence
  Description of Artificial Sequence: Synthetic coding sequence
atggagatcgtgtgggaggtgctcttcctgctgcaggccaacttcatcgtgtgcatcagcgcccagcagaacagccccaagatccacgagggctggtgggcctacaaggaggtggtgcagggcagctttgtgcctgtgcccagcttctggggcctggtgaacagcgcctggaacctgtgcagcgtgggcaagaggcagagccctgtgaacatcgagaccagccacatgatctttgaccccttcctgacccccctgcgcatcaacacaggaggcaggaaggtgtctggcaccatgtacaacacaggccgccacgtgtccctgcggctggacaaggagcacctggtgaacatcagcggcggccccatgacctacagccaccggctggaggagatccggctgcactttggaagtgaggacagccagggcagcgagcacctgctgaatggccaggccttctctggagaggtgcagctgatccactacaaccacgagctgtacaccaacgtgacagaggccgccaagagccccaacggcctggtggtggtgtccatcttcatcaaggtgtctgacagcagcaaccccttcctgaacaggatgctgaacagagacaccatcacccgcatcacctacaagaatgatgcctacctgctgcagggcctgaacatcgaggagctgtacccagagaccagcagcttcatcacctatgatggctccatgaccatccccccctgctatgaaacagcctcctggatcatcatgaacaagcctgtgtacatcaccaggatgcagatgcacagcctgcggctgctgagccagaaccagcccagccagatcttcctgtccatgtctgacaacttccggcctgtgcagcccctgaacaaccgctgcatccgcaccaacatcaacttcagcctgcagggcaaggactgccccaacaacagagcccagaagctgcagtacagagtgaatgagtggctgctgaagtag

SEQ ID NO: 146220 - DNA, 1005 bp, Artificial Sequence
  Description of Artificial Sequence: Synthetic coding sequence
atggccagcatccgcagccgcagcggctgcggcttcacagagccagatgagctgtgcatggtgggcgtgagagaaaatgcccagcagaacagccccaagatccacgagggctggtgggcctacaaggaggtggtgcagggcagctttgtgcctgtgcccagcttctggggcctggtgaacagcgcctggaacctgtgcagcgtgggcaagaggcagagccctgtgaacatcgagaccagccacatgatctttgaccccttcctgacccccctgcgcatcaacacaggaggcaggaaggtgtctggcaccatgtacaacacaggccgccacgtgtccctgcggctggacaaggagcacctggtgaacatcagcggcggccccatgacctacagccaccggctggaggagatccggctgcactttggaagtgaggacagccagggcagcgagcacctgctgaatggccaggccttctctggagaggtgcagctgatccactacaaccacgagctgtacaccaacgtgacagaggccgccaagagccccaacggcctggtggtggtgtccatcttcatcaaggtgtctgacagcagcaaccccttcctgaacaggatgctgaacagagacaccatcacccgcatcacctacaagaatgatgcctacctgctgcagggcctgaacatcgaggagctgtacccagagaccagcagcttcatcacctatgatggctccatgaccatccccccctgctatgaaacagcctcctggatcatcatgaacaagcctgtgtacatcaccaggatgcagatgcacagcctgcggctgctgagccagaaccagcccagccagatcttcctgtccatgtctgacaacttccggcctgtgcagcccctgaacaaccgctgcatccgcaccaacatcaacttcagcctgcagggcaaggactgccccaacaacagagcccagaagctgcagtacagagtgaatgagtggctgctgaagtag

SEQ ID NO: 146221 - DNA, 987 bp, Artificial Sequence; identical to SEQ ID NO: 146219
  Description of Artificial Sequence: Synthetic coding sequence

SEQ ID NO: 146222 - DNA, 987 bp, Artificial Sequence; identical to SEQ ID NO: 146219
  Description of Artificial Sequence: Synthetic coding sequence

SEQ ID NO: 146223 - DNA, 987 bp, Artificial Sequence
  Description of Artificial Sequence: Synthetic coding sequence
atgggcgccgccgcccggctgagcgccccccgggccctggtgctgtgggccgccctgggcgccgccgcccacatcggccctgccccagaccctgaggactggtggagctacaaggacaacctgcagggcaactttgtgcccggcccccccttctggggcctggtgaatgctgcctggagcctgtgtgctgtgggcaagaggcagagccctgtggatgtggagctgaagagggtgctgtatgaccccttcctgccccccctgcggctgagcactggaggagagaagctgcggggcaccctgtacaacacaggccgccacgtgtccttcctgcctgcccccaggcctgtggtgaatgtgtctgggggccccctgctgtacagccaccggctgtctgagctgcggctgctgtttggagccagagatggagctggcagcgagcaccagatcaaccaccagggcttctctgctgaggtgcagctgatccacttcaaccaggagctgtatggcaacttctctgctgccagccggggccccaacggcctggccatcctgagcctgtttgtgaatgtggccagcaccagcaaccccttcctgagccggctgctgaacagagacaccatcacccgcatctcctacaagaatgatgcctacttcctgcaggacctgagcctggagctgctcttccctgagagctttggcttcatcacctaccagggcagcctgagcaccccaccctgcagcgagaccgtgacctggatcctgattgaccgggccctgaacatcaccagcctgcagatgcacagcctgcggctgctgagccagaacccccccagccagatcttccagagcctgagcggcaacagccggcccctgcagcccctggcccaccgggccctgcggggcaacagagaccccaggcaccctgagcggcgctgccggggccccaactaccgcctgcacgtggatggagtgccccacggccgctag

SEQ ID NO: 146224 - DNA, 1065 bp, Artificial Sequence
  Description of Artificial Sequence: Synthetic coding sequence
atgcccaggaggagcctgcacgccgctgctgtgctgctgctggtgatcctgaaggagcagcccagcagccctgcccctgtgaatggcagcaagtggacctactttggaccagatggagagaacagctggagcaagaagtaccccagctgtggcggcctgctgcagagccccatcgacctgcacagcgacatcctgcagtatgatgccagcctgacccccctggagttccagggctacaacctgagcgccaacaagcagttcctgctgaccaacaacggccacagcgtgaagctgaacctgcccagcgacatgcacatccagggcctgcagagccgctacagcgccacccagctgcacctgcactggggcaaccccaatgacccccacggcagcgagcacacagtgtctggccagcactttgctgctgagctgcacatcgtgcactacaacagcgacctgtacccagatgccagcacagccagcaacaagtctgagggcctggccgtgctggccgtgctgattgagatgggcagcttcaaccccagctatgacaagatcttcagccacctgcagcacgtgaagtacaagggccaggaggcctttgtgcccggcttcaacatcgaggagctgctgcctgagaggacagctgagtactaccgctaccggggcagcctgaccaccccaccctgcaaccccaccgtgctgtggacagtgttcaggaaccctgtgcagatcagccaggagcagctgctggccctggagacagccctgtactgcacccacatggatgaccccagcccccgggagatgatcaacaacttccggcaggtgcagaagtttgatgagcggctggtgtacaccagcttcagccaggtgcaggtgtgcacagctgctggcctgagcctgggcatcatcctgagcctggccctggccggcatcctgggcatctgcatcgtggtggtggtgtccatctggctgttccggaggaagagcatcaagaagggggacaacaagggcgtcatctacaagccagccaccaagatggagacagaggcccacgcctag

SEQ ID NO: 146225 - DNA, 1032 bp, Artificial Sequence
  Description of Artificial Sequence: Synthetic coding sequence
atgcccaggaggagcctgcacgccgctgctgtgctgctgctggtgatcctgaaggagcagcccagcagccctgcccctgtgaatggcagcaagtggacctactttggaccagatggagagaacagctggagcaagaagtaccccagctgtggcggcctgctgcagagccccatcgacctgcacagcgacatcctgcagtatgatgccagcctgacccccctggagttccagggctacaacctgagcgccaacaagcagttcctgctgaccaacaacggccacagcgtgaagctgaacctgcccagcgacatgcacatccagggcctgcagagccgctacagcgccacccagctgcacctgcactggggcaaccccaatgacccccacggcagcgagcacacagtgtctggccagcactttgctgctgagctgcacatcgtgcactacaacagcgacctgtacccagatgccagcacagccagcaacaagtctgagggcctggccgtgctggccgtgctgattgagatgggcagcttcaaccccagctatgacaagatcttcagccacctgcagcacgtgaagtacaagggccaggaggcctttgtgcccggcttcaacatcgaggagctgctgcctgagaggacagctgagtactaccgctaccggggcagcctgaccaccccaccctgcaaccccaccgtgctgtggacagtgttcaggaaccctgtgcagatcagccaggagcagctgctggccctggagacagccctgtactgcacccacatggatgaccccagcccccgggagatgatcaacaacttccggcaggtgcagaagtttgatgagcggctggtgtacaccagcttcagccagggcatcatcctgagcctggccctggccggcatcctgggcatctgcatcgtggtggtggtgtccatctggctgttccggaggaagagcatcaagaagggggacaacaagggcgtcatctacaagccagccaccaagatggagacagaggcccacgcctag

SEQ ID NO: 146226 - DNA, 852 bp, Artificial Sequence
  Description of Artificial Sequence: Synthetic coding sequence
atgcccaggaggagcctgcacgccgctgctgtgctgctgctggtgatcctgaaggagcagcccagcagccctgcccctgtgaatggcagcaagtggacctactttgtgaagctgaacctgcccagcgacatgcacatccagggcctgcagagccgctacagcgccacccagctgcacctgcactggggcaaccccaatgacccccacggcagcgagcacacagtgtctggccagcactttgctgctgagctgcacatcgtgcactacaacagcgacctgtacccagatgccagcacagccagcaacaagtctgagggcctggccgtgctggccgtgctgattgagatgggcagcttcaaccccagctatgacaagatcttcagccacctgcagcacgtgaagtacaagggccaggaggcctttgtgcccggcttcaacatcgaggagctgctgcctgagaggacagctgagtactaccgctaccggggcagcctgaccaccccaccctgcaaccccaccgtgctgtggacagtgttcaggaaccctgtgcagatcagccaggagcagctgctggccctggagacagccctgtactgcacccacatggatgaccccagcccccgggagatgatcaacaacttccggcaggtgcagaagtttgatgagcggctggtgtacaccagcttcagccagggcatcatcctgagcctggccctggccggcatcctgggcatctgcatcgtggtggtggtgtccatctggctgttccggaggaagagcatcaagaagggggacaacaagggcgtcatctacaagccagccaccaagatggagacagaggcccacgcctag

SEQ ID NO: 146227 - DNA, 1014 bp, Artificial Sequence
  Description of Artificial Sequence: Synthetic coding sequence
atgctgttcagcgccctgctgctggaggtgatctggatcctggccgcagatggcggccagcactggacctatgagggcccccacggccaggaccactggccagccagctacccagaatgtggcaacaatgcccagagccccatcgacatccagacagacagcgtgacctttgatcctgacctgcctgccctgcagccccacggctatgaccagcccggcacagagcccctggacctgcacaacaacggccacacagtgcagctgagcctgcccagcaccctgtacctgggcggcctgcccaggaaatatgtggccgcccagctgcacctgcactggggccagaagggcagccctgggggcagcgagcaccagatcaacagcgaggccacctttgctgagctgcacatcgtgcactatgacagcgacagctatgacagcctgtctgaggccgctgagcggccccagggcctggccgtgctgggcatcctgattgaggtgggggagaccaagaacatcgcctatgagcacatcctgagccacctgcacgaggtgcgccacaaggaccagaagacctctgtgccccccttcaacctgcgggagctgctgcccaagcagctgggccagtacttccgctacaacggcagcctgaccaccccaccctgctaccagagcgtgctgtggacagtgttctaccgccgcagccagatctccatggagcagctggagaagctgcagggcaccctcttcagcacagaggaggagcccagcaagctgctggtgcagaactaccgggccctgcagcccctgaaccagaggatggtgtttgccagcttcatccaggccggcagcagctacaccactggagagatgctgagcctgggcgtgggcatcctggtgggctgcctgtgcctgctgctggccgtgtacttcatcgccaggaagatcaggaagaagaggctggagaacaggaagtctgtggtgttcaccagcgcccaggccaccacagaggcctag

SEQ ID NO: 146228 - DNA, 834 bp, Artificial Sequence
  Description of Artificial Sequence: Synthetic coding sequence
atgagcagcggcatccacgtggccctggtgactggaggcaacaagggcatcggcctggccatcgtgcgggacctgtgccgcctcttctctggagatgtggtgctgacagccagagatgtgacccggggccaggccgctgtgcagcagctgcaggccgagggcctgagcccccgcttccaccagctggacattgatgacctgcagagcatccgggccctgcgggacttcctgaggaaggagtatggaggcctggatgtgctggtgaacaatgccggcatcgccttcaaggtggccgaccccacccccttccacatccaggccgaggtgaccatgaagaccaacttcttcggcaccagagatgtgtgcacagagctgctgcccctcatcaagccccagggccgggtggtgaatgtgagcagcatcatgtctgtgcgggccctgaagagctgcagccctgagctgcagcagaagttccgctctgagaccatcacagaggaggagctggtgggcctgatgaacaagtttgtggaggacaccaagaagggcgtgcaccagaaggagggctggcccagcagcgcctacggcgtgaccaagattggagtgacagtgctgagccgcatccacgccaggaagctgtctgagcagaggaaaggagacaagatcctgctgaatgcctgctgccccggctgggtgaggacagacatggccggccccaaggccaccaagagccctgaggagggcgctgagacccctgtgtacctggccctgctgcccccagatgctgagggcccccacggccagtttgtgtctgagaagagggtggagcagtggtag

SEQ ID NO: 146229 - DNA, 834 bp, Artificial Sequence
  Description of Artificial Sequence: Synthetic coding sequence
atgagcagctgcagccgggtggccctggtgactggagccaacagaggaattggcctggccatcgcccgggagctgtgccggcagttctctggagatgtggtgctgacagccagagatgtggcccggggccaggccgctgtgcagcagctgcaggccgagggcctgagcccccgcttccaccagctggacattgatgacctgcagagcatccgggccctgcgggacttcctgaggaaggagtatggaggcctgaatgtgctggtgaacaatgctgctgtggccttcaagagtgatgaccccatgccctttgacatcaaggccgagatgaccctgaagaccaacttctttgccaccaggaacatgtgcaatgagctgctgcccatcatgaagccccacggccgggtggtgaacatcagcagcctgcagtgcctgcgggcctttgagaactgcagcgaggacctgcaggagcgcttccacagcgagaccctgacagaaggagacctggtggacctgatgaagaagtttgtggaggacaccaagaatgaggtgcatgagcgggagggctggcccaacagcccctacggcgtgtccaagctgggcgtgacagtgctgagccgcatcctggcccggcggctggatgagaagaggaaggctgaccgcatcctggtgaatgcctgctgccccggccctgtgaagacagacatggatggcaaggacagcatcagaacagtggaggagggcgctgagacccctgtgtacctggccctgctgcccccagatgccacagagccccagggccagctggtgcatgacaaggtggtgcagaactggtag

SEQ ID NO: 146230 - DNA, 2169 bp, Artificial Sequence
  Description of Artificial Sequence: Synthetic coding sequence
atgctgaccatgggccgcctgcagctggtggtgctgggcctgacctgctgctgggccgtggccagcgctgccaagctgggcgctgtgtacacagaaggaggctttgtggagggcgtgaacaagaagctgggcctgctgggggacagcgtggacatcttcaagggcatcccctttgctgcccccaccaaggccctggagaacccccagccccaccctggctggcagggcaccctgaaggccaagaacttcaagaagcgctgcctgcaggccaccatcacccaggacagcacctatggagatgaggactgcctgtacctgaacatctgggtgccccagggcaggaagcaggtgtcccgggacctgcctgtgatgatctggatctacggcggggccttcctgatgggcagcggccacggggccaacttcctgaacaactacctgtatgatggagaggagatcgccaccagaggaaatgtcatcgtggtgaccttcaactacagagtgggccccctgggcttcctgagcactggagatgccaacctgcccggcaactacggcctgcgggaccagcacatggccatcgcctgggtgaagagaaatattgctgccttcggcggggaccccaacaacatcaccctgtttggagagagcgctgggggcgcctctgtgtccctgcagaccctgagcccctacaacaagggcctcatcagaagagccatcagccagagcggcgtggccctgagcccctgggtgatccagaagaaccccctcttctgggccaagaaggtggccgagaaggtgggctgccctgtgggagatgctgccaggatggcccagtgcctgaaggtgacagacccccgggccctgaccctggcctacaaggtgcccctggccggcctggagtaccccatgctgcactacgtgggctttgtgcctgtgattgatggagacttcatcccagctgaccccatcaacctgtatgccaatgctgctgacatcgactacatcgccggcaccaacaacatggatggccacatctttgccagcattgacatgcctgccatcaacaagggcaacaagaaggtgacagaggacttctacaagctggtgtctgagttcaccatcaccaagggcctgcggggggccaagaccacctttgatgtgtacacagagagctgggcccaggaccccagccaggagaacaagaagaagacagtggtggactttgaaacagatgtgctcttcctggtgcccacagaaattgccctggcccagcaccgggccaatgccaagagcgccaagacctacgcctacctgttcagccaccccagcaggatgcctgtgtaccccaagtgggtgggcgctgaccacgcagatgacatccagtatgtgtttgggaagccctttgccacccccaccggctaccggccccaggacagaacagtgtccaaggccatgattgcctactggaccaactttgccaagacaggagaccccaacatgggagacagcgctgtgcccacccactgggagccctacaccacagagaacagcggctacctggagatcaccaagaagatgggcagcagctccatgaagaggagcctgcggaccaacttcctgcgctactggaccctgacctacctggccctgcccaccgtgacagaccaggaggccacccctgtgcccccaactggagacagcgaggccacccctgtgccccccaccggggacagcgagacagcccctgtgcccccaactggagacagcggggcccctcctgtgccccccaccggggacagcggggcccctcctgtgcccccaactggagacagcggggcccctcctgtgccccccaccggggacagcggggcccctcctgtgcccccaactggagacagcggggcccctcctgtgcccccaactggagatgctggccccccacctgtgcccccaactggagacagcggggcccctcctgtgccccccaccggggacagcggggcccctcctgtgacccccactggagacagcgagacagcccctgtgccccccaccggggacagcggggcccctcctgtgcccccaactggagacagcgaggccgcccctgtgcccccaacagatgacagcaaggaggcccagatgcctgctgtgatccgcttctag

SEQ ID NO: 146231 - DNA, 2064 bp, Artificial Sequence
  Description of Artificial Sequence: Synthetic coding sequence
atgggccgcctgcagctggtggtgctgggcctgacctgctgctgggccgtggccagcgctgccaagctgggcgctgtgtacacagagggcggctttgtggagggcgtgaacaagaagctgggcctgctgggggacagcgtggacatcttcaagggcatcccctttgctgcccccaccaaggccctggagaacccccagccccaccctggctggcagggcaccctgaaggccaagaacttcaagaagcgctgcctgcaggccaccatcacccaggacagcacctatggagatgaggactgcctgtacctgaacatctgggtgccccagggcaggaagcaggtgtcccgggacctgcctgtgatgatctggatctatggaggagccttcctgatgggcagcggccatggagccaacttcctgaacaactacctgtatgatggagaggagatcgccaccagaggaaatgtgattgtggtgaccttcaactacagagtgggccccctgggcttcctgagcactggagatgccaacctgcccggcaactacggcctgcgggaccagcacatggccatcgcctgggtgaagaggaacattgctgcctttggaggagaccccaacaacatcaccctgtttggagagagcgctggaggagcctctgtgtccctgcagaccctgagcccctacaacaagggcctcatccggcgggccatcagccagagcggcgtggccctgagcccctgggtgatccagaagaaccccctcttctgggccaagaaggtggccgagaaggtgggctgccctgtgggagatgctgccaggatggcccagtgcctgaaggtgacagacccccgggccctgaccctggcctacaaggtgcccctggccggcctggagtaccccatgctgcactacgtgggctttgtgcctgtgattgatggagacttcatcccagctgaccccatcaacctgtatgccaatgctgctgacatcgactacatcgccggcaccaacaacatggatggccacatctttgccagcattgacatgcctgccatcaacaagggcaacaagaaggtgacagaggaggacttctacaagctggtgtctgagttcaccatcaccaagggcctgcggggggccaagaccacctttgatgtgtacacagagagctgggcccaggaccccagccaggagaacaagaagaagacagtggtggactttgaaacagatgtgctcttcctggtgcccacagaaattgccctggcccagcaccgggccaatgccaaggaccccaacatgggagacagcgctgtgcccacccactgggagccctacaccacagagaacagcggctacctggagatcaccaagaagatgggcagcagctccatgaagaggagcctgcggaccaacttcctgcgctactggaccctgacctacctggccctgcccaccgtgacagaccaggaggccacccctgtgcccccaactggagacagcgaggccacccctgtgccccccaccggggacagcgagacagcccctgtgcccccaactggagacagcggggcccctcctgtgccccccaccggggacagcggggcccctcctgtgcccccaactggagacagcggggcccctcctgtgccccccaccggggacagcggggcccctcctgtgcccccaactggagacagcggggcccctcctgtgccccccaccggggacagcggggcccctcctgtgcccccaactggagacagcggggcccctcctgtgccccccaccggggacagcggggcccctcctgtgcccccaactggagatgctggccccccacctgtgccccccaccggggacagcggggcccctcctgtgcccccaactggagacagcggggcccctcctgtgacccccaccggggacagcgagacagcccctgtgcccccaactggagacagcggggcccctcctgtgccccccaccggggacagcgaggccgcccctgtgcccccaacagatgacagcaaggaggcccagatgcctgctgtgatccgcttctag

SEQ ID NO: 146232 - DNA, 2271 bp, Artificial Sequence
  Description of Artificial Sequence: Synthetic coding sequence
atgctgaccatgggccgcctgcagctggtggtgctgggcctgacctgctgctgggccgtggccagcgctgccaagctgggcgctgtgtacacagaaggaggctttgtggagggcgtgaacaagaagctgggcctgctgggggacagcgtggacatcttcaagggcatcccctttgctgcccccaccaaggccctggagaacccccagccccaccctggctggcagggcaccctgaaggccaagaacttcaagaagcgctgcctgcaggccaccatcacccaggacagcacctatggagatgaggactgcctgtacctgaacatctgggtgccccagggcaggaagcaggtgtcccgggacctgcctgtgatgatctggatctacggcggggccttcctgatgggcagcggccacggggccaacttcctgaacaactacctgtatgatggagaggagatcgccaccagaggaaatgtcatcgtggtgaccttcaactacagagtgggccccctgggcttcctgagcactggagatgccaacctgcccggcaactacggcctgcgggaccagcacatggccatcgcctgggtgaagagaaatattgctgccttcggcggggaccccaacaacatcaccctgtttggagagagcgctgggggcgcctctgtgtccctgcagaccctgagcccctacaacaagggcctcatcagaagagccatcagccagagcggcgtggccctgagcccctgggtgatccagaagaaccccctcttctgggccaagaaggtggccgagaaggtgggctgccctgtgggagatgctgccaggatggcccagtgcctgaaggtgacagacccccgggccctgaccctggcctacaaggtgcccctggccggcctggagtaccccatgctgcactacgtgggctttgtgcctgtgattgatggagacttcatcccagctgaccccatcaacctgtatgccaatgctgctgacatcgactacatcgccggcaccaacaacatggatggccacatctttgccagcattgacatgcctgccatcaacaagggcaacaagaaggtgacagaggaggacttctacaagctggtgtctgagttcaccatcaccaagggcctgcggggggccaagaccacctttgatgtgtacacagagagctgggcccaggaccccagccaggagaacaagaagaagacagtggtggactttgaaacagatgtgctcttcctggtgcccacagagatcgccctggcccagcaccgggccaatgccaagagcgccaagacctacgcctacctgttcagccaccccagcaggatgcctgtgtaccccaagtgggtgggcgctgaccatgctgatgacatccagtatgtgtttgggaagccctttgccacccccaccggctaccggccccaggacagaacagtgtccaaggccatgattgcctactggaccaactttgccaagacaggagaccccaacatgggagacagcgctgtgcccacccactgggagccctacaccacagaaaattctggctacctggagatcaccaagaagatgggcagcagctccatgaagaggagcctgcggaccaacttcctgcgctactggaccctgacctacctggccctgcccaccgtgacagaccaggaggccacccctgtgccccccaccggggacagcgaggccacccctgtgcccccaactggagacagcgagacagcccctgtgccccccaccggggacagcggggcccctcctgtgcccccaactggagacagcggggcccctcctgtgccccccaccggggacagcggggcccctcctgtgcccccaactggagacagcggggcccctcctgtgccccccaccggggacagcggggcccctcctgtgcccccaactggagacagcggggcccctcctgtgccccccaccggggacagcggggcccctcctgtgcccccaactggagacagcggggcccctcctgtgcccccaactggagatgctggccccccacctgtgcccccaactggagacagcggggcccctcctgtgccccccaccggggacagcggggcccctcctgtgacccccactggagacagcgagacagcccctgtgccccccaccggggacagcggggcccctcctgtgcccccaactggagacagcgaggccgcccctgtgcccccaacagatgacagcaaggaggcccagatgcctgctgtgatccgcttctag

SEQ ID NO: 146233 - DNA, 1707 bp, Artificial Sequence
  Description of Artificial Sequence: Synthetic coding sequence
atgtggctgcgggccttcatcctggccaccctgagcgccagcgctgcctgggccggccaccccagcagcccccctgtggtggacacagtgcacggcaaggtgctgggcaagtttgtgtccctggagggctttgcccagcctgtggccatcttcctgggcatcccctttgccaagccacccctgggccccctgcgcttcaccccaccccagcctgctgagccctggagctttgtgaagaatgccaccagctacccacccatgtgcacccaggaccccaaggccggccagctgctgtctgagctgttcaccaacagaaaagaaaacatccccctgaagctgtctgaggactgcctgtacctgaacatctacaccccagctgacctgaccaagaagaaccggctgcctgtgatggtgtggattcatggaggcggcctgatggtgggcgccgccagcacctatgatggcctggccctggccgcccatgaaaatgtggtggtggtgaccatccagtaccgcctgggcatctggggcttcttcagcactggagatgagcacagccggggcaactggggccacctggaccaggtggccgccctgcgctgggtgcaggacaacatcgccagctttggaggcaaccctggctctgtgaccatctttggagagagcgctggaggagagagcgtgtctgtgctggtgctgagccccctggccaagaacctcttccaccgggccatcagcgagagcggcgtggccctgacctctgtgctggtgaagaagggagatgtgaagcccctggccgagcagatcgccatcacagctggctgcaagaccaccaccagcgctgtgatggtgcactgcctgcggcagaagacagaggaggagctgctggagaccaccctgaagatgaagttcctgagcctggacctgcagggcgacccccgggagagccagcccctgctgggcaccgtgattgatggcatgctgctgctgaagaccccagaggagctgcaggccgagaggaacttccacacagtgccctacatggtgggcatcaacaagcaggagtttggctggctgatccccatgcagctgatgagctaccccctgtctgagggccagctggaccagaagacagccatgagcctgctgtggaagagctaccccctggtgtgcatcgccaaggagctgatccctgaggccacagagaagtacctgggcggcacagatgacacagtgaagaagaaggacctcttcctggacctgattgctgatgtgatgtttggagtgcccagcgtgattgtggccaggaaccacagagatgctggggcccccacctacatgtatgagttccagtaccggcccagcttcagcagtgacatgaagcccaagacagtcatcggggaccatggagatgagctgttctctgtgtttggagcccccttcctgaaggagggcgccagcgaggaggagatccggctgagcaagatggtgatgaagttctgggccaactttgccagaaatggaaaccccaatggagagggcctgccccactggccagagtacaaccagaaggagggctacctgcagatcggggccaacacccaggccgcccagaagctgaaggacaaggaggtggccttctggaccaacctgtttgccaagaaggctgtggagaagccaccccagacagagcacatcgagctgtag

SEQ ID NO: 146234 - DNA, 1704 bp, Artificial Sequence
  Description of Artificial Sequence: Synthetic coding sequence
atgtggctgcgggccttcatcctggccaccctgagcgccagcgctgcctggggccaccccagcagcccccctgtggtggacacagtgcacggcaaggtgctgggcaagtttgtgtccctggagggctttgcccagcctgtggccatcttcctgggcatcccctttgccaagccacccctgggccccctgcgcttcaccccaccccagcctgctgagccctggagctttgtgaagaatgccaccagctacccacccatgtgcacccaggaccccaaggccggccagctgctgtctgagctgttcaccaacaggaaggagaacatccccctgaagctgtctgaggactgcctgtacctgaacatctacaccccagctgacctgaccaagaagaaccggctgcctgtgatggtgtggatccacggcggcggcctgatggtgggcgccgccagcacctatgatggcctggccctggccgcccatgaaaatgtggtggtggtgaccatccagtaccgcctgggcatctggggcttcttcagcactggagatgagcacagccggggcaactggggccacctggaccaggtggccgccctgcgctgggtgcaggacaacatcgccagctttggaggcaaccctggctctgtgaccatctttggagagagcgctggaggagagagcgtgtctgtgctggtgctgagccccctggccaagaacctcttccaccgggccatcagcgagagcggcgtggccctgacctctgtgctggtgaagaagggagatgtgaagcccctggccgagcagatcgccatcacagctggctgcaagaccaccaccagcgctgtgatggtgcactgcctgcggcagaagacagaggaggagctgctggagaccaccctgaagatgaagttcctgagcctggacctgcagggcgacccccgggagagccagcccctgctgggcaccgtgattgatggcatgctgctgctgaagaccccagaggagctgcaggccgagaggaacttccacacagtgccctacatggtgggcatcaacaagcaggagtttggctggctgatccccatgcagctgatgagctaccccctgtctgagggccagctggaccagaagacagccatgagcctgctgtggaagagctaccccctggtgtgcatcgccaaggagctgatccctgaggccacagagaagtacctgggcggcacagatgacacagtgaagaagaaggacctcttcctggacctgattgctgatgtgatgtttggagtgcccagcgtcatcgtggccaggaaccacagagatgctggggcccccacctacatgtatgagttccagtaccggcccagcttcagcagtgacatgaagcccaagacagtgattggagaccatggagatgagctgttctctgtgtttggagcccccttcctgaaggagggcgccagcgaggaggagatccggctgagcaagatggtgatgaagttctgggccaactttgccagaaatggaaaccccaacggggagggcctgccccactggccagagtacaaccagaaggagggctacctgcagattggagccaacacccaggccgcccagaagctgaaggacaaggaggtggccttctggaccaacctgtttgccaagaaggctgtggagaagccaccccagacagagcacatcgagctgtag

SEQ ID NO: 146235 - DNA, 1701 bp, Artificial Sequence
  Description of Artificial Sequence: Synthetic coding sequence
atgtggctgcgggccttcatcctggccaccctgagcgccagcgctgcctggggccaccccagcagcccccctgtggtggacacagtgcacggcaaggtgctgggcaagtttgtgtccctggagggctttgcccagcctgtggccatcttcctgggcatcccctttgccaagccacccctgggccccctgcgcttcaccccaccccagcctgctgagccctggagctttgtgaagaatgccaccagctacccacccatgtgcacccaggaccccaaggccggccagctgctgtctgagctgttcaccaacaggaaggagaacatccccctgaagctgtctgaggactgcctgtacctgaacatctacaccccagctgacctgaccaagaagaaccggctgcctgtgatggtgtggatccacggcggcggcctgatggtgggcgccgccagcacctatgatggcctggccctggccgcccatgaaaatgtggtggtggtgaccatccagtaccgcctgggcatctggggcttcttcagcactggagatgagcacagccggggcaactggggccacctggaccaggtggccgccctgcgctgggtgcaggacaacatcgccagctttggaggcaaccctggctctgtgaccatctttggagagagcgctggaggagagagcgtgtctgtgctggtgctgagccccctggccaagaacctcttccaccgggccatcagcgagagcggcgtggccctgacctctgtgctggtgaagaagggagatgtgaagcccctggccgagcagatcgccatcacagctggctgcaagaccaccaccagcgctgtgatggtgcactgcctgcggcagaagacagaggaggagctgctggagaccaccctgaagatgaagttcctgagcctggacctgcagggcgacccccgggagagccagcccctgctgggcaccgtgattgatggcatgctgctgctgaagaccccagaggagctgcaggccgagaggaacttccacacagtgccctacatggtgggcatcaacaagcaggagtttggctggctgatccccatgctgatgagctaccccctgtctgagggccagctggaccagaagacagccatgagcctgctgtggaagagctaccccctggtgtgcatcgccaaggagctgatccctgaggccacagagaagtacctgggcggcacagatgacacagtgaagaagaaggacctcttcctggacctgattgctgatgtgatgtttggagtgcccagcgtgattgtggccaggaaccacagagatgctggggcccccacctacatgtatgagttccagtaccggcccagcttcagcagtgacatgaagcccaagacagtcatcggggaccatggagatgagctgttctctgtgtttggagcccccttcctgaaggagggcgccagcgaggaggagatccggctgagcaagatggtgatgaagttctgggccaactttgccagaaatggaaaccccaatggagagggcctgccccactggccagagtacaaccagaaggagggctacctgcagatcggggccaacacccaggccgcccagaagctgaaggacaaggaggtggccttctggaccaacctgtttgccaagaaggctgtggagaagccaccccagacagagcacatcgagctgtag

SEQ ID NO: 146236 - DNA, 1299 bp, Artificial Sequence
  Description of Artificial Sequence: Synthetic coding sequence
atggtgtggattcatggaggcggcctgatggtgggcgccgccagcacctatgatggcctggccctggccgcccatgaaaatgtggtggtggtgaccatccagtaccgcctgggcatctggggcttcttcagcactggagatgagcacagccggggcaactggggccacctggaccaggtggccgccctgcgctgggtgcaggacaacatcgccagctttggaggcaaccctggctctgtgaccatctttggagagagcgctggaggagagagcgtgtctgtgctggtgctgagccccctggccaagaacctcttccaccgggccatcagcgagagcggcgtggccctgacctctgtgctggtgaagaagggagatgtgaagcccctggccgagcagatcgccatcacagctggctgcaagaccaccaccagcgctgtgatggtgcactgcctgcggcagaagacagaggaggagctgctggagaccaccctgaagatgaagttcctgagcctggacctgcagggcgacccccgggagagccagcccctgctgggcaccgtgattgatggcatgctgctgctgaagaccccagaggagctgcaggccgagaggaacttccacacagtgccctacatggtgggcatcaacaagcaggagtttggctggctgatccccatgcagctgatgagctaccccctgtctgagggccagctggaccagaagacagccatgagcctgctgtggaagagctaccccctggtgtgcatcgccaaggagctgatccctgaggccacagagaagtacctgggcggcacagatgacacagtgaagaagaaggacctcttcctggacctgattgctgatgtgatgtttggagtgcccagcgtgattgtggccaggaaccacagagatgctggggcccccacctacatgtatgagttccagtaccggcccagcttcagcagtgacatgaagcccaagacagtcatcggggaccatggagatgagctgttctctgtgtttggagcccccttcctgaaggagggcgccagcgaggaggagatccggctgagcaagatggtgatgaagttctgggccaactttgccagaaatggaaaccccaatggagagggcctgccccactggccagagtacaaccagaaggagggctacctgcagatcggggccaacacccaggccgcccagaagctgaaggacaaggaggtggccttctggaccaacctgtttgccaagaaggctgtggagaagccaccccagacagagcacatcgagctgtag

SEQ ID NO: 146237 - DNA, 1716 bp, Artificial Sequence
  Description of Artificial Sequence: Synthetic coding sequence
atggagagagctgtgcgggtggagagcggcgtgctggtgggcgtggtgtgcctgctgctggcctgcccagccacagccactggacctgaggtggcccagcctgaggtggacaccaccctgggccgggtgcggggccggcaggtgggcgtgaagggcacagaccggctggtgaatgtgttcctgggcatcccctttgcccagccccccctgggccctgaccgcttcagcgccccccacccagcccagccctgggagggcgtgagagatgccagcacagccccacccatgtgcctgcaggatgtggagagcatgaacagcagcagatttgtgctgaatggcaagcagcagatcttctctgtgtctgaggactgcctggtgctgaatgtgtacagccctgctgaggtgcctgctggcagcggccggcctgtgatggtgtgggtgcacggcggggccctgatcaccggggccgccaccagctatgatggcagcgccctggccgcctatggagatgtggtggtggtgacagtgcagtaccgcctgggcgtgctgggcttcttcagcactggagatgagcacgcccctggcaaccagggcttcctggatgtggtggccgccctgcgctgggtgcaggagaacatcgccccctttggaggagacctgaactgtgtgacagtgtttggaggcagcgctgggggcagcatcatcagcggcctggtgctgagccctgtggccgccggcctcttccaccgggccatcacccagagcggggtcatcaccaccccaggcatcatcgacagccacccctggcccctggcccagaagatcgccaacaccctggcctgcagcagcagcagccctgctgagatggtgcagtgcctgcagcagaaggagggggaggagctggtgctgagcaagaagctgaagaacaccatctaccccctgactgtggatggcaccgtcttccccaagagccccaaggagctgctgaaggagaagcccttccacagcgtgcccttcctgatgggcgtgaacaaccacgagttctcctggctgatcccccggggctggggcctgctggacaccatggagcagatgagccgggaggacatgctggccatcagcacccctgtgctgaccagcctggatgtgcccccagagatgatgcccaccgtgattgatgagtacctgggcagcaacagtgatgcccaggccaagtgccaggccttccaggagttcatgggagatgtgttcatcaacgtgcccaccgtgtccttcagccgctacctgcgggacagcggcagccctgtgttcttctatgagttccagcaccggcccagcagctttgccaagatcaagccagcctgggtgaaggctgaccacggggctgagggcgcctttgtgtttggaggccccttcctgatggatgagagcagccggctggccttccctgaggccacagaggaggagaagcagctgagcctgaccatgatggcccagtggacccactttgccaggactggagaccccaacagcaaggccctgcccccctggccccagttcaaccaggccgagcagtacctggagatcaaccctgtgcccagggctggccagaagttccgggaggcctggatgcagttctggagcgagaccctgcccagcaagatccagcagtggcaccagaagcagaagaacaggaaggcccaggaggacctgtag

SEQ ID NO: 146238 - DNA, 633 bp, Artificial Sequence
  Description of Artificial Sequence: Synthetic coding sequence
atggagcagatgagccgggaggacatgctggccatcagcacccctgtgctgaccagcctggatgtgcccccagagatgatgcccaccgtgattgatgagtacctgggcagcaacagtgatgcccaggccaagtgccaggccttccaggagttcatgggagatgtgttcatcaacgtgcccaccgtgtccttcagccgctacctgcgggacagcggcagccctgtgttcttctatgagttccagcaccggcccagcagctttgccaagatcaagccagcctgggtgaaggctgaccatggagctgagggcgcctttgtgtttggaggccccttcctgatggatgagagcagccggctggccttccctgaggccacagaggaggagaagcagctgagcctgaccatgatggcccagtggacccactttgccaggactggagaccccaacagcaaggccctgcccccctggccccagttcaaccaggccgagcagtacctggagatcaaccctgtgccccgggccggccagaagttccgggaggcctggatgcagttctggagcgagaccctgcccagcaagatccagcagtggcaccagaagcagaagaacaggaaggcccaggaggacctgtag

SEQ ID NO: 146239 - DNA, 1707 bp, Artificial Sequence
  Description of Artificial Sequence: Synthetic coding sequence
atggagagagctgtgcgggtggagagcggcgtgctggtgggcgtggtgtgcctgctgctggcctgcccagccacagccactggacctgaggtggcccagcctgaggtggacaccaccctgggccgggtgcggggccggcaggtgggcgtgaagggcacagaccggctggtgaatgtgttcctgggcatcccctttgcccagccccccctgggccctgaccgcttcagcgccccccacccagcccagccctgggagggcgtgagagatgccagcacagccccacccatgtgcctgcaggatgtggagagcatgaacagcagcagatttgtgctgaatggcaagcagcagatcttctctgtgtctgaggactgcctggtgctgaatgtgtacagccctgctgaggtgcctgctggcagcggccggcctgtgatggtgtgggtgcacggcggggccctgatcaccggggccgccaccagctatgatggcagcgccctggccgcctatggagatgtggtggtggtgacagtgcagtaccgcctgggcgtgctgggcttcttcagcactggagatgagcacgcccctggcaaccagggcttcctggatgtggtggccgccctgcgctgggtgcaggagaacatcgccccctttggaggagacctgaactgtgtgacagtgtttggaggcagcgctgggggcagcatcatcagcggcctggtgctgagccctgtggccgccggcctcttccaccgggccatcacccagagcggggtcatcaccaccccaggcatcatcgacagccacccctggcccctggcccagaagatcgccaacaccctggcctgcagcagcagcagccctgctgagatggtgcagtgcctgcagcagaaggagggggaggagctggtgctgagcaagaagctgaagaacaccatctaccccctgactgtggatggcaccgtcttccccaagagccccaaggagctgctgaaggagaagcccttccacagcgtgcccttcctgatgggcgtgaacaaccacgagttctcctggctgatcccccggggctggggcctgctggacaccatggagcagatgagccgggaggacatgctggccatcagcacccctgtgctgaccagcctggatgtgcccccagagatgatgcccaccgtgattgatgagtacctgggcagcaacagtgatgcccaggccaagtgccaggccttccaggagttcatgggagatgtgttcatcaacgtgcccaccgtgtccttcagccgctacctgcgggacagcggcagccctgtgttcttctatgagttccagcaccggcccagcagctttgccaagatcaagccagcctgggtgaaggctgaccacggggctgagggcgcctttgtgtttggaggccccttcctgatggatgagagcagccggctggaggccacagaggaggagaagcagctgagcctgaccatgatggcccagtggacccactttgccaggactggagaccccaacagcaaggccctgcccccctggccccagttcaaccaggccgagcagtacctggagatcaaccctgtgccccgggccggccagaagttccgggaggcctggatgcagttctggagcgagaccctgcccagcaagatccagcagtggcaccagaagcagaagaacaggaaggcccaggaggacctgtag

SEQ ID NO: 146240 - DNA, 738 bp, Artificial Sequence
  Description of Artificial Sequence: Synthetic coding sequence
atggccaatgaggcctacccctgcccctgtgacatcggccaccggctggagtatggaggcctgggccgggaggtgcaggtggagcacatcaaggcctacgtgaccaagagccctgtggatgctgggaaggccgtcatcgtcatccaggacatcttcggctggcagctgcccaacacccgctacatcgctgacatgatctctggaaatggctacaccaccatcgtgcctgacttctttgtgggccaggagccctgggaccccagcggggactggagcatcttccctgagtggctgaagaccagaaatgcccagaagattgaccgggagatcagcgccatcctgaagtacctgaagcagcagtgccacgcccagaagattggcatcgtgggcttctgctggggcggcacagctgtgcaccacctgatgatgaagtacagcgagttccgggccggcgtgtctgtgtatggaattgtgaaggacagcgaggacatctacaacctgaagaaccccaccctcttcatctttgctgaaaatgatgtggtgatccccctgaaggatgtgtccctgctgacccagaagctgaaggagcactgcaaggtggagtaccagatcaagaccttcagcggccagacccacggctttgtgcacaggaagcgggaggactgcagccctgctgacaagccctacattgatgaggcccggaggaacctgattgagtggctgaacaagtacatgtag

SEQ ID NO: 146241 - DNA, 1260 bp, Artificial Sequence
  Description of Artificial Sequence: Synthetic coding sequence
atgaggggcctgctggtgctgtctgtgctgctgggcgctgtgtttgggaaggaggactttgtgggccaccaggtgctgcgcatctctgtggctgatgaggcccaggtgcagaaggtgaaggagctggaggacctggagcacctgcagctggacttctggaggggccctgcccaccctggcagccccattgatgtgcgggtgcccttccccagcatccaggccgtgaagatcttcctggagagccacggcatctcctatgagaccatgattgaagatgtgcagagcctgctggatgaggagcaggagcagatgtttgccttccgcagccgggcccggagcacagacaccttcaactatgccacctaccacaccctggaggagatctatgacttcctggacctgctggtggccgagaacccccacctggtgtccaagatccagatcggcaacacctatgagggccggcccatctacgtgctgaagttcagcactggaggcagcaagaggcctgccatctggattgacaccggcatccacagccgggagtgggtgacccaggccagcggcgtgtggtttgccaagaagatcacccaggactatggccaggatgctgccttcaccgccatcctggacaccctggacatcttcctggagatcgtgaccaacccagatggctttgccttcacccacagcaccaacaggatgtggaggaagaccaggagccacacagctggcagcctgtgcattggagtggaccccaacagaaactgggatgctggcttcggcctgagcggggccagcagcaacccctgcagcgagacctaccacggcaagtttgccaacagcgaggtggaggtgaagagcatcgtggactttgtgaaggaccacggcaacatcaaggccttcatcagcatccacagctacagccagctgctgatgtacccctacggctacaagacagagcctgtgcctgaccaggatgagctggaccagctgagcaaggctgctgtgacagccctggccagcctgtatggcaccaagttcaactacggcagcatcatcaaggccatctaccaggccagcggcagcaccatcgactggacctacagccagggcatcaagtacagcttcacctttgagctgcgggacaccggccgctatggcttcctgctgcctgccagccagatcatccccacagccaaggagacctggctggccctgctgaccatcatggagcacaccctgaaccacccctactag

SEQ ID NO: 146242 - DNA, 1098 bp, Artificial Sequence
  Description of Artificial Sequence: Synthetic coding sequence
atggaccgggccgccctgctgggcctggcccggctgtgtgccctgtgggccgccctgctggtgctcttcccctatggagcccagggcaactggatgtggctgggcatcgccagctttggagtgcctgagaagctgggctgtgccaacctgcccctgaacagccggcagaaggagctgtgcaagaggaagccctacctgctgcccagcatccgggagggcgcccggctgggcatccaggagtgtggcagccagttcagacatgagcgctggaactgcatgatcacagctgctgccaccacagcccccatgggcgccagccccctgtttggctatgagctgagcagcggcaccaaggagacagccttcatctatgctgtgatggctgctggcctggtgcacagcgtgaccaggagctgcagcgctggcaacatgacagagtgcagctgtgacaccaccctgcagaatggaggcagcgccagcgagggctggcactggggcggctgcagtgatgatgtgcagtatggcatgtggttcagcaggaagttcctggacttccccatcggcaacaccaccgggaaggagaacaaggtgctgctggccatgaacctgcacaacaatgaggccggccggcaggccgtggccaagctgatgtctgtggactgccgctgccacggcgtgtctggcagctgtgctgtgaagacctgctggaagaccatgagcagctttgagaagattggccacctgctgaaggacaagtatgagaacagcatccagatcagtgacaagaccaagaggaagatgagaagaagagagaaggaccagaggaagatccccatccacaaggatgacctgctgtatgtgaacaagagccccaactactgtgtggaggacaagaagctgggcatccctggcacccagggccgggagtgcaacagaaccagcgagggcgcagatggctgcaacctgctgtgctgcggccggggctacaacacccacgtggtgcgccacgtggagcgctgtgagtgcaagttcatctggtgctgctacgtgcgctgcagaagatgtgagagcatgacagatgtgcacacctgcaagtag

SEQ ID NO: 146243 - DNA, 1254 bp, Artificial Sequence
  Description of Artificial Sequence: Synthetic coding sequence
atgaggctcatcctgcctgtgggcctcatcgccaccaccctggccatcgcccctgtgcgctttgaccgggagaaggtgttccgggtgaagccccaggatgagaagcaggccgacatcatcaaggacctggccaagaccaatgagctggacttctggtacccaggggccacccaccacgtggccgccaacatgatggtggacttccgggtgtctgagaaggagagccaggccatccagagcgccctggaccagaacaagatgcactatgagatcctgattcatgacctgcaggaggagattgagaagcagtttgatgtgaaggaggacatccctggccgccacagctatgccaagtacaacaactgggagaagatcgtggcctggacagagaagatgatggacaagtacccagagatggtgagccgcatcaagattggcagcacagtggaggacaaccccctgtatgtgctgaagattggagagaagaatgaaagaaggaaggccatcttcacagactgtggcatccacgcccgggagtgggtgtccccagccttctgccagtggtttgtgtaccaggccaccaagacctatggaagaaacaagatcatgaccaagctgctggacaggatgaacttctacatcctgcccgtcttcaacgtggatggctacatctggagctggaccaagaacaggatgtggaggaagaacagaagcaagaaccagaacagcaagtgcatcggcacagacctgaacagaaacttcaatgcctcctggaacagcatccccaacaccaatgacccctgtgccgacaactaccggggcagcgcccctgagagcgagaaggagaccaaggctgtgaccaacttcatccgcagccacctgaatgagatcaaggtgtacatcaccttccacagctacagccagatgctgctcttcccctacggctacaccagcaagctgccccccaaccacgaggacctggccaaggtggccaagattggaacagatgtgctgagcaccaggtatgagacccgctacatctacggccccatcgagagcaccatctaccccatcagcggcagcagcctggactgggcctatgacctgggcatcaagcacacctttgcctttgagctgcgggacaagggcaagtttggcttcctgctgcctgagagccgcatcaagcccacctgccgggagaccatgctggccgtgaagttcatcgccaagtacatcctgaagcacaccagctag

SEQ ID NO: 146244 - DNA, 1260 bp, Artificial Sequence
  Description of Artificial Sequence: Synthetic coding sequence
atggccatgaggctcatcctcttctttggagccctgtttggccacatctactgcctggagacctttgtgggggaccaggtgctggagatcgtgcccagcaatgaggagcagatcaagaacctgctgcagctggaggcccaggagcacctgcagctggacttctggaagagccccaccaccccaggagaaacagcccacgtgcgggtgccctttgtgaatgtgcaggccgtgaaggtgttcctggagagccagggcatcgcctacagcatcatgattgaagatgtgcaggtgctgctggacaaggaaaatgaggagatgctgttcaacagaagaagagagaggagcggcaacttcaactttggagcctaccacaccctggaggagatcagccaggagatggacaacctggtggccgagcaccctggcctggtgtccaaggtgaacatcggcagcagctttgagaaccggcccatgaatgtgctgaagttcagcactggaggagacaagccagccatctggctggatgctggcatccacgcccgggagtgggtgacccaggccacagccctgtggacagccaacaagatcgtgtctgactatggcaaggaccccagcatcaccagcatcctggatgccctggacatcttcctgctgcctgtgaccaacccagatggctacgtgttcagccagaccaagaacaggatgtggaggaagaccaggagcaaggtgtctggcagcctgtgtgtgggcgtggaccccaacagaaactgggatgctggctttggaggccctggggccagcagcaacccctgcagcgacagctaccacggccccagcgccaacagcgaggtggaggtgaagagcatcgtggacttcatcaagagccacggcaaggtgaaggccttcatcaccctgcacagctacagccagctgctgatgttcccctacggctacaagtgcaccaagctggatgactttgatgagctgtctgaggtggcccagaaggccgcccagagcctgcggagcctgcacggcaccaagtacaaggtgggccccatctgcagcgtcatctaccaggccagcggcggcagcattgactggagctatgactatggcatcaagtacagctttgcctttgagctgcgggacaccggccgctatggcttcctgctgcctgcccggcagatcctgcccacagctgaggagacctggctgggcctgaaggccatcatggagcacgtgcgggaccacccctactag

SEQ ID NO: 146245 - DNA, 1167 bp, Artificial Sequence
  Description of Artificial Sequence: Synthetic coding sequence
atgcgctggatcctcttcatcggggccctgattggcagcagcatctgtggccaggagaagttcttcggggaccaggtgctgcgcatcaacgtgagaaatggagatgagatcagcaagctgagccagctggtgaacagcaacaacctgaagctgaacttctggaagagccccagcagcttcaacagacctgtggatgtgctggtgcccagcgtgtccctgcaggccttcaagagcttcctgcggagccagggcctggagtatgctgtgaccatcgaggacctgcagatctaccacgagatggacaacattgctgctgacttcccagacctggcccggcgggtgaagattggccacagctttgaaaatcggcccatgtatgtgctgaagttcagcacaggcaagggcgtgagaagacctgctgtgtggctgaatgccggcatccacagccgggagtggatcagccaggccacagccatctggacagccaggaagatcgtgtctgactaccagagggaccctgccatcaccagcatcctggagaagatggacatcttcctgctgcctgtggccaacccagatggctacgtgtacacccagacccagaaccggctgtggaggaagaccaggagcagaaatcctggcagcagctgcatcggggctgaccccaacagaaactggaatgccagctttgctggaaaaggagccagtgacaacccctgcagcgaggtgtaccacggcccccacgccaacagcgaggtggaggtgaagtctgtggtggacttcatccagaagcacggcaacttcaagggcttcatcgacctgcacagctacagccagctgctgatgtacccctacggctacagcgtgaagaaggccccagatgctgaggagctggacaaggtggcccggctggccgccaaggccctggcctctgtgtctggaacagagtaccaggtgggccccacctgcaccaccgtgtacccagccagcggcagcagcattgactgggcctatgacaatggcatcaagtttgccttcacctttgagctgcgggacaccggcacctacggcttcctgctgcctgccaaccagatcatccccacagctgaggagacctggctgggcctgaagaccatcatggagcacgtgcgggacaacctgtactag

SEQ ID NO: 146246 - DNA, 681 bp, Artificial Sequence
  Description of Artificial Sequence: Synthetic coding sequence
atgaagatcgtgtctgactaccagagggaccctgccatcaccagcatcctggagaagatggacatcttcctgctgcctgtggccaacccagatggctacgtgtacacccagacccagaaccggctgtggaggaagaccaggagcagaaatcctggcagcagctgcatcggggctgaccccaacagaaactggaatgccagctttgctggaaaaggagccagtgacaacccctgcagcgaggtgtaccacggcccccacgccaacagcgaggtggaggtgaagtctgtggtggacttcatccagaagcacggcaacttcaagggcttcatcgacctgcacagctacagccagctgctgatgtacccctacggctacagcgtgaagaaggccccagatgctgaggagctggacaaggtggcccggctggccgccaaggccctggcctctgtgtctggaacagagtaccaggtgggccccacctgcaccaccgtgtacccagccagcggcagcagcattgactgggcctatgacaatggcatcaagtttgccttcacctttgagctgcgggacaccggcacctacggcttcctgctgcctgccaaccagatcatccccacagctgaggagacctggctgggcctgaagaccatcatggagcacgtgcgggacaacctgtactag

SEQ ID NO: 146247 - DNA, 582 bp, Artificial Sequence
  Description of Artificial Sequence: Synthetic coding sequence
atgcaccacctgaacaagacccacagcggcctcatccacatgttcagcatcggccgctcctatgagggccgcagcctcttcatcctgaagctgggcagaagaagccggctgaagagagctgtgtggattgactgtggcatccacgcccgggagtggattggccctgccttctgccagtggtttgtgaaggaggccctgctgacctacaagagtgaccctgccatgaggaagatgctgaaccacctgtacttctacatcatgcctgtgttcaacgtggatggctaccacttctcctggaccaatgaccgcttctggaggaagaccaggagcaggaacagccgcttccgctgccggggcgtggatgccaacagaaactggaaggtgaagtggtgtgatgtgagcagcggcagctccatggactgggcctacaagaatggcatcccctatgcctttgcctttgagctgcgggacaccggctacttcggcttcctgctgcctgagatgctgatcaagcccacctgcacagagaccatgctggccgtgaagaacatcaccatgcacctgctgaagaagtgcccctag

SEQ ID NO: 146248 - DNA, 1314 bp, Artificial Sequence
  Description of Artificial Sequence: Synthetic coding sequence
atgaagtgcctgggcaagagaagaggccaggccgccgccttcctgcccctgtgctggctgttcctgaagatcctgcagcccggccacagccacctgtacaacaacagatatgctggggacaaggtgatccgcttcatccccaagacagaggaggaggcctatgccctgaagaagatctcctaccagctgaaggtggacctgtggcagcccagcagcatctcctatgtgtctgagggcaccgtgacagatgtgcacatcccccagaatggcagccgggccctgctggccttcctgcaggaggccaacatccagtacaaggtgctgattgaggacctgcagaagaccctggagaagggcagcagcctgcacacccagaggaacagaagaagcctgagcggctacaactatgaggtgtaccacagcctggaggagatccagaactggatgcaccacctgaacaagacccacagcggcctcatccacatgttcagcatcggccgctcctatgagggccgcagcctcttcatcctgaagctgggcagaagaagccggctgaagagagctgtgtggattgactgtggcatccacgcccgggagtggattggccctgccttctgccagtggtttgtgaaggaggccctgctgacctacaagagtgaccctgccatgaggaagatgctgaaccacctgtacttctacatcatgcctgtgttcaacgtggatggctaccacttctcctggaccaatgaccgcttctggaggaagaccaggagcaggaacagccgcttccgctgccggggcgtggatgccaacagaaactggaaggtgaagtggtgtgatgagggcgcctccatgcacccctgtgatgacacctactgcggccccttccctgagagcgagcctgaggtgaaggctgtggccaacttcctgaggaagcacaggaagcacatccgggcctacctgtccttccacgcctatgcccagatgctgctgtacccctacagctacaagtatgccaccatccccaacttccgctgtgtggagagcgctgcctacaaggctgtgaatgccctgcagagcgtgtatggagtgcgctaccgctatggccctgccagcaccaccctgtatgtgagcagcggcagctccatggactgggcctacaagaatggcatcccctatgcctttgcctttgagctgcgggacaccggctacttcggcttcctgctgcctgagatgctgatcaagcccacctgcacagagaccatgctggccgtgaagaacatcaccatgcacctgctgaagaagtgcccctag

SEQ ID NO: 146249 - DNA, 948 bp, Artificial Sequence
  Description of Artificial Sequence: Synthetic coding sequence
atgaagtgcctgggcaagagaagaggccaggccgccgccttcctgcccctgtgctggctgttcctgaagatcctgcagcccggccacagccacctgtacaacaacagatatgctggggacaaggtgatccgcttcatccccaagacagaggaggaggcctatgccctgaagaagatctcctaccagctgaaggtggacctgtggcagcccagcagcatctcctatgtgtctgagggcaccgtgacagatgtgcacatcccccagaatggcagccgggccctgctggccttcctgcaggaggccaacatccagtacaaggtgctgattgaggacctgcagaagaccctggagaagggcagcagcctgcacacccagaggaacagaagaagcctgagcggctacaactatgaggtgtaccacagcctggaggagatccagaactggatgcaccacctgaacaagacccacagcggcctcatccacatgttcagcatcggccgctcctatgagggccgcagcctcttcatcctgaagctgggcagaagaagccggctgaagagagctgtgtggattgactgtggcatccacgcccgggagtggattggccctgccttctgccagtggtttgtgaaggaggccctgctgacctacaagagtgaccctgccatgaggaagatgctgaaccacctgtacttctacatcatgcctgtgttcaacgtggatggctaccacttctcctggaccaatgaccgcttctggaggaagaccaggagcaggaacagccgcttccgctgccggggcgtggatgccaacagaaactggaaggtgaagtggtgtgggaagtttggcaccaactgggaccctgaccccaaggtgtctgctggcttcaccctgcagaacatgagccctgaggacagccacggccgcctgatgttcttctgcatgtag

SEQ ID NO: 146250 - DNA, 1272 bp, Artificial Sequence
  Description of Artificial Sequence: Synthetic coding sequence
atgaagctgtgcagcctggccgtgctggtgcccatcgtgctcttctgtgagcagcacgtgtttgccttccagagcggccaggtgctggccgccctgcccaggaccagccggcaggtgcaggtgctgcagaacctgaccaccacctatgaaattgtgctgtggcagcctgtgacagctgacctgattgtgaagaagaagcaggtgcacttctttgtgaatgccagtgatgtggacaacgtgaaggcccacctgaatgtgtctggcatcccctgcagcgtgctgctggctgatgtggaggacctgatccagcagcagatcagcaatgacacagtgagcccccgggccagcgccagctactatgagcagtaccacagcctgaatgagatctacagctggattgagttcatcacagagcggcacccagacatgctgaccaagatccacatcggcagcagctttgagaagtaccccctgtatgtgctgaaggtgtctgggaaggagcaggccgccaagaatgccatctggattgactgtggcatccacgcccgggagtggatcagccctgccttctgcctgtggttcatcggccacatcacccagttctacggcatcatcggccagtacaccaacctgctgcggctggtggacttctacgtgatgcctgtggtgaatgtggatggctatgactacagctggaagaagaacaggatgtggaggaagaacagaagcttctacgccaacaaccactgcattggaacagacctgaacagaaactttgccagcaagcactggtgtgaggagggcgccagcagcagcagctgcagcgagacctactgcggcctgtacccagagagcgagcctgaggtgaaggctgtggccagcttcctgcggaggaacatcaaccagatcaaggcctacatctccatgcacagctacagccagcacatcgtgttcccctacagctacaccaggagcaagagcaaggaccacgaggagctgagcctggtggccagcgaggccgtgcgggccatcgagaagatcagcaagaacacccgctacacccacggccacggcagcgagaccctgtacctggcccctggaggaggagatgactggatctatgacctgggcatcaagtacagcttcaccatcgagctgcgggacaccggcacctacggcttcctgctgcctgagcgctacatcaagcccacctgccgggaggcctttgctgctgtgtccaagatcgcctggcacgtgatcagaaatgtgtag

SEQ ID NO: 146251 - DNA, 1083 bp, Artificial Sequence
  Description of Artificial Sequence: Synthetic coding sequence
atgaagctgtgcagcctggccgtgctggtgcccatcgtgctcttctgtgagcagcacgtgtttgccttccagagcggccaggtgctggccgccctgcccaggaccagccggcaggtgcaggtgctgcagaacctgaccaccacctatgaaattgtgctgtggcagcctgtgacagctgacctgattgtgaagaagaagcaggtgcacttctttgtgaatgccagtgatgtggacaacgtgaaggcccacctgaatgtgtctggcatcccctgcagcgtgctgctggctgatgtggaggacctgatccagcagcagatcagcaatgacacagtgagcccccgggccagcgccagctactatgagcagtaccacagcctgaatgagatctacagctggattgagttcatcacagagcggcacccagacatgctgaccaagatccacatcggcagcagctttgagaagtaccccctgtatgtgctgaaggtgtctgggaaggagcaggccgccaagaatgccatctggattgactgtggcatccacgcccgggagtggatcagccctgccttctgcctgtggttcatcggccacaacaggatgtggaggaagaacagaagcttctacgccaacaaccactgcatcggcacagacctgaacagaaactttgccagcaagcactggtgtgaggagggcgccagcagcagcagctgcagcgagacctactgcggcctgtacccagagagcgagcctgaggtgaaggctgtggccagcttcctgcggaggaacatcaaccagatcaaggcctacatctccatgcacagctacagccagcacatcgtgttcccctacagctacaccaggagcaagagcaaggaccacgaggagctgagcctggtggccagcgaggccgtgcgggccatcgagaagatcagcaagaacacccgctacacccacggccacggcagcgagaccctgtacctggcccctggaggaggagatgactggatctatgacctgggcatcaagtacagcgtgaccagcaacccccctgtggagaagctgctgcccctgagcctgaagtag

SEQ ID NO: 146252 - DNA, 849 bp, Artificial Sequence
  Description of Artificial Sequence: Synthetic coding sequence
atgctgcccctgctgcgctgtgtgccccgggtgctgggcagctctgtggccggcctgcgggccgccgccccagccagccccttccggcagctgctgcagcctgccccccggctgtgcacccggcccttcggcctgctgtctgtgcgggccggcagcgagcggcggcccggcctgctgcggccccggggcccctgtgcctgtggctgcggctgcggcagcctgcacacagatggagacaaggcctttgtggacttcctgagtgatgagatcaaggaggagaggaagatccagaagcacaagaccctgcccaagatgtctgggggctgggagctggagctgaatggaacagaggccaagctggtgaggaaggtggccggggagaagatcaccgtgaccttcaacatcaacaacagcatcccccccacctttgatggagaggaggagcccagccagggccagaaggtggaggagcaggagcctgagctgaccagcacccccaactttgtggtggaggtgatcaagaatgatgatggcaagaaggccctggtgctggactgccactacccagaagatgaggtgggccaggaggatgaagctgagagtgacatcttcagcatccgggaggtgtccttccagagcactggagagagcgagtggaaggacaccaactacaccctgaacacagacagcctggactgggccctgtatgaccacctgatggacttcctggccgacagaggagtggacaacacctttgctgatgagctggtggagctgagcacagccctggagcaccaggagtacatcaccttcctggaggacctgaagagctttgtgaagagccagtag

SEQ ID NO: 146253 - DNA, 3402 bp, Artificial Sequence
  Description of Artificial Sequence: Synthetic coding sequence
atgagatttgtgctgagcggcaacctgcacggcggctctgtggtggccagctacccctttgatgacagccctgagcacaaggccaccggcatctacagcaagaccagtgatgatgaggtgttcaagtacctggccaaggcctatgccagcaaccaccccatcatgaagacaggagagccccactgccctggagatgaagatgagaccttcaaggatggcatcaccaacggggcccactggtatgatgtggagggcggcatgcaggactacaactacgtgtgggccaactgctttgagatcaccctggagctgagctgctgcaagtaccccccagccagccagctgcggcaggagtgggagaacaaccgggagagcctcatcaccctcatcgagaaggtgcacatcggcgtgaagggctttgtgaaggacagcatcaccggcagcggcctggagaatgccaccatctctgtggccggcatcaaccacaacatcaccaccggccgctttggagacttctaccgcctgctggtgcccggcacctacaacctgactgtggtgctgaccggctacatgcccctgactgtgaccaacgtggtggtgaaggagggccctgccacagaggtggacttcagcctgcggcccaccgtgaccagcgtcatcccagacaccacagaggccgtgtccacagccagcacagtggccatccccaacatcctgagcggcaccagcagcagctaccagcccatccagcccaaggacttccaccaccaccacttcccagacatggagatcttcctgcggagatttgccaatgagtaccccaacatcacccggctgtacagcctgggcaagtctgtggagagccgggagctgtatgtgatggagatcagtgacaaccctggggtgcatgagcctggagagcctgagttcaagtacatcggcaacatgcatggaaatgaggtggtgggccgggagctgctgctgaacctgattgagtacctgtgcaagaactttggaacagatcctgaggtgacagacctggtgcacaacacccgcatccacctgatgcccagcatgaacccagatggctatgagaagagccaggagggggacagcatcagcgtcatcggcaggaacaacagcaacaactttgacctgaacagaaacttcccagaccagtttgtgcagatcacagaccccacccagcctgagaccatcgctgtgatgtcctggatgaagagctacccctttgtgctgagcgccaacctgcacggcggcagcctggtggtgaactacccctttgatgatgatgagcagggcctggccacctacagcaagagcccagatgatgctgtgttccagcagatcgccctgagctacagcaaagaaaacagccagatgttccagggccggccctgcaagaacatgtacccaaatgagtacttcccccacggcatcaccaacggggcctcctggtacaacgtgcctgggggcatgcaggactggaactacctgcagaccaactgctttgaggtgaccatcgagctgggctgtgtgaagtaccccctggagaaggagctgcccaacttctgggagcagaacagaagaagcctcatccagttcatgaagcaggtgcaccagggcgtgcggggctttgtgctggatgccacagatggccggggcatcctgaatgccaccatctctgtggccgagatcaaccaccctgtgaccacctacaagacaggagactactggaggctgctggtgcccggcacctacaagatcacagccagcgcccggggctacaaccctgtgaccaagaatgtgacagtgaagtctgagggcgccatccaggtgaacttcaccctggtgcgcagcagcacagacagcaacaatgaaagcaagaagggcaagggggccagcagcagcaccaatgatgccagtgaccccaccaccaaggagtttgagaccctcatcaaggacctgtctgcagaaaatggcctggagagcctgatgctgcggagcagcagcaacctggccctggccctgtaccgctaccacagctacaaggacctgtctgagttcctgcggggcctggtgatgaactacccccacatcaccaacctgaccaacctgggccagagcacagagtaccgccacatctggagcctggagatcagcaacaagcccaacgtgtctgagcctgaggagcccaagatccgctttgtggccggcatccatggaaatgcccctgtgggcacagagctgctgctggccctggccgagttcctgtgcctgaactacaagaagaacccagctgtgacccagctggtggacaggaccagaattgtgattgtgcccagcctgaacccagatggccgggagcgggcccaggagaaggactgcaccagcaagattggccagaccaatgcccggggcaaggacctggacacagacttcaccaacaatgccagccagcctgagaccaaggccatcatcgagaacctgatccagaagcaggacttcagcctgtctgtggccctggatggcggctccatgctggtgacctacccctatgacaagcctgtgcagacagtggagaacaaggagaccctgaagcacctggccagcctgtatgccaacaaccaccccagcatgcacatgggccagcccagctgccccaacaagagtgatgagaacatccctgggggcgtgatgagaggagctgagtggcacagccacctgggctccatgaaggactacagcgtgacctacggccactgcccagagatcaccgtgtacaccagctgctgctacttccccagcgctgcccggctgcccagcctgtgggccgacaacaagaggagcctgctgtccatgctggtggaggtgcacaagggcgtgcacggctttgtgaaggacaagacaggcaagcccatcagcaaggctgtgattgtgctgaatgaaggcatcaaggtgcagaccaaggagggcggctacttccacgtgctgctggcccctggggtgcacaacatcatcgccatcgcagatggctaccagcagcagcacagccaggtgtttgtgcaccatgatgctgccagctctgtggtgattgtgtttgacacagacaaccgcatcttcggcctgccccgggagctggtggtgacagtgtctggggccaccatgtctgccctgatcctgacagcctgcatcatctggtgcatctgcagcatcaagagcaacagacacaaggatggcttccaccggctgcggcagcaccatgatgaatatgaagatgagatccgcatgatgagcacaggcagcaagaagagcctgctgagccatgagttccaggatgaaacagacacagaggaggagaccctgtacagcagcaagcactag

SEQ ID NO: 146254 - DNA, 1149 bp, Artificial Sequence
  Description of Artificial Sequence: Synthetic coding sequence
atgagaagaagaagaaggctgcagcaggaggatggcatcagctttgagtaccaccgctacccagagctgcgggaggccctggtgtctgtgtggctgcagtgcacagccatcagccgcatctacacagtgggccgcagctttgagggccgggagctgctggtgattgagctgagtgacaaccctggggtgcatgagcccggggagcctgagttcaagtacatcggcaacatgcacggcaatgaggccgtgggccgggagctgctgatcttcctggcccagtacctgtgcaatgagtaccagaagggaaatgagaccatcgtgaacctgatccacagcacccgcatccacatcatgcccagcctgaacccagatggctttgagaaggccgccagccagcctggagagctgaaggactggtttgtgggccgcagcaatgcccagggcatcgacctgaacagaaacttcccagacctggacagaattgtgtatgtgaatgagaaggagggcggccccaacaaccacctgctgaagaacatgaagaagatcgtggaccagaacaccaagctggcccctgagaccaaggctgtgatccactggatcatggacatcccctttgtgctgagcgccaacctgcacggcggggacctggtggccaactacccctatgatgagaccaggagcggcagcgcccacgagtacagcagcagcccagatgatgccatcttccagagcctggcccgggcctacagcagcttcaacccagccatgtctgaccccaaccggcccccctgcaggaagaatgatgatgacagcagctttgtggatggcaccaccaatggaggagcctggtacagcgtgcctgggggcatgcaggacttcaactacctgagcagcaactgctttgagatcaccgtggagctgagctgtgagaagtttcctcctgaggagaccctgaagacctactgggaggacaacaagaacagcctcatctcctacctggagcagatccacagaggagtgaagggctttgtgcgggacctgcagggcaaccccatcgccaatgccaccatctctgtggagggcatcgaccatgatgtgaccagcgccaaggatggagactactggaggctgctgacctggaagctgtag

SEQ ID NO: 146255 - DNA, 1431 bp, Artificial Sequence
  Description of Artificial Sequence: Synthetic coding sequence
atggccggccggggcggcagcgccctgctggccctgtgtggggccctggccgcctgtggctggctgctgggcgctgaggcccaggagcccggggccccagctgctggcatgagaagaagaagaaggctgcagcaggaggatggcatcagctttgagtaccaccgctacccagagctgcgggaggccctggtgtctgtgtggctgcagtgcacagccatcagccgcatctacacagtgggccgcagctttgagggccgggagctgctggtgattgagctgagtgacaaccctggggtgcatgagcccggggagcctgagttcaagtacatcggcaacatgcacggcaatgaggccgtgggccgggagctgctgatcttcctggcccagtacctgtgcaatgagtaccagaagggaaatgagaccatcgtgaacctgatccacagcacccgcatccacatcatgcccagcctgaacccagatggctttgagaaggccgccagccagcctggagagctgaaggactggtttgtgggccgcagcaatgcccagggcatcgacctgaacagaaacttcccagacctggacagaattgtgtatgtgaatgagaaggagggcggccccaacaaccacctgctgaagaacatgaagaagatcgtggaccagaacaccaagctggcccctgagaccaaggctgtgatccactggatcatggacatcccctttgtgctgagcgccaacctgcacggcggggacctggtggccaactacccctatgatgagaccaggagcggcagcgcccacgagtacagcagcagcccagatgatgccatcttccagagcctggcccgggcctacagcagcttcaacccagccatgtctgaccccaaccggcccccctgcaggaagaatgatgatgacagcagctttgtggatggcaccaccaatggaggagcctggtacagcgtgcctgggggcatgcaggacttcaactacctgagcagcaactgctttgagatcaccgtggagctgagctgtgagaagtttcctcctgaggagaccctgaagacctactgggaggacaacaagaacagcctcatctcctacctggagcagatccacagaggagtgaagggctttgtgcgggacctgcagggcaaccccatcgccaatgccaccatctctgtggagggcatcgaccatgatgtgaccagcgccaaggatggagactactggaggctgctgatccctggcaactacaagctgacagccagcgcccctggctacctggccatcaccaagaaggtggccgtgccctacagccctgctgctggggtggactttgagctggagagcttcagcgagaggaaggaggaggagaaggaggagctgatggagtggtggaagatgatgtctgagaccctgaacttctag

SEQ ID NO: 146256 - DNA, 1332 bp, Artificial Sequence
  Description of Artificial Sequence: Synthetic coding sequence
atggacttcccctgcctgtggctgggcctgctgctgcccctggtggccgccctggacttcaactaccaccggcaggagggcatggaggccttcctgaagacagtggcccagaactacagctctgtgacccacctgcacagcatcggcaagtctgtgaagggcaggaacctgtgggtgctggtggtgggccgcttccccaaggagcacagaattggcatccctgagttcaagtatgtggccaacatgcatggagatgaaacagtgggccgggagctgctgctgcacctgattgactacctggtgaccagtgatggcaaggaccctgagatcaccaacctgatcaacagcacccgcatccacatcatgcccagcatgaacccagatggctttgaggccgtgaagaagccagactgctactacagcatcggccgggagaactacaaccagtatgacctgaacagaaacttcccagatgcctttgagtacaacaacgtgtcccggcagcctgagaccgtggccgtgatgaagtggctgaagacagagacctttgtgctgagcgccaacctgcacggcggggccctggtggccagctacccctttgacaacggggtgcaggccactggagccctgtacagccgcagcctgaccccagatgatgatgtgttccagtacctggcccacacctacgccagcaggaaccccaacatgaagaagggagatgagtgcaagaacaagatgaacttccccaacggggtgaccaacggctacagctggtaccccctgcagggcggcatgcaggactacaactacatctgggcccagtgctttgagatcaccctggagctgagctgctgcaagtacccccgggaggagaagctgcccagcttctggaacaacaacaaggccagcctgattgagtacatcaagcaggtgcacctgggcgtgaagggccaggtgtttgaccagaatggaaaccccctgcccaacgtgattgtggaggtgcaggacaggaagcacatctgcccctaccgcaccaacaagtacggggagtactacctgctgctgctgcccggcagctacatcatcaacgtgacagtgcccggccatgacccccacatcaccaaggtgatcatccctgagaagagccagaacttcagcgccctgaagaaggacatcctgctgcccttccagggccagctggacagcatccctgtgagcaaccccagctgccccatgatccccctgtacagaaacctgcctgaccacagcgctgccaccaagcccagcctcttcctgttcctggtgtccctgctgcacatcttcttcaagtag

SEQ ID NO: 146257 - DNA, 1332 bp, Artificial Sequence; identical to SEQ ID NO: 146256
  Description of Artificial Sequence: Synthetic coding sequence

SEQ ID NO: 146258 - DNA, 1332 bp, Artificial Sequence; identical to SEQ ID NO: 146256
  Description of Artificial Sequence: Synthetic coding sequence

SEQ ID NO: 146259 - DNA, 411 bp, Artificial Sequence
  Description of Artificial Sequence: Synthetic coding sequence
atggacttcccctgcctgtggctgggcctgctgctgcccctggtggccgccctggacttcaactaccaccggcaggagggcatggaggccttcctgaagacagtggcccagaactacagctctgtgacccacctgcacagcatcggcaagtctgtgaagggcaggaacctgtgggtgctggtggtgggccgcttccccaaggagcacagaattggcatccctgagttcaagtatgtggccaacatgcatggagatgaaacagtgggccgggagctgctgctgcacctgattgactacctggtgaccagtgatggcaaggaccctgagatcaccaacctgatcaacagcacccgcatccacatcatgcccagcatgaacccagatggctttgaggccgtgaagaagccctag

SEQ ID NO: 146260 - DNA, 750 bp, Artificial Sequence
  Description of Artificial Sequence: Synthetic coding sequence
atggacttcccctgcctgtggctgggcctgctgctgcccctggtggccgccctggacttcaactaccaccggcaggagggcatggaggccttcctgaagacagtggcccagaactacagctctgtgacccacctgcacagcatcggcaagtctgtgaagggcaggaacctgtgggtgctggtggtgggccgcttccccaaggagcacagaattggcatccctgagttcaagtatgtggccaacatgcatggagatgaaacagtgggccgggagctgctgctgcacctgattgactacctggtgaccagtgatggcaaggaccctgagatcaccaacctgatcaacagcacccgcatccacatcatgcccagcatgaacccagatggctttgaggccgtgaagaagccagactgctactacagcatcggccgggagaactacaaccagtatgacctgaacagaaacttcccagatgcctttgagtacaacaacgtgtcccggcagcctgagaccgtggccgtgatgaagtggctgaagacagagacctttgtgctgagcgccaacctgcacggcggggccctggtggccagctacccctttgacaacggggtgcaggccactggagccctgtacagccgcagcctgaccccagatgatgatgtgttccagtacctggcccacacctacgccagcaggaaccccaacatgaagaagggagatgagtgcaagaacaagatgaacttcccctag

SEQ ID NO: 146261 - DNA, 1332 bp, Artificial Sequence; identical to SEQ ID NO: 146256
  Description of Artificial Sequence: Synthetic coding sequence

SEQ ID NO: 146262 - DNA, 1377 bp, Artificial Sequence
  Description of Artificial Sequence: Synthetic coding sequence
atgtctgacctgctgagcgtcttcctgcacctgctgctgctcttcaagctggtggcccctgtgaccttccgccaccacagatatgatgacctggtgaggaccctgtacaaggtgcagaatgaatgtcctggcatcaccagggtgtacagcatcggccgctctgtggagggccgccacctgtatgtgctggagttcagtgaccaccctggcatccacgagcccctggagcctgaggtgaagtatgtgggcaacatgcacggcaatgaggccctgggccgggagctgatgctgcagctgtctgagttcctgtgtgaggagttcaggaacagaaaccagagaattgtgcagctgatccaggacacccgcatccacatcctgcccagcatgaacccagatggctatgaggtggccgccgcccagggccccaacaagccaggctacctggtgggcagaaataatgccaatggagtggacctgaacagaaacttcccagacctgaacacctacatctactacaatgagaagtatggaggccccaaccaccacctgcccctgcctgacaactggaagagccaggtggagcctgagaccagggctgtgatccgctggatgcacagcttcaactttgtgctgagcgccaacctgcacggcggcgctgtggtggccaactacccctatgacaagagctttgagcaccgggtgcggggcgtgcggaggacagccagcacccccaccccagatgacaagctgttccagaagctggccaaggtgtacagctatgcccacggctggatgttccagggctggaactgtggggactacttcccagatggcatcaccaatggagcctcctggtacagcctgagcaagggcatgcaggacttcaactacctgcacaccaactgctttgagatcaccctggagctgagctgtgacaagtttcctcctgaggaggagctgcagcgggagtggctgggcaaccgggaggccctgatccagttcctggagcaggtgcaccagggcatcaagggcatggtgctggatgagaactacaacaacctggccaatgctgtgatctctgtgtctggcatcaaccatgatgtgaccagcggggaccatggagactacttccggctgctgctgcccggcatctacacagtgtctgccacagcccctggctatgaccctgagaccgtgacagtgacagtgggccctgctgagcccaccctggtgaacttccacctgaagaggagcatcccccaggtgtcccctgtgcggcgggcccccagcagaagacatggagtgcgggccaaggtgcagccccaggccaggaagaaggagatggagatgaggcagctgcagaggggccctgcctag

SEQ ID NO: 146263 - DNA, 615 bp, Artificial Sequence
  Description of Artificial Sequence: Synthetic coding sequence
atgcacagcttcaactttgtgctgagcgccaacctgcatggaggagctgtggtggccaactacccctatgacaagagctttgagcaccgggtgcggggcgtgagaagaacagccagcacccccaccccagatgacaagctgttccagaagctggccaaggtgtacagctatgcccacggctggatgttccagggctggaactgtggggactacttcccagatggcatcaccaacggggcctcctggtacagcctgagcaagggcatgcaggacttcaactacctgcacaccaactgctttgagatcaccctggagctgagctgtgacaagttccccccagaggaggagctgcagcgggagtggctgggcaaccgggaggccctgatccagttcctggagcaggtgcaccagggcatcaagggcatggtgctggatgagaactacaacaacctggccaatgctgtgatctctgtgtctggcatcaaccatgatgtgaccagcggggaccacggggactacttccggctgctgctgcccggcatctacacagtgtctgccacagcccctggctatgaccctgagaccgtgacagtgacagtgggccctgctgagtag

SEQ ID NO: 146264 - DNA, 1638 bp, Artificial Sequence
  Description of Artificial Sequence: Synthetic coding sequence
atgctgcccggggcctggctgctgtggaccagcctgctgctgctggcccggcctgcccagccctgccccatgggctgtgactgctttgtgcaggaggtgttctgcagtgatgaggagctggccaccgtgcccctggacatccccccctacaccaagaacatcatctttgtggagaccagcttcaccaccctggagacccgggccttcggcagcaaccccaacctgaccaaggtggtgttcctgaacacccagctgtgccagttccggccagatgcctttggaggcctgccccggctggaggacctggaggtgacaggcagcagcttcctgaacctgagcaccaacatcttcagcaacctgaccagcctgggcaagctgaccctgaacttcaacatgctggaggccctgcctgagggcctcttccagcacctggccgccctggagagcctgcacctgcagggcaaccagctgcaggccctgccccggcggctcttccagcccctgacccacctgaagaccctgaacctggcccagaacctgctggcccagctgcctgaggagctgttccaccccctgaccagcctgcagaccctgaagctgagcaacaatgccctgagcggcctgccccagggcgtgtttgggaagctgggcagcctgcaggagctgttcctggacagcaacaacatcagcgagctgcccccccaggtgttcagccagctgttctgcctggagcggctgtggctgcagagaaatgccatcacccacctgcccctgagcatctttgccagcctgggcaacctgaccttcctgagcctgcagtggaacatgctgcgggtgctgcctgctggcctgtttgcccacaccccctgcctggtgggcctgagcctgacccacaaccagctggagaccgtggccgagggcacctttgcccacctgagcaacctgcggagcctgatgctgagctacaatgccatcacccacctgcctgctggcatcttccgggacctggaggagctggtgaagctgtacctgggcagcaacaacctgacagccctgcacccagccctcttccagaacctgagcaagctggagctgctgagcctgagcaagaaccagctgaccaccctgcctgagggcatctttgacaccaactacaacctcttcaacctggccctgcacggcaacccctggcagtgtgactgccacctggcctacctgttcaactggctgcagcagtacacagaccggctgctgaacatccagacctactgtgccggccctgcctacctgaagggccaggtggtgcctgccctgaatgagaagcagctggtgtgccctgtgacccgggaccacctgggcttccaggtgacctggccagatgagagcaaggccggcggctcctgggacctggccgtgcaggagcgggccgcccggagccagtgcacctacagcaaccctgagggcaccgtggtgctggcctgtgaccaggcccagtgccgctggctgaatgtgcagctgagcccccagcagggcagcctgggcctgcagtacaatgccagccaggagtgggacctgcggagcagctgtggcagcctgcggctgactgtgtccattgaggcccgggctgctggcccctag

SEQ ID NO: 146265 - DNA, 1638 bp, Artificial Sequence; identical to SEQ ID NO: 146264
  Description of Artificial Sequence: Synthetic coding sequence

SEQ ID NO: 146266 - DNA, 1431 bp, Artificial Sequence
  Description of Artificial Sequence: Synthetic coding sequence
atggtgggcgccatgtggaaggtgattgtgtccctggtgctgctgatgcctggcccctgtgatggcctcttccgcagcctgtacagatctgtgtccatgccacccaagggggacagcggccagcccctcttcctgaccccctacattgaagctgggaagatccagaagggccgggagctgagcctggtgggccccttccctggcctgaacatgaagagctatgccggcttcctgactgtgaacaagacctacaacagcaacctcttcttctggttcttccctgcccagatccagccagaagatgcccctgtggtgctgtggctgcagggcggccctgggggcagctccatgtttggcctgtttgtggagcacggcccctacgtggtgaccagcaacatgaccctgcgggaccgggacttcccctggaccaccaccctgtccatgctgtacatcgacaaccctgtgggcaccggcttctccttcacagatgacacccacggctatgctgtgaatgaagatgatgtggcccgggacctgtacagcgccctgatccagttcttccagatcttccctgagtacaagaacaatgacttctacgtgactggagagagctatgctgggaagtatgtgcctgccatcgcccacctgatccacagcctgaaccctgtgcgggaggtgaagatcaacctgaatggaattgccatcggagatggctacagcgaccctgagagcatcatcggcggctacgccgagttcctgtaccagatcggcctgctggatgagaagcagaagaagtacttccagaagcagtgccatgaatgtattgagcacatcaggaagcagaactggtttgaggcctttgagatcctggacaagctgctggatggagacctgaccagtgaccccagctacttccagaatgtgacaggctgcagcaactactacaacttcctgcgctgcacagagcctgaggaccagctgtactacgtgaagttcctgagcctgcctgaggtgcggcaggccatccacgtgggcaaccagaccttcaatgatggcaccatcgtggagaagtacctgagagaagatactgtgcagagcgtgaagccctggctgacagagatcatgaacaactacaaggtgctgatctacaacggccagctggacatcatcgtggccgccgccctgacagagaggagcctgatgggcatggactggaagggcagccaggagtacaagaaggccgagaagaaggtgtggaagatcttcaagagtgacagcgaggtggccggctacatccggcaggccggggacttccaccaggtgatcatccggggcggcggccacatcctgccctatgaccagcccctgcgggcctttgacatgatcaaccgcttcatctacggcaagggctgggacccctacgtgggctag

SEQ ID NO: 146267 - DNA, 1431 bp, Artificial Sequence; identical to SEQ ID NO: 146266
  Description of Artificial Sequence: Synthetic coding sequence

SEQ ID NO: 146268 - DNA, 1431 bp, Artificial Sequence; identical to SEQ ID NO: 146266
  Description of Artificial Sequence: Synthetic coding sequence

SEQ ID NO: 146269 - DNA, 21 bp, Artificial Sequence
  Description of Artificial Sequence: Synthetic coding sequence
atggtgggcgccatgtggtag

SEQ ID NO: 146270 - DNA, 159 bp, Artificial Sequence
  Description of Artificial Sequence: Synthetic coding sequence
atggtgggcgccatgtggaaggtgattgtgtccctggtgctgctgatgcctggcccctgtgatggcctcttccgcagcctgtacagatctgtgtccatgccacccaagggggacagcggccagcccctcttcctgaccccctacattgaagctggatag

SEQ ID NO: 146271 - DNA, 132 bp, Artificial Sequence
  Description of Artificial Sequence: Synthetic coding sequence
atggtgggcgccatgtggaaggtgattgtgtccctggtgctgctgatgcctggcccctgtgatggcctcttccgcagcctgtacagatctgtgtccatgccacccaagggggacagcggccagcccctgtag

SEQ ID NO: 146272 - DNA, 699 bp, Artificial Sequence
  Description of Artificial Sequence: Synthetic coding sequence
atgtttggcctgtttgtggagcacggcccctacgtggtgaccagcaacatgaccctgcgggaccgggacttcccctggaccaccaccctgtccatgctgtacatcgacaaccctgtgggcaccggcttctccttcacagatgacacccacggctatgctgtgaatgaagatgatgtggcccgggacctgtacagcgccctgatccagttcttccagatcttccctgagtacaagaacaatgacttctacgtgactggagagagctatgctgggaagtatgtgcctgccatcgcccacctgatccacagcctgaaccctgtgcgggaggtgaagatcaacctgaatggaattgccatcggagatggctacagcgaccctgagagcatcatcggcggctacgccgagttcctgtaccagatcggcctgctggatgagaagcagaagaagtacttccagaagcagtgccatgaatgtattgagcacatcaggaagcagaactggtttgaggcctttgagatcctggacaagctgctggatggagacctgaccagtgaccccagctacttccagaatgtgacaggctgcagcaactactacaacttcctgcgctgcacagagcctgaggaccagctgtactacgtgaagttcctgagcctgcctgaggtgcggcaggcccccagaggagagagtgacttctag

SEQ ID NO: 146273 - DNA, 1581 bp, Artificial Sequence
  Description of Artificial Sequence: Synthetic coding sequence
atgggccacctgagcgcccccctgcaccgggtgcgggtgccctggcagggcctgctgctgacagccagcctgctgaccttctggaacccccccaccacagcccagctgaccacagagagcatgcccttcaacgtggccgagggcaaggaggtgctgctgctggtgcacaacctgccccagcagctgtttggctacagctggtacaagggggagcgggtggatggcaaccggcagatcgtgggctacgccatcggcacccagcaggccaccccaggccctgccaacagcggccgggagaccatctacccaaatgccagcctgctgatccagaatgtgacccagaatgacaccggcttctacaccctgcaggtgatcaagagtgacctggtgaatgaggaggccaccggccagttccacgtgtacccagagctgcccaagcccagcatcagcagcaacaacagcaaccctgtggaggacaaggatgctgtggccttcacctgtgagcctgagacccaggacaccacctacctgtggtggatcaacaaccagagcctgcctgtgagcccccggctgcagctgagcaatggaaacagaaccctgaccctgctgtctgtgaccagaaatgacaccggcccctatgaatgtgagatccagaaccctgtgtctgccaacagaagtgaccctgtgaccctgaatgtgacctacggccctgacacccccaccatcagccccagcgacacctactacagacctggggccaacctgagcctgagctgctatgctgccagcaaccccccagcccagtacagctggctgatcaatggcaccttccagcagagcacccaggagctgttcatccccaacatcaccgtgaacaacagcggcagctacacctgccacgccaacaacagcgtgacaggctgcaacagaaccaccgtgaagaccatcatcgtgacagagctgagccctgtggtggccaagccccagatcaaggccagcaagaccaccgtgactggagacaaggacagcgtgaacctgacctgcagcaccaatgacaccggcatcagcatccgctggttcttcaagaaccagagcctgcccagcagcgagaggatgaagctgagccagggcaacaccaccctgagcatcaaccctgtgaagagagaagatgctggcacctactggtgtgaggtgttcaaccccatcagcaagaaccagagcgaccccatcatgctgaatgtgaactacaatgccctgccccaggagaatggcctgagccctggggccatcgccggcatcgtgattggagtggtggccctggtggccctgattgctgtggccctggcctgcttcctgcactttgggaagacaggccgggccagtgaccagagggacctgacagagcacaagcccagcgtgagcaaccacacccaggaccacagcaatgacccccccaacaagatgaatgaggtgacctacagcaccctgaactttgaggcccagcagcccacccagcccaccagcgccagccccagcctgacagccacagagatcatctacagcgaggtgaagaagcagtag

SEQ ID NO: 146274 - DNA, 1080 bp, Artificial Sequence
  Description of Artificial Sequence: Synthetic coding sequence
atgcccttcaacgtggccgagggcaaggaggtgctgctgctggtgcacaacctgccccagcagctgtttggctacagctggtacaagggggagcgggtggatggcaaccggcagatcgtgggctacgccatcggcacccagcaggccaccccaggccctgccaacagcggccgggagaccatctacccaaatgccagcctgctgatccagaatgtgacccagaatgacaccggcttctacaccctgcaggtgatcaagagtgacctggtgaatgaggaggccaccggccagttccacgtgtacccagagctgcccaagcccagcatcagcagcaacaacagcaaccctgtggaggacaaggatgctgtggccttcacctgtgagcctgagacccaggacaccacctacctgtggtggatcaacaaccagagcctgcctgtgagcccccggctgcagctgagcaatggaaacagaaccctgaccctgctgtctgtgaccagaaatgacaccggcccctatgaatgtgagatccagaaccctgtgtctgccaacagaagtgaccctgtgaccctgaatgtgacctacggccctgacacccccaccatcagccccagcgacacctactacagacctggggccaacctgagcctgagctgctatgctgccagcaaccccccagcccagtacagctggctgatcaatggcaccttccagcagagcacccaggagctgttcatccccaacatcaccgtgaacaacagcggcagctacacctgccacgccaacaacagcgtgacaggctgcaacagaaccaccgtgaagaccatcatcgtgacagagatggccttccaccacgtggccaaggccggcctgaagctgctgagcagcagcaaccccccagccagcaccagccagagcgccaagatcacagacaatgccctgccccaggagaatggcctgagccctggggccatcgccggcatcgtcatcggcgtggtggccctggtggccctgattgctgtggccctggcctgcttcctgcactttgggaagacaggcagcagcggccccctgcagtag

SEQ ID NO: 146275 - DNA, 1056 bp, Artificial Sequence
  Description of Artificial Sequence: Synthetic coding sequence
atgggccacctgagcgcccccctgcaccgggtgcgggtgccctggcagggcctgctgctgacagccagcctgctgaccttctggaacccccccaccacagcccagctgaccacagagagcatgcccttcaacgtggccgagggcaaggaggtgctgctgctggtgcacaacctgccccagcagctgtttggctacagctggtacaagggggagcgggtggatggcaaccggcagatcgtgggctacgccatcggcacccagcaggccaccccaggccctgccaacagcggccgggagaccatctacccaaatgccagcctgctgatccagaatgtgacccagaatgacaccggcttctacaccctgcaggtgatcaagagtgacctggtgaatgaggaggccaccggccagttccacgtgtacccagagctgcccaagcccagcatcagcagcaacaacagcaaccctgtggaggacaaggatgctgtggccttcacctgtgagcctgagacccaggacaccacctacctgtggtggatcaacaaccagagcctgcctgtgagcccccggctgcagctgagcaatggaaacagaaccctgaccctgctgtctgtgaccagaaatgacaccggcccctatgaatgtgagatccagaaccctgtgtctgccaacagaagtgaccctgtgaccctgaatgtgacctacggccctgacacccccaccatcagccccagcgacacctactacagacctggggccaacctgagcctgagctgctatgctgccagcaaccccccagcccagtacagctggctgatcaatggcaccttccagcagagcacccaggagctgttcatccccaacatcaccgtgaacaacagcggcagctacacctgccacgccaacaacagcgtgacaggctgcaacagaaccaccgtgaagaccatcatcgtgacagagagccctgtgctgggggaggatgaagctgtgcccggccagcaccacccccagcacaagccctgccaggagggcggctgctgggatgtgctggtgtag

SEQ ID NO: 146276 - DNA, 759 bp, Artificial Sequence
  Description of Artificial Sequence: Synthetic coding sequence
atgggccacctgagcgcccccctgcaccgggtgcgggtgccctggcagggcctgctgctgacagccagcctgctgaccttctggaacccccccaccacagcccagctgaccacagagagcatgcccttcaacgtggccgagggcaaggaggtgctgctgctggtgcacaacctgccccagcagctgtttggctacagctggtacaagggggagcgggtggatggcaaccggcagatcgtgggctacgccatcggcacccagcaggccaccccaggccctgccaacagcggccgggagaccatctacccaaatgccagcctgctgatccagaatgtgacccagaatgacaccggcttctacaccctgcaggtgatcaagagtgacctggtgaatgaggaggccaccggccagttccacgtgtaccacaatgccctgccccaggagaatggcctgagccctggggccatcgccggcatcgtgattggagtggtggccctggtggccctgattgctgtggccctggcctgcttcctgcactttgggaagacaggccgggccagtgaccagagggacctgacagagcacaagcccagcgtgagcaaccacacccaggaccacagcaatgacccccccaacaagatgaatgaggtgacctacagcaccctgaactttgaggcccagcagcccacccagcccaccagcgccagccccagcctgacagccacagagatcatctacagcgaggtgaagaagcagtag

SEQ ID NO: 146277 - DNA, 1293 bp, Artificial Sequence
  Description of Artificial Sequence: Synthetic coding sequence
atgggccacctgagcgcccccctgcaccgggtgcgggtgccctggcagggcctgctgctgacagccagcctgctgaccttctggaacccccccaccacagcccagctgaccacagagagcatgcccttcaacgtggccgagggcaaggaggtgctgctgctggtgcacaacctgccccagcagctgtttggctacagctggtacaagggggagcgggtggatggcaaccggcagatcgtgggctacgccatcggcacccagcaggccaccccaggccctgccaacagcggccgggagaccatctacccaaatgccagcctgctgatccagaatgtgacccagaatgacaccggcttctacaccctgcaggtgatcaagagtgacctggtgaatgaggaggccaccggccagttccacgtgtacccagagctgcccaagcccagcatcagcagcaacaacagcaaccctgtggaggacaaggatgctgtggccttcacctgtgagcctgagacccaggacaccacctacctgtggtggatcaacaaccagagcctgcctgtgagcccccggctgcagctgagcaatggaaacagaaccctgaccctgctgtctgtgaccagaaatgacaccggcccctatgaatgtgagatccagaaccctgtgtctgccaacagaagtgaccctgtgaccctgaatgtgacctacggccctgacacccccaccatcagccccagcgacacctactacagacctggggccaacctgagcctgagctgctatgctgccagcaaccccccagcccagtacagctggctgatcaatggcaccttccagcagagcacccaggagctgttcatccccaacatcaccgtgaacaacagcggcagctacacctgccacgccaacaacagcgtgacaggctgcaacagaaccaccgtgaagaccatcatcgtgacagacaatgccctgccccaggagaatggcctgagccctggggccatcgccggcatcgtgattggagtggtggccctggtggccctgattgctgtggccctggcctgcttcctgcactttgggaagacaggccgggccagtgaccagagggacctgacagagcacaagcccagcgtgagcaaccacacccaggaccacagcaatgacccccccaacaagatgaatgaggtgacctacagcaccctgaactttgaggcccagcagcccacccagcccaccagcgccagccccagcctgacagccacagagatcatctacagcgaggtgaagaagcagtag

SEQ ID NO: 146278 - DNA, 1386 bp, Artificial Sequence
  Description of Artificial Sequence: Synthetic coding sequence
atgggccacctgagcgcccccctgcaccgggtgcgggtgccctggcagggcctgctgctgacagccagcctgctgaccttctggaacccccccaccacagcccagctgaccacagagagcatgcccttcaacgtggccgagggcaaggaggtgctgctgctggtgcacaacctgccccagcagctgtttggctacagctggtacaagggggagcgggtggatggcaaccggcagatcgtgggctacgccatcggcacccagcaggccaccccaggccctgccaacagcggccgggagaccatctacccaaatgccagcctgctgatccagaatgtgacccagaatgacaccggcttctacaccctgcaggtgatcaagagtgacctggtgaatgaggaggccaccggccagttccacgtgtacccagagctgcccaagcccagcatcagcagcaacaacagcaaccctgtggaggacaaggatgctgtggccttcacctgtgagcctgagacccaggacaccacctacctgtggtggatcaacaaccagagcctgcctgtgagcccccggctgcagctgagcaatggaaacagaaccctgaccctgctgtctgtgaccagaaatgacaccggcccctatgaatgtgagatccagaaccctgtgtctgccaacagaagtgaccctgtgaccctgaatgtgacctacggccctgacacccccaccatcagccccagcgacacctactacagacctggggccaacctgagcctgagctgctatgctgccagcaaccccccagcccagtacagctggctgatcaatggcaccttccagcagagcacccaggagctgttcatccccaacatcaccgtgaacaacagcggcagctacacctgccacgccaacaacagcgtgacaggctgcaacagaaccaccgtgaagaccatcatcgtgacagagcggcagaacctgaccatgctgccccggctggacagcaacagctgggcccaggccatcctgcccagcgtgtcccagagcgctgagatcacagacaatgccctgccccaggagaatggcctgagccctggggccatcgccggcatcgtcatcggcgtggtggccctggtggccctgattgctgtggccctggcctgcttcctgcactttgggaagacaggccgggccagtgaccagagggacctgacagagcacaagcccagcgtgagcaaccacacccaggaccacagcaatgacccccccaacaagatgaatgaggtgacctacagcaccctgaactttgaggcccagcagcccacccagcccaccagcgccagccccagcctgacagccacagagatcatctacagcgaggtgaagaagcagtag

SEQ ID NO: 146279 - DNA, 1254 bp, Artificial Sequence
  Description of Artificial Sequence: Synthetic coding sequence
atgggccacctgagcgcccccctgcaccgggtgcgggtgccctggcagggcctgctgctgacagccagcctgctgaccttctggaacccccccaccacagcccagctgaccacagagagcatgcccttcaacgtggccgagggcaaggaggtgctgctgctggtgcacaacctgccccagcagctgtttggctacagctggtacaagggggagcgggtggatggcaaccggcagatcgtgggctacgccatcggcacccagcaggccaccccaggccctgccaacagcggccgggagaccatctacccaaatgccagcctgctgatccagaatgtgacccagaatgacaccggcttctacaccctgcaggtgatcaagagtgacctggtgaatgaggaggccaccggccagttccacgtgtacccagagctgcccaagcccagcatcagcagcaacaacagcaaccctgtggaggacaaggatgctgtggccttcacctgtgagcctgagacccaggacaccacctacctgtggtggatcaacaaccagagcctgcctgtgagcccccggctgcagctgagcaatggaaacagaaccctgaccctgctgtctgtgaccagaaatgacaccggcccctatgaatgtgagatccagaaccctgtgtctgccaacagaagtgaccctgtgaccctgaatgtgacctacggccctgacacccccaccatcagccccagcgacacctactacagacctggggccaacctgagcctgagctgctatgctgccagcaaccccccagcccagtacagctggctgatcaatggcaccttccagcagagcacccaggagctgttcatccccaacatcaccgtgaacaacagcggcagctacacctgccacgccaacaacagcgtgacaggctgcaacagaaccaccgtgaagaccatcatcgtgacagagctgagccctgtggtggccaagccccagatcaaggccagcaagaccaccgtgactggagacaaggacagcgtgaacctgacctgcagcaccaatgacaccggcatcagcatccgctggttcttcaagaaccagagcctgcccagcagcgagaggatgaagctgagccagggcaacaccaccctgagcatcaaccctgtgaagagagaagatgctggcacctactggtgtgaggtgttcaaccccatcagcaagaaccagagcgaccccatcatgctgaatgtgaactgcaagtag

SEQ ID NO: 146280 - DNA, 1437 bp, Artificial Sequence
  Description of Artificial Sequence: Synthetic coding sequence
atgcccttcaacgtggccgagggcaaggaggtgctgctgctggtgcacaacctgccccagcagctgtttggctacagctggtacaagggggagcgggtggatggcaaccggcagatcgtgggctacgccatcggcacccagcaggccaccccaggccctgccaacagcggccgggagaccatctacccaaatgccagcctgctgatccagaatgtgacccagaatgacaccggcttctacaccctgcaggtgatcaagagtgacctggtgaatgaggaggccaccggccagttccacgtgtacccagagctgcccaagcccagcatcagcagcaacaacagcaaccctgtggaggacaaggatgctgtggccttcacctgtgagcctgagacccaggacaccacctacctgtggtggatcaacaaccagagcctgcctgtgagcccccggctgcagctgagcaatggaaacagaaccctgaccctgctgtctgtgaccagaaatgacaccggcccctatgaatgtgagatccagaaccctgtgtctgccaacagaagtgaccctgtgaccctgaatgtgacctacggccctgacacccccaccatcagccccagcgacacctactacagacctggggccaacctgagcctgagctgctatgctgccagcaaccccccagcccagtacagctggctgatcaatggcaccttccagcagagcacccaggagctgttcatccccaacatcaccgtgaacaacagcggcagctacacctgccacgccaacaacagcgtgacaggctgcaacagaaccaccgtgaagaccatcatcgtgacagagctgagccctgtggtggccaagccccagatcaaggccagcaagaccaccgtgactggagacaaggacagcgtgaacctgacctgcagcaccaatgacaccggcatcagcatccgctggttcttcaagaaccagagcctgcccagcagcgagaggatgaagctgagccagggcaacaccaccctgagcatcaaccctgtgaagagagaagatgctggcacctactggtgtgaggtgttcaaccccatcagcaagaaccagagcgaccccatcatgctgaatgagatggccttccaccacgtggccaaggccggcctgaagctgctgagcagcagcaaccccccagccagcaccagccagagcgccaagatcacagagcggcagaacctgaccatgctgccccggctggacagcaacagctgggcccaggccatcctgcccagcgtgtcccagagcgctgagatcacagacaatgccctgccccaggagaatggcctgagccctggggccatcgccggcatcgtgattggagtggtggccctggtggccctgattgctgtggccctggcctgcttcctgcactttgggaagacaggatag

SEQ ID NO: 146281 - DNA, 966 bp, Artificial Sequence
  Description of Artificial Sequence: Synthetic coding sequence
atgggccacctgagcgcccccctgcaccgggtgcgggtgccctggcagggcctgctgctgacagccagcctgctgaccttctggaacccccccaccacagcccagctgaccacagagagcatgcccttcaacgtggccgagggcaaggaggtgctgctgctggtgcacaacctgccccagcagctgtttggctacagctggtacaagggggagcgggtggatggcaaccggcagatcgtgggctacgccatcggcacccagcaggccaccccaggccctgccaacagcggccgggagaccatctacccaaatgccagcctgctgatccagaatgtgacccagaatgacaccggcttctacaccctgcaggtgatcaagagtgacctggtgaatgaggaggccaccggccagttccacgtgtacccagagctgcccaagcccagcatcagcagcaacaacagcaaccctgtggaggacaaggatgctgtggccttcacctgtgagcctgagacccaggacaccacctacctgtggtggatcaacaaccagagcctgcctgtgagcccccggctgcagctgagcaatggaaacagaaccctgaccctgctgtctgtgaccagaaatgacaccggcccctatgaatgtgagatccagaaccctgtgtctgccaacagaagtgaccctgtgaccctgaatgtgacctacggccctgacacccccaccatcagccccagcgacacctactacagacctggggccaacctgagcctgagctgctatgctgccagcaaccccccagcccagtacagctggctgatcaatggcaccttccagcagagcacccaggagctgttcatccccaacatcaccgtgaacaacagcggcagctacacctgccacgccaacaacagcgtgacaggctgcaacagaaccaccgtgaagaccatcatcgtgacaggcaagtag

SEQ ID NO: 146282 - DNA, 1458 bp, Artificial Sequence
  Description of Artificial Sequence: Synthetic coding sequence
cggggggacagagctgctgtgctggaggccttcctggagcccaagctgagcagcactggagaagatcgggccagccgccgccaccacggggcccccctgagccccaccagccagagcgcctgcaccctgggcctgctgctgacagccagcctgctgaccttctggaacccccccaccacagcccagctgaccacagagagcatgcccttcaacgtggccgagggcaaggaggtgctgctgctggtgcacaacctgccccagcagctgtttggctacagctggtacaagggggagcgggtggatggcaaccggcagatcgtgggctacgccatcggcacccagcaggccaccccaggccctgccaacagcggccgggagaccatctacccaaatgccagcctgctgatccagaatgtgacccagaatgacaccggcttctacaccctgcaggtgatcaagagtgacctggtgaatgaggaggccaccggccagttccacgtgtacccagagctgcccaagcccagcatcagcagcaacaacagcaaccctgtggaggacaaggatgctgtggccttcacctgtgagcctgagacccaggacaccacctacctgtggtggatcaacaaccagagcctgcctgtgagcccccggctgcagctgagcaatggaaacagaaccctgaccctgctgtctgtgaccagaaatgacaccggcccctatgaatgtgagatccagaaccctgtgtctgccaacagaagtgaccctgtgaccctgaatgtgacctacggccctgacacccccaccatcagccccagcgacacctactacagacctggggccaacctgagcctgagctgctacgccgccagcaaccccccagcccagtacagctggctgatcaatggcaccttccagcagagcacccaggagctgttcatccccaacatcaccgtgaacaacagcggcagctacacctgccacgccaacaacagcgtgacaggctgcaacagaaccaccgtgaagaccatcatcgtgacagagctgagccctgtggtggccaagccccagatcaaggccagcaagaccaccgtgactggagacaaggacagcgtgaacctgacctgcagcaccaatgacaccggcatcagcatccgctggttcttcaagaaccagagcctgcccagcagcgagaggatgaagctgagccagggcaacaccaccctgagcatcaaccctgtgaagcgggaggatgctggcacctactggtgtgaggtgttcaaccccatcagcaagaaccagagcgaccccatcatgctgaatgtgaactacaatgccctgccccaggagaatggcctgagccctggggccatcgccggcatcgtcatcggcgtggtggccctggtggccctgattgctgtggccctggcctgcttcctgcactttgggaagacaggatag

SEQ ID NO: 146283 - DNA, 1395 bp, Artificial Sequence
  Description of Artificial Sequence: Synthetic coding sequence
atgggccacctgagcgcccccctgcaccgggtgcgggtgccctggcagggcctgctgctgacagccagcctgctgaccttctggaacccccccaccacagcccagctgaccacagagagcatgcccttcaacgtggccgagggcaaggaggtgctgctgctggtgcacaacctgccccagcagctgtttggctacagctggtacaagggggagcgggtggatggcaaccggcagatcgtgggctacgccatcggcacccagcaggccaccccaggccctgccaacagcggccgggagaccatctacccaaatgccagcctgctgatccagaatgtgacccagaatgacaccggcttctacaccctgcaggtgatcaagagtgacctggtgaatgaggaggccaccggccagttccacgtgtacccagagctgcccaagcccagcatcagcagcaacaacagcaaccctgtggaggacaaggatgctgtggccttcacctgtgagcctgagacccaggacaccacctacctgtggtggatcaacaaccagagcctgcctgtgagcccccggctgcagctgagcaatggaaacagaaccctgaccctgctgtctgtgaccagaaatgacaccggcccctatgaatgtgagatccagaaccctgtgtctgccaacagaagtgaccctgtgaccctgaatgtgacctacggccctgacacccccaccatcagccccagcgacacctactacagacctggggccaacctgagcctgagctgctatgctgccagcaaccccccagcccagtacagctggctgatcaatggcaccttccagcagagcacccaggagctgttcatccccaacatcaccgtgaacaacagcggcagctacacctgccacgccaacaacagcgtgacaggctgcaacagaaccaccgtgaagaccatcatcgtgacagagctgagccctgtggtggccaagccccagatcaaggccagcaagaccaccgtgactggagacaaggacagcgtgaacctgacctgcagcaccaatgacaccggcatcagcatccgctggttcttcaagaaccagagcctgcccagcagcgagaggatgaagctgagccagggcaacaccaccctgagcatcaaccctgtgaagagagaagatgctggcacctactggtgtgaggtgttcaaccccatcagcaagaaccagagcgaccccatcatgctgaatgtgaactacaatgccctgccccaggagaatggcctgagccctggggccatcgccggcatcgtgattggagtggtggccctggtggccctgattgctgtggccctggcctgcttcctgcactttgggaagacaggcagcagcggccccctgcagtag

SEQ ID NO: 146284 - DNA, 1107 bp, Artificial Sequence
  Description of Artificial Sequence: Synthetic coding sequence
atgggccacctgagcgcccccctgcaccgggtgcgggtgccctggcagggcctgctgctgacagccagcctgctgaccttctggaacccccccaccacagcccagctgaccacagagagcatgcccttcaacgtggccgagggcaaggaggtgctgctgctggtgcacaacctgccccagcagctgtttggctacagctggtacaagggggagcgggtggatggcaaccggcagatcgtgggctacgccatcggcacccagcaggccaccccaggccctgccaacagcggccgggagaccatctacccaaatgccagcctgctgatccagaatgtgacccagaatgacaccggcttctacaccctgcaggtgatcaagagtgacctggtgaatgaggaggccaccggccagttccacgtgtacccagagctgcccaagcccagcatcagcagcaacaacagcaaccctgtggaggacaaggatgctgtggccttcacctgtgagcctgagacccaggacaccacctacctgtggtggatcaacaaccagagcctgcctgtgagcccccggctgcagctgagcaatggaaacagaaccctgaccctgctgtctgtgaccagaaatgacaccggcccctatgaatgtgagatccagaaccctgtgtctgccaacagaagtgaccctgtgaccctgaatgtgacctacggccctgacacccccaccatcagccccagcgacacctactacagacctggggccaacctgagcctgagctgctatgctgccagcaaccccccagcccagtacagctggctgatcaatggcaccttccagcagagcacccaggagctgttcatccccaacatcaccgtgaacaacagcggcagctacacctgccacgccaacaacagcgtgacaggctgcaacagaaccaccgtgaagaccatcatcgtgacagacaatgccctgccccaggagaatggcctgagccctggggccatcgccggcatcgtgattggagtggtggccctggtggccctgattgctgtggccctggcctgcttcctgcactttgggaagacaggcagcagcggccccctgcagtag

SEQ ID NO: 146285 - DNA, 906 bp, Artificial Sequence
  Description of Artificial Sequence: Synthetic coding sequence
atgctggccctgcgggtggcccggggctcctggggcgccctgcggggagctgcctgggcccctggcacccggcccagcaagaggcgggcctgctgggccctgctgccccctgtgccctgctgcctgggctgcctggccgagcgctggaggctgcggcctgctgccctgggcctgcggctgcccggcatcggccagaggaaccactgcagcggggccggcaaggccgcccccaggcctgctgctggagctggagctgctgctgaggcccctgggggccagtggggccctgccagcacccccagcctgtatgagaacccctggaccatccccaacatgctgtccatgacccgcatcggcctggcccctgtgctgggctacctgatcatcgaggaggacttcaacatcgccctgggcgtgtttgccctggccggcctgacagacctgctggatggcttcatcgccaggaactgggccaaccagaggtctgccctgggcagcgccctggaccccctggccgacaagatcctgatcagcatcctgtatgtgtccctgacctatgctgacctgatccctgtgcccctgacctacatgatcatcagcagagatgtgatgctgattgctgctgtgttctacgtgcgctaccgcaccctgcccacccccaggaccctggccaagtacttcaacccctgctacgccacagcccggctgaagcccaccttcatcagcaaggtgaacacagctgtgcagctgatcctggtggccgccagcctggccgcccctgtgttcaactatgctgacagcatctacctgcagatcctgtggtgcttcaccgccttcaccacagctgccagcgcctacagctactaccactacggcaggaagacagtgcaggtgatcaaggactag

SEQ ID NO: 146286 - DNA, 609 bp, Artificial Sequence
  Description of Artificial Sequence: Synthetic coding sequence
atgccccagtatgagaacccctggaccatccccaacatgctgtccatgaccagaattggcctggcccctgtgctgggctacctgatcatcgaggaggacttcaacatcgccctgggcgtgtttgccctggccggcctgacagacctgctggatggcttcatcgccaggaactgggccaaccagaggtctgccctgggcagcgccctggaccccctggccgacaagatcctgatcagcatcctgtatgtgtccctgacctacgccgacctgatccctgtgcccctgacctacatgatcatcagcagagatgtgatgctgattgctgctgtgttctacgtgcgctaccgcaccctgcccacccccaggaccctggccaagtacttcaacccctgctacgccacagcccggctgaagcccaccttcatcagcaaggtgaacacagctgtgcagctgatcctggtggccgccagcctggccgcccctgtgttcaactatgctgacagcatctacctgcagatcctgtggtgcttcaccgccttcaccacagctgccagcgcctacagctactaccactacggcaggaagacagtgcaggtgatcaaggactag

SEQ ID NO: 146287 - DNA, 618 bp, Artificial Sequence
  Description of Artificial Sequence: Synthetic coding sequence
atgctggccctgcgggtggcccggggctcctggggcgccctgcggggagctgcctgggcccctggcacccggcccagcaagaggcgggcctgctgggccctgctgccccctgtgccctgctgcctgggctgcctggccgagcgctggaggctgcggcctgctgccctgggcctgcggctgcccggcatcggccagaggaaccactgcagcggggccggcaaggccgcccccaggcctgctgctggagctggagctgctgctgaggcccctgggggccagtggggccctgccagcacccccagcctgtatgagaacccctggaccatccccaacatgctgtccatgacccgcatcggcctggcccctgtgctgggctacctgatcatcgaggaggacttcaacatcgccctgggcgtgtttgccctggccggcctgacagacctgctggatggcttcatcgccaggaactgggccaaccagaggtctgccctgggcagcgccctggaccccctggccgacaagatcctgatcagcatcctgtatgtgtccctgacctatgctgacctgatcccagccaacacctgccaggtgttccagagcctgctgtgccactgctag

SEQ ID NO: 146288 - DNA, 12210 bp, Artificial Sequence
  Description of Artificial Sequence: Synthetic coding sequence
atggccagccgggacagcaaccacgccggggagagcttcctgggcagtgatggagatgaggaggccacccgggagctggagacagaggaggagagcgagggggaggaggatgaaacagctgctgagagcgaggaggagccagacagccggctgagtgaccaggatgaggagggcaagatcaagcaggagtacatcatcagtgaccccagcttctccatggtgacagtgcagagagaagattctggcatcacctgggagaccaacagcagccgcagcagcaccccctgggccagcgaggagagccagaccagcggcgtgtgcagccgggagggcagcacagtgaacagccccccaggaaatgtgtccttcatcgtggatgaggtgaagaaggtgaggaagaggacccacaagagcaagcacggcagccccagcctgcggaggaagggcaacaggaagagaaattcctttgagagccaggatgtgcccaccaacaagaagggcagccccctgaccagcgccagccaggtgctgaccacagagaaggagaagagctacacaggcatctatgacaaggccaggaagaagaagaccaccagcaacaccccacccatcactggagccatctacaaggagcacaagcccctggtgctgcggcctgtgtacatcggcaccgtgcagtacaagatcaagatgttcaacagcgtgaaggaggagctgatccccctgcagttctacggcaccctgcccaagggctacgtgatcaaggagatccactacaggaagggcaaggatgccagcatcagcctggagccagacctggacaacagcggcagcaacacagtgtccaagaccaggaagctggtggcccagagcattgaggacaaggtgaaggaggtgtttcctccctggaggggggccctgagcaaaggaagtgagagcctgaccctgatgttcagccatgaggaccagaagaagatctatgctgacagccccctgaatgccaccagcgccctggagcacacagtgcccagctacagcagcagcggccgggcagagcagggcatccagctgcggcacagccagagcgtgccccagcagccagaagatgaggccaagccccatgaggtggagccccccagcgtgaccccagacaccccagccaccatgttcctgcggaccaccaaggaggagtgtgagctggccagccctggaacagctgcctctgaaaatgacagctctgtgagccccagctttgccaatgaggtgaagaaggaggatgtgtacagcgcccaccacagcatcagcctggaggccgccagccctggcctggccgccagcacccaggacggcctggaccctgaccaggagcagcctgacctgaccagcattgagcgggcagagcctgtgtctgccaagctgacccccacccaccccagcgtgaagggggagaaggaggagaacatgctggagcccagcatcagcctgtctgagcccctgatgctggaggagcctgagaaggaggagattgagaccagcctgcccatcgccatcaccccagagcctgaggacagcaacctggtggaggaggagatcgtggagctggactacccagagagccccctggtgtctgagaagcccttccccccccacatgagccctgaggtggagcacaaggaggaggagctgatcctgcccctgctggccgccagcagccctgagcacgtggccctgtctgaggaggagcgggaggagatcgcctctgtgtccacaggcagcgcctttgtgtctgagtacagcgtgccccaggacctgaaccacgagctgcaggagcaggagggggagcctgtgccccccagcaatgtggaggccatcgccgagcacgctgtgctgtctgaggaggagaatgaggagtttgaggcctacagccctgctgctgcccccaccagcgagagcagcctgagccccagcaccacagagaagaccagcgagaaccagagccccctcttcagcacagtgaccccagagtacatggtgctgtctggagatgaggccagcgagagcggctgctacaccccagacagcaccagcgccagcgagtacagcgtgcccagcctggccaccaaggagagcctgaagaagaccatcgacaggaagagccccctcatcctgaagggcgtgtctgagtacatgatccccagcgaggagaaggaggacaccggcagcttcaccccagctgtggccccagccagcgagcccagcctgagccccagcaccacagagaagaccagcgagtgccagagccccctgcccagcacagccaccagcgagcacgtggtgcccagcgagggggaggacctgggcagcgagcgcttcaccccagacagcaagctgatcagcaaatatgctgcccccctgaatgccacccaggagagccagaagaagatcatcaatgaggccagccagttcaagcccaagggcatcagcgagcacacagtgctgtctgtggatggcaaggaggtgattggccccagcagcccagacctggtggtggccagcgagcacagcttccccccccacaccacagagatgaccagcgagtgccaggccccacccctgagcgccaccccatctgaatatgtggtgctgagtgatgaggaggccgtggagctggagcgctacacccccagcagcaccagcgccagcgagttctctgtgcccccctatgccaccccagaggcccaggaggaggagatcgtgcacaggagcctgaacctgaagggggccagcagccccatgaacctgtctgaggaggaccaggaggacatcggccccttctccccagattctgcctttgtgtctgagttctccttccccccctatgccacccaggaggccgagaagcgggagtttgaatgtgacagccccatctgcctgaccagccccagcgagcacaccatcctgagtgatgaggacacagaggaggccgagctgttctccccagacagcgccagccaggtgtccatcccccccttccgcatcagcgagacagagaagaatgagctggagccagacagcctgctgacagctgtgtctgccagcggctacagctgcttcagcgaggctgatgaggaggacatcggcagcacagctgccacccctgtgtctgagcagttcagcagcagccagaagcagaaggccgagaccttccccctgatgagccccctggaggacctgagcctgccccccagcacagacaagtctgagaaggccgagatcaagccagagatccccaccaccagcacctctgtgtctgagtacctgatcctggcccagaagcagaagacccaggcctacctggagcctgagagcgaggacctgatccccagccacctgaccagcgaggtggagaagggggagcgggaggccagcagctctgtggccgccatcccagctgccctgcctgcccagagcagcatcgtgaaggaggagaccaagccagccagcccccacagcgtgctgcctgacagcgtgcctgccatcaagaaggagcaggagcccacagctgccctgaccctgaaggctgctgatgagcagatggccctgagcaaggtgaggaaggaggagatcgtgcctgacagccaggaggccacagcccacgtgtcccaggaccagaagatggagccccagccccccaacgtgcctgagagcgagatgaagtacagcgtgctgcctgacatggtggatgagcccaagaagggcgtgaagcccaagctggtgctgaatgtgaccagcgagctggagcagaggaagctgagcaagaatgaacctgaggtgatcaagccctacagccccctgaaggagaccagcctgagcggccctgaggccctgtctgctgtgaagatggagatgaagcatgacagcaagatcaccaccacccccatcgtgctgcacagcgccagcagtggagtggagaagcaggtggagcacggccccccagccctggccttcagcgccctgtctgaggagatcaagaaggagattgagcccagcagcagcaccaccacagcctctgtgaccaagctggacagcaacctgaccagggctgtgaaggaggagatccccacagacagcagcctcatcacccctgtggacaggcctgtgctgaccaaggtgggcaaaggagagctgggcagcggcctgccccccctggtgaccagcgcagatgagcacagcgtgctggccgaggaggacaaggtggccatcaagggggccagccccatcgagaccagcagcaagcacctggcctggagcgaggccgagaaggagatcaagtttgacagcctgcccagcgtgagcagcattgctgagcacagcgtgctgtctgaggtggaggccaaggaggtgaaggccggcctgcctgtgatcaagaccagcagcagccagcacagcgacaagtctgaggaggcccgggtggaggacaagcaggacctgctcttcagcacagtgtgtgacagcgagcggctggtgagcagccagaagaagagcctgatgagcaccagcgaggtgctggagcctgagcacgagctgcccctgagcctgtggggcgagatcaagaagaaggagacagagctgcccagcagccagaatgtgtccccagccagcaagcacatcatccccaagggcaaggatgaggagacagccagcagcagccctgagctggagaacctggccagcggcctggcccccaccctgctgctgctgagtgatgacaagaacaagccagctgtggaggtgagcagcacagcccagggcgacttccccagcgagaagcaggatgtggccctggccgagctgagcctggagcctgagaagaaggacaagccccaccagcccctggagctgcccaatgccggcagcgagttcagcagtgacctgggccggcagagcggcagcatcggcaccaagcaggccaagagccccatcacagaaacagaagattctgtgctggagaagggccctgctgagctgcggagccgggagggcaaggaggagaaccgggagctgtgtgccagcagcaccatgcctgccatcagcgagctgagcagcctgctgcgggaggagagccagaatgaggagatcaagcccttcagccccaagatcatcagcctggagagcaaggagcccccagcctctgtggccgagggcggcaaccctgaggagttccagcccttcaccttcagcctgaagggcctgtctgaggaggtgagccaccctgctgacttcaagaagggcggcaaccaggagatcggccccctgcccccaactggaaacctgaaggcccaggtgatgggagacatcctggacaagctgtctgaggagaccggccaccccaacagcagccaggtgctgcagagcatcacagagcccagcaagatcgcccccagcgacctgctggtggagcagaagaagacagagaaggccctgcacagcgaccagacagtgaagctgcctgatgtgtccaccagcagcgaggacaagcaggacctgggcatcaagcagttcagcctgatgagggagaacctgcccctggagcagagcaagagcttcatgaccaccaagccagcagatgtgaaggagaccaagatggaggagttcttcatcagccccaaggatgagaactggatgctgggcaagccagaaaatgtggccagccagcacgagcagagaattgctggctctgtgcagctggacagcagcagcagcaatgagctgcggcccggccagctgaaggctgctgtgagcagcaaggaccacacctgtgaggtgaggaagcaggtgctgccccacagcgctgaggagagccacctgagcagccaggaggccgtgtctgccctggacaccagcagcggcaacacagagaccctgagcagcaagagctacagcagcgaggaggtgaagctggccgaggagcccaagagcctggtgctggccggaaatgtggagaggaacattgctgagggcaaggagatccacagcctgatggagagcgagagcctgctgctggagaaggccaacacagagctgtcctggcccagcaaggaggacagccaggagaagatcaagctgcccccagagcgcttcttccagaagcctgtgtctggcctgtctgtggagcaggtgaagtctgagaccatcagcagctctgtgaagacagcccacttccctgctgagggcgtggagcccgccctgggcaatgagaaggaggcccacaggagcaccccacccttccctgaggagaagcccctggaggagagcaagatggtgcagagcaaggtgattgatgatgctgatgagggcaagaagcccagccctgaggtgaagatccccacccagaggaagcccatcagcagcatccacgcccgggagccccagagccctgagagccctgaggtgacccagaacccccccacccagcccaaggtggccaagccagacctgcctgaggagaagggcaagaagggcatcagcagcttcaagtcctggatgagcagcctcttcttcggcagcagcaccccagacaacaaggtggccgagcaggaggacctggagacccagcccagccccagcgtggagaaggctgtgacagtgattgatcctgagggcaccatccccaccaacttcaacgtggccgagaagccagctgaccacagcctgtctgaggtgaagctgaagacagcagatgagccccggggcaccctggtgaagtctggagatggccagaatgtgaaggagaagtccatgatcctgagcaatgtggaggacctgcagcagcccaagttcatcagcgaggtgtccagagaagattatggcaagaaggagatcagcggggacagcgaggagatgaacatcaacagcgtggtgaccagcgcagatggagagaacctggagatccagagctacagcctgattggagagaagctggtgatggaggaggccaagaccatcgtgccccctcatgtgacagacagcaagagggtgcagaagccagccatcgccccacccagcaagtggaacatcagcatcttcaaggaggagcccaggagtgaccagaagcagaagagcctgctgagctttgatgtggtggacaaggtgccccagcagcccaagagcgccagcagcaactttgccagcaagaacatcaccaaggagagcgagaagccagagagcatcatcctgcctgtggaggagagcaagggcagcctgattgacttcagcgaggaccggctgaagaaggagatgcagaaccccaccagcctgaagatcagcgaggaggagaccaagctgcggtctgtgagccccacagagaagaaggacaacctggagaacagaagctacaccctggccgagaagaaggtgctggccgagaagcagaacagcgtggcccccctggagctgcgggacagcaatgaaattggcaagacccagatcaccctgggcagccgcagcacagagctgaaggagagcaaggcagatgccatgccccagcacttctaccagaatgaagactacaatgaaagacccaagatcatcgtgggcagcgagaaggagaagggggaggagaaggagaaccaggtgtatgtgctgtctgagggcaagaagcagcaggagcaccagccctacagcgtgaatgtggccgagagcatgagccgggagagtgacatcagcctgggccacagcctgggggagacccagagcttcagcctggtgaaggccacctctgtgacagagaagtctgaggccatgctggccgaggcccaccctgagatccgggaggccaaggctgtgggcacccagccccaccccctggaggagagcaaggtgctggtggagaagaccaagaccttcctgcctgtggccctgagctgcagagatgaaattgagaaccacagcctgagccaggagggcaacctggtgctggagaagagcagccgggacatgccagaccacagcgaggagaaggagcagttccgggagagcgagctgagcaaaggaggctctgtggacatcaccaaggagaccgtgaagcagggcttccaggagaaggctgtgggcacccagccccggcccctggaggagagcaaggtgctggtggagaagaccaagaccttcctgcctgtggtgctgagctgccatgatgaaattgagaaccacagcctgagccaggagggcaacctggtgctggagaagagcagccgggacatgccagaccacagcgaggagaaggagcagttcaaggagagcgagctgtggaagggcggctctgtggacatcaccaaggagagcatgaaggagggcttccccagcaaggagagcgagaggaccctggcccggccctttgatgagaccaagagcagcgagaccccaccctacctgctgagccctgtgaagccccagaccctggccagcggggccagccctgagatcaatgctgtgaagaagaaggagatgcccaggtctgagctgaccccagagcggcacacagtgcacaccatccagaccagcaaggatgacaccagtgatgtgcccaagcagagcgtgctggtgtccaagcaccacctggaggccgctgaggacaccagggtgaaggagcccctgagcagcgccaagagcaactatgcccagttcatcagcaacaccagcgccagcaatgctgacaagatggtgagcaacaaggagatgcccaaggagcctgaggacacctacgccaagggggaggacttcaccgtgaccagcaagccagctggcctgtctgaggaccagaagacagccttcagcatcatcagcgagggctgtgagatcctgaacatccacgccccagccttcatcagcagcattgaccaggaggagagcgagcagatgcaggacaagctggagtacctggaggagaaggccagcttcaagaccatccccctgcctgatgattctgaaacagtggcctgccacaagaccctgaagagccggctggaggatgagaaggtgacccccctgaaggagaacaagcagaaggagacccacaagaccaaggaggagatcagcacagattctgaaacagacctgtccttcatccagcccaccatccccagcgaggaggactactttgagaagtacaccctgattgactacaacatcagcccagaccctgagaagcagaaggccccccagaagctgaatgtggaggagaagctgagcaaggaggtgacagaggagaccatctccttccctgtgtcctctgtggagagcgccctggagcacgagtatgacctggtgaagctggatgagagcttctacggccctgagaagggccacaacatcctgagccaccctgagacccagagccagaacagcgctgacagaaatgtgtccaaggacaccaagagagatgtggacagcaagagccctggcatgcccctgtttgaggccgaggagggcgtgctgagcaggacccagatcttccccaccaccatcaaggtgattgatcctgagttcctggaggagcccccagccctggccttcctgtacaaggacctgtatgaggaggccgtgggggagaagaagaaggaggaggagacagccagcgagggggacagcgtgaacagcgaggccagcttccccagcaggaacagcgacacagatgatggcaccggcatctactttgagaagtacatcctgaaggatgacatcctgcatgacaccagcctgacccagaaggaccagggccagggcctggaggagaagagggtgggcaaggatgacagctaccagcccatcgctgctgagggggagatctggggcaagtttggcaccatctgccgggagaagagcctggaggagcagaagggcgtgtatggagagggggagagcgtggaccacgtggagaccgtgggcaatgtggccatgcagaagaaggcccccatcacagaagatgtgcgggtggccacccagaagatctcctatgctgtgccctttgaggacacccaccacgtgctggagcgggcagatgaagctggcagccacggcaatgaggtgggcaatgccagccctgaggtgaacctgaatgtgcctgtgcaggtgtccttccctgaggaggagtttgccagcggggccacccacgtgcaggagaccagcctggaggagcccaagatcctggtgcccccagagcccagcgaggagcggctgaggaacagccctgtgcaggatgaatatgagttcacagagagcctgcacaatgaggtggtgccccaggacatcctgtctgaggagctgagcagcgagagcaccccagaagatgtgctgagccagggcaaggagagctttgagcacatcagtgaaaatgaatttgccagcgaggccgagcagagcaccccagctgagcagaaggagctgggcagcgagaggaaggaggaggaccagctgagcagcgaggtggtgacagagaaggcccagaaggagctgaagaagagccagattgacacctactgctacacctgcaagtgccccatcagcgccacagacaaggtgtttggcacccacaaggaccacgaggtgtccaccctggacacagccatctctgctgtgaaggtgcagctggccgagttcctggagaacctgcaggagaagagcctgagaattgaggcctttgtgtctgaaattgagagcttcttcaacaccatcgaggagaactgcagcaagaatgagaagaggctggaggagcagaatgaggagatgatgaagaaggtgctggcccagtatgatgagaaggcccagagctttgaggaggtgaagaagaagaagatggagttcctgcacgagcagatggtgcacttcctgcagagcatggacacagccaaggacaccctggagaccatcgtgcgggaggccgaggagctggatgaggccgtgttcctgaccagctttgaggagatcaatgaaaggctgctgagcgccatggagagcacagccagcctggagaagatgcctgctgccttcagcctgtttgagcactatgatgacagcagcgcccggagtgaccagatgctgaagcaggtggccgtgccccagcccccccggctggagccccaggagcccaacagcgccaccagcaccaccatcgctgtgtactggagcatgaacaaggaggatgtgattgacagcttccaggtgtactgcatggaggagccccaggatgaccaggaggtgaatgagctggtggaggagtaccgcctgactgtgaaggagagctactgcatctttgaggacctggagccagaccgctgctaccaggtgtgggtgatggctgtgaacttcaccggctgcagcctgcccagcgagcgggccatcttcagaacagcccccagcacccctgtgatccgggcagaggactgcaccgtgtgctggaacacagccaccatccgctggaggcccaccaccccagaggccacagagacctacaccctggagtactgccggcagcacagccctgagggggagggcctgcgctccttcagcggcatcaagggcctgcagctgaaggtgaacctgcagcccaatgacaactacttcttctacgtgcgggccatcaatgccttcggcaccagcgagcagagcgaggccgccctgatcagcacccggggcacccgcttcctgctgctgcgggagacagcccacccagccctgcacatcagcagcagcggcaccgtcatcagctttggagagcggcggcggctgacagagatccccagcgtgctgggggaggagctgcccagctgtggccagcactactgggagaccaccgtgacagactgcccagcctaccgcctgggcatctgcagcagcagcgctgtgcaggccggggccctgggccagggcgagacctcctggtacatgcactgcagcgagccccagcgctacaccttcttctacagcggcatcgtgtctgatgtgcacgtgacagagaggcctgcccgggtgggcatcctgctggactacaacaaccagaggctcatcttcatcaatgctgagagcgagcagctgctcttcatcatccgccaccgcttcaatgaaggagtgcacccagcctttgccctggagaagccaggcaagtgcaccctgcacctgggcatcgagcccccagattctgtgcgccacaagtag

SEQ ID NO: 146289 - DNA, 678 bp, Artificial Sequence
  Description of Artificial Sequence: Synthetic coding sequence
atggacctgcgggccggggacagctggggcatgctggcctgcctgtgcaccgtgctgtggcacctgcctgctgtgcctgccctgaacagaactggagaccccggccctggccccagcatccagaagacctatgacctgacccgctacctggagcaccagctgcggagcctggccggcacctacctgaactacctgggcccccccttcaatgaaccagacttcaaccccccccggctgggcgctgagaccctgccccgggccaccgtggacctggaggtgtggaggagcctgaatgacaagctgcggctgacccagaactatgaggcctacagccacctgctgtgctacctgcggggcctgaaccggcaggccgccacagctgagctgcggcgcagcctggcccacttctgcaccagcctgcagggcctgctgggcagcattgctggggtgatggccgccctgggctaccccctgccccagcccctgcctggaacagagcccacctggaccccaggccctgcccacagcgacttcctgcagaagatggatgacttctggctgctgaaggagctgcagacctggctgtggaggtctgccaaggacttcaaccggctgaagaagaagatgcagcccccagctgctgctgtgaccctgcacctgggcgcccacggcttctag

SEQ ID NO: 146290 - DNA, 648 bp, Artificial Sequence
  Description of Artificial Sequence: Synthetic coding sequence
atgctggcctgcctgtgcaccgtgctgtggcacctgcctgctgtgcctgccctgaacagaactggagaccccggccctggccccagcatccagaagacctatgacctgacccgctacctggagcaccagctgcggagcctggccggcacctacctgaactacctgggcccccccttcaatgaaccagacttcaaccccccccggctgggcgctgagaccctgccccgggccaccgtggacctggaggtgtggaggagcctgaatgacaagctgcggctgacccagaactatgaggcctacagccacctgctgtgctacctgcggggcctgaaccggcaggccgccacagctgagctgcggcgcagcctggcccacttctgcaccagcctgcagggcctgctgggcagcattgctggggtgatggccgccctgggctaccccctgccccagcccctgcctggaacagagcccacctggaccccaggccctgcccacagcgacttcctgcagaagatggatgacttctggctgctgaaggagctgcagacctggctgtggaggtctgccaaggacttcaaccggctgaagaagaagatgcagcccccagctgctgctgtgaccctgcacctgggcgcccacggcttctag

SEQ ID NO: 146291 - DNA, 648 bp, Artificial Sequence; identical to SEQ ID NO: 146290
  Description of Artificial Sequence: Synthetic coding sequence

SEQ ID NO: 146292 - DNA, 1881 bp, Artificial Sequence
  Description of Artificial Sequence: Synthetic coding sequence
atgctggcctttgctgccaggacagtggtgaagcccctgggcttcctgaagcccttcagcctgatgaaggccagcagccgcttcaaggcccaccaggatgccctgccccggctgcctgtgccccccctgcagcagagcctggaccactacctgaaggccctgcagcccatcgtgtctgaggaggagtgggcccacaccaagcagctggtggatgagttccaggccagcggcggcgtgggggagcggctgcagaagggcctggagcggcgggccaggaagacagagaactggctgtctgagtggtggctgaagacagcctacctgcagtaccggcagcctgtggtgatctacagcagccctggggtgatgctgcccaagcaggactttgtggacctgcagggccagctgcgctttgctgccaagctgattgaaggagtgctggacttcaaggtgatgattgacaatgagaccctgcctgtggagtacctgggcggcaagcccctgtgcatgaaccagtactaccagatcctgagcagctgccgggtgcccggccccaagcaggacacagtgagcaacttcagcaagaccaagaagccacccacccacatcaccgtggtgcacaactaccagttctttgagctggatgtgtaccacagtgatggcacccccctgacagctgaccagatctttgtgcagctggagaagatctggaacagcagcctgcagaccaacaaggagcctgtgggcatcctgaccagcaaccacaggaacagctgggccaaggcctacaacaccctcatcaaggacaaggtgaacagagattctgtgcgcagcatccagaagagcatcttcaccgtgtgcctggatgccaccatgccccgggtgtctgaagatgtgtaccgcagccacgtggccggccagatgctgcacggcggcggcagccggctgaacagcggcaaccgctggtttgacaagaccctgcagttcatcgtggctgaagatggcagctgtggcctggtgtatgaacatgctgctgctgagggcccccccatcgtgaccctgctggactatgtgattgagtacaccaagaagccagagctggtgcgcagccccctggtgcccctgcccatgcccaagaagctgcgcttcaacatcaccccagagatcaagagtgacatcgagaaggccaagcagaacctgagcatcatgatccaggacctggacatcaccgtgatggtgttccaccactttgggaaggacttccccaagtctgagaagctgagcccagatgccttcatccagatggccctgcagctggcctactaccgcatctacggccaggcctgtgccacctatgagagcgccagcctgaggatgttccacctgggccgcacagacaccatccgcagcgcctccatggacagcctgacctttgtgaaggccatggatgacagctctgtgacagagcaccagaaggtggagctgctgaggaaggctgtgcaggcccaccggggctacacagaccgggccatccggggggaggcctttgacagacacctgctgggcctgaagctgcaggccatcgaggacctggtgtccatgccagacatcttcatggacaccagctatgccatcgccatgcacttccacctgagcaccagccaggtgcctgccaagacagactgtgtgatgttcttcggccctgtggtgcctgatggctacggcgtgtgctacaaccccatggaggcccacatcaacttcagcctgagcgcctacaacagctgtgccgagaccaatgctgcccggctggcccactacctggagaaggccctgctggacatgagggccctgctgcagagccacccccgggccaagctgtag

SEQ ID NO: 146293 - DNA, 1638 bp, Artificial Sequence
  Description of Artificial Sequence: Synthetic coding sequence
atgctggcctttgctgccaggacagtggtgaagcccctgggcttcctgaagcccttcagcctgatgaaggccagcagccgcttcaaggcccaccaggatgccctgccccggctgcctgtgccccccctgcagcagagcctggaccactacctgaaggccctgcagcccatcgtgtctgaggaggagtgggcccacaccaagcagctggtggatgagttccaggccagcggcggcgtgggggagcggctgcagaagggcctggagcggcgggccaggaagacagagaactggctgtctgagtggtggctgaagacagcctacctgcagtaccggcagcctgtggtgatctacagcagccctggggtgatgctgcccaagcaggactttgtggacctgcagggccagctgcgctttgctgccaagctgattgaaggagtgctggacttcaaggtgatgattgacaatgagaccctgcctgtggagtacctgggcggcaagcccctgtgcatgaaccagtactaccagatcctgagcagctgccgggtgcccggccccaagcaggacacagtgagcaacttcagcaagaccaagaagccacccacccacatcaccgtggtgcacaactaccagttctttgagctggatgtgtaccacagtgatggcacccccctgacagctgaccagatctttgtgcagctggagaagatctggaacagcagcctgcagaccaacaaggagcctgtgggcatcctgaccagcaaccacaggaacagctgggccaaggcctacaacaccctcatcaaggacaaggtgaacagagattctgtgcgcagcatccagaagaagaagccagagctggtgcgcagccccctggtgcccctgcccatgcccaagaagctgcgcttcaacatcaccccagagatcaagagtgacatcgagaaggccaagcagaacctgagcatcatgatccaggacctggacatcaccgtgatggtgttccaccactttgggaaggacttccccaagtctgagaagctgagcccagatgccttcatccagatggccctgcagctggcctactaccgcatctacggccaggcctgtgccacctatgaaagtgccagcctgaggatgttccacctgggccgcacagacaccatccgcagcgcctccatggacagcctgacctttgtgaaggccatggatgacagctctgtgacagagcaccagaaggtggagctgctgaggaaggctgtgcaggcccaccggggctacacagaccgggccatccggggggaggcctttgacagacacctgctgggcctgaagctgcaggccatcgaggacctggtgtccatgccagacatcttcatggacaccagctatgccatcgccatgcacttccacctgagcaccagccaggtgcctgccaagacagactgtgtgatgttctttggacctgtggtgcctgatggctatggagtgtgctacaaccccatggaggcccacatcaacttcagcctgagcgcctacaacagctgtgccgagaccaatgctgcccggctggcccactacctggagaaggccctgctggacatgagggccctgctgcagagccacccccgggccaagctgtag

SEQ ID NO: 146294 - DNA, 2322 bp, Artificial Sequence
  Description of Artificial Sequence: Synthetic coding sequence
atggccgaggcccaccaggccgtggccttccagttcaccgtgaccccagatggcatcgacctgcggctgagccatgaggccctgcggcagatctacctgagcggcctgcacagctggaagaagaagttcatccgcttcaagaatggcatcatcaccggggtgtacccagccagccccagctcctggctgattgtggtggtgggcgtgatgaccaccatgtatgccaagattgaccccagcctgggcatcatcgccaagatcaacagaaccctggagacagccaactgcatgagcagccagaccaagaatgtggtgtctggagtgctgtttggcaccggcctgtgggtggccctgattgtgaccatgagatacagcctgaaggtgctgctgagctaccacggctggatgttcacagagcacggcaagatgagccgggccaccaagatctggatgggcatggtgaagatcttcagcggcaggaagcccatgctgtacagcttccagaccagcctgccccggctgcctgtgcctgctgtgaaggacacagtgaaccgctacctgcagagcgtgcggcccctgatgaaggaggaggacttcaagaggatgacagccctggcccaggactttgctgtgggcctgggcccccggctgcagtggtacctgaagctgaagtcctggtgggccaccaactacgtgtctgactggtgggaggagtacatctacctgcggggccggggccccctgatggtgaacagcaactactatgccatggacctgctgtacatcctgcccacccacatccaggccgcccgggctggaaatgccatccacgccatcctgctgtacagaaggaagctggaccgggaggagatcaagcccatccggctgctgggcagcaccatccccctgtgcagcgcccagtgggagaggatgttcaacaccagccgcatccctggagaggagacagacaccatccagcacatgagggacagcaagcacatcgtggtgtaccaccggggccgctacttcaaggtgtggctgtaccatgatggccgcctgctgaagccccgggagatggagcagcagatgcagaggatcctggacaacaccagcgagccccagcctggagaggcccggctggccgccctgacagctggggacagagtgccctgggcccgctgccggcaggcctacttcggccggggcaagaacaagcagagcctggatgctgtggagaaggccgccttctttgtgaccctggatgaaacagaggagggctacagaagtgaggaccctgacacctccatggacagctatgccaagagcctgctgcacggccgctgctatgaccgctggtttgacaagagcttcacctttgtggtgttcaagaatggcaagatgggcctgaatgctgagcacagctgggcagatgcccccatcgtggcccacctgtgggagtatgtgatgagcattgacagcctgcagctgggctatgcagaagatggccactgcaagggggacatcaaccccaacatcccctaccccacccggctgcagtgggacatccctggagagtgccaggaggtgattgagaccagcctgaacacagccaacctgctggccaatgatgtggacttccacagcttcccctttgtggccttcggcaagggcatcatcaagaagtgcaggaccagcccagatgcctttgtgcagctggccctgcagctggcccactacaaggacatgggcaagttctgcctgacctatgaggcctccatgaccaggctcttccgggagggccgcacagagaccgtgcgcagctgcaccacagagagctgtgactttgtgcgggccatggtggaccctgcccagacagtggagcagaggctgaagctgttcaagctggccagcgagaagcaccagcacatgtaccgcctggccatgactggaagtggcatcgacagacacctgttctgcctgtatgtggtgtccaagtacctggccgtggagagccccttcctgaaggaggtgctgtctgagccctggaggctgagcaccagccagaccccccagcagcaggtggagctgtttgacctggagaacaacccagaatatgtgagcagcggcggcggcttcggccctgtggctgatgatggctacggcgtgtcctacatcctggtgggagaaaatctcatcaacttccacatcagcagcaagttcagctgcccagagacagacagccaccgcttcggccgccacctgaaggaggccatgacagacatcatcaccctgtttggcctgagcagcaacagcaagaagtag

SEQ ID NO: 146295 - DNA, 2271 bp, Artificial Sequence
  Description of Artificial Sequence: Synthetic coding sequence
atggccgaggcccaccaggccgtggccttccagttcaccgtgaccccagatggcatcgacctgcggctgagccatgaggccctgcggcagatctacctgagcggcctgcacagctggaagaagaagttcatccgcttcaagaatggcatcatcaccggggtgtacccagccagccccagctcctggctgattgtggtggtgggcgtgatgaccaccatgtatgccaagattgaccccagcctgggcatcatcgccaagatcaacagaaccctggagacagccaactgcatgagcagccagaccaagaatgtggtgtctggagtgctgtttggcaccggcctgtgggtggccctgattgtgaccatgagatacagcctgaaggtgctgctgagctaccacggctggatgttcacagagcacggcaagatgagccgggccaccaagatctggatgggcatggtgaagatcttcagcggcaggaagcccatgctgtacagcttccagaccagcctgccccggctgcctgtgcctgctgtgaaggacacagtgaaccgctacctgcagagcgtgcggcccctgatgaaggaggaggacttcaagaggatgacagccctggcccaggactttgctgtgggcctgggcccccggctgcagtggtacctgaagctgaagtcctggtgggccaccaactacgtgtctgactggtgggaggagtacatctacctgcggggccggggccccctgatggtgaacagcaactactatgccatggacctgctgtacatcctgcccacccacatccaggccgcccgggctggaaatgccatccacgccatcctgctgtacagaaggaagctggaccgggaggagatcaagcccatccggctgctgggcagcaccatccccctgtgcagcgcccagtgggagaggatgttcaacaccagccgcatccctggagaggagacagacaccatccagcacatgagggacagcaagcacatcgtggtgtaccaccggggccgctacttcaaggtgtggctgtaccatgatggccgcctgctgaagccccgggagatggagcagcagatgcagaggatcctggacaacaccagcgagccccagcctggagaggcccggctggccgccctgacagctggggacagagtgccctgggcccgctgccggcaggcctacttcggccggggcaagaacaagcagagcctggatgctgtggagaaggccgccttctttgtgaccctggatgaaacagaggagggctacagaagtgaggaccctgacacctccatggacagctatgccaagagcctgctgcacggccgctgctatgaccgctggtttgacaagagcttcacctttgtggtgttcaagaatggcaagatgggcctgaatgctgagcacagctgggcagatgcccccatcgtggcccacctgtgggagtatgtgatgagcattgacagcctgcagctgggctatgcagaagatggccactgcaagggggacatcaaccccaacatcccctaccccacccggctgcagtgggacatccctggagagtgccaggaggtgattgagaccagcctgaacacagccaacctgctggccaatgatgtggacttccacagcttcccctttgtggccttcggcaagggcatcatcaagaagtgcaggaccagcccagatgcctttgtgcagctggccctgcagctggcccactacaaggacatgggcaagttctgcctgacctatgaggcctccatgaccaggctcttccgggagggccgcacagagaccgtgcgcagctgcaccacagagagctgtgactttgtgcgggccatggtggaccctgcccagacagtggagcagaggctgaagctgttcaagctggccagcgagaagcaccagcacatgtaccgcctggccatgactggaagtggcatcgacagacacctgttctgcctgtatgtggtgtccaagtacctggccgtggagagccccttcctgaaggaggtgctgtctgagccctggaggctgagcaccagccagaccccccagcagcaggtggagctgtttgacctggagaacaacccagaatatgtgagcagcggcggcggcttcggccctgtggctgatgatggctacggcgtgtcctacatcctggtgggagaaaatctcatcaacttccacatcagcagcaagttcagctgcccagagaccggcatcatcagccagggccccagcagtgacacctag

SEQ ID NO: 146296 - DNA, 2322 bp, Artificial Sequence; identical to SEQ ID NO: 146294
  Description of Artificial Sequence: Synthetic coding sequence

SEQ ID NO: 146297 - DNA, 2322 bp, Artificial Sequence; identical to SEQ ID NO: 146294
  Description of Artificial Sequence: Synthetic coding sequence

SEQ ID NO: 146298 - DNA, 2271 bp, Artificial Sequence; identical to SEQ ID NO: 146295
  Description of Artificial Sequence: Synthetic coding sequence

SEQ ID NO: 146299 - DNA, 2319 bp, Artificial Sequence
  Description of Artificial Sequence: Synthetic coding sequence
atggccgaggcccaccaggccgtggccttccagttcaccgtgaccccagatggagtggacttccggctgagccgggaggccctgaagcacgtgtacctgagcggcatcaacagctggaagaagaggctcatccgcatcaagaatggcatcctgcggggcgtgtacccaggcagccccacctcctggctggtggtgatcatggccaccgtgggcagcagcttctgcaatgtggacatcagcctgggcctggtgtcctgcatccagcgctgcctgccccagggctgcggcccctaccagaccccccagacccgggccctgctgtccatggccatcttcagcactggagtgtgggtgacaggcatcttcttcttccggcagaccctgaagctgctgctgtgctaccacggctggatgtttgagatgcacggcaagaccagcaacctgacccgcatctgggccatgtgcatccggctgctgagcagccgccaccccatgctgtacagcttccagaccagcctgcccaagctgcctgtgccccgggtgtctgccaccatccagcgctacctggagagcgtgcggcccctgctggatgatgaggagtactacaggatggagctgctggccaaggagttccaggacaagacagccccccggctgcagaagtacctggtgctgaagtcctggtgggccagcaactacgtgtctgactggtgggaggagtacatctacctgcggggccgcagccccctgatggtgaacagcaactactacgtgatggacctggtgctgatcaagaacacagatgtgcaggccgcccggctgggcaacatcatccacgccatgatcatgtacagaaggaagctggaccgggaggagatcaagcctgtgatggccctgggcatcgtgcccatgtgcagctaccagatggagaggatgttcaacaccacccgcatccctgggaaggacacagatgtgctgcagcacctgagtgacagccgccacgtggccgtgtaccacaagggccgcttcttcaagctgtggctgtatgaaggagcccggctgctgaagccccaggacctggagatgcagttccagaggatcctggatgaccccagccccccccagcccggggaggagaagctggccgccctgacagctgggggccgggtggagtgggcccaggcccggcaggccttcttcagcagcggcaagaacaaggccgccctggaggccatcgagagagctgccttctttgtggccctggatgaggagagctacagctatgaccctgaagatgaggccagcctgagcctgtatggcaaggccctgctgcacggcaactgctacaaccgctggtttgacaagagcttcaccctcatctccttcaagaatggccagctgggcctgaatgctgagcacgcctgggcagatgcccccatcatcggccacctgtgggagtttgtgctgggcacagacagcttccacctgggctacacagaaacaggccactgcctgggcaagcccaacccagccctggccccacccacccggctgcagtgggacatccccaagcagtgccaggccgtcatcgagagcagctaccaggtggccaaggccctggctgatgatgtggagctgtactgcttccagttcctgccctttgggaagggcctcatcaagaagtgcaggaccagcccagatgcctttgtgcagatcgccctgcagctggcccacttccgggaccggggcaagttctgcctgacctatgaggcctccatgaccaggatgttccgggagggccgcacagagaccgtgcgcagctgcaccagcgagagcacagcctttgtgcaggccatgatggagggcagccacaccaaggctgacctgcgggacctcttccagaaggccgccaagaagcaccagaacatgtaccgcctggccatgactggagctggcatcgacagacacctgttctgcctgtacctggtgtccaagtacctgggcgtgagcagccccttcctggccgaggtgctgtctgagccctggaggctgagcaccagccagatcccccagagccagatccgcatgtttgatcctgagcagcaccccaaccacctgggcgctgggggcggcttcggccctgtggctgatgatggctacggcgtgtcctacatgattgctggggagaacaccatcttcttccacatcagcagcaagttcagcagcagcgagaccaatgcccagcgcttcggcaaccacatcaggaaggccctgctggacattgctgacctcttccaggtgcccaaggcctacagctag

SEQ ID NO: 146300 - DNA, 2319 bp, Artificial Sequence; identical to SEQ ID NO: 146299
  Description of Artificial Sequence: Synthetic coding sequence

SEQ ID NO: 146301 - DNA, 2319 bp, Artificial Sequence; identical to SEQ ID NO: 146299
  Description of Artificial Sequence: Synthetic coding sequence

SEQ ID NO: 146302 - DNA, 2319 bp, Artificial Sequence; identical to SEQ ID NO: 146299
  Description of Artificial Sequence: Synthetic coding sequence

SEQ ID NO: 146303 - DNA, 378 bp, Artificial Sequence
  Description of Artificial Sequence: Synthetic coding sequence
atggccgaggcccaccaggccgtggccttccagttcaccgtgaccccagatggagtggacttccggctgagccgggaggccctgaagcacgtgtacctgagcggcatcaacagctggaagaagaggctcatccgcatcaagaatggcatcctgcggggcgtgtacccaggcagccccacctcctggctggtggtgatcatggccaccgtgggcagcagcttctgcaatgtggacatcagcctgggcctggtgtcctgcatccagcgctgcctgccccagggctgcggcccctaccagaccccccagacccgggccctgctgtccatggccatcttcagcactggagtgtgggtgacaggcatcttcttcttcagatag

SEQ ID NO: 146304 - DNA, 1704 bp, Artificial Sequence
  Description of Artificial Sequence: Synthetic coding sequence
atggagctgctggccaaggagttccaggacaagacagccccccggctgcagaagtacctggtgctgaagtcctggtgggccagcaactacgtgtctgactggtgggaggagtacatctacctgcggggccgcagccccctgatggtgaacagcaactactacgtgatggacctggtgctgatcaagaacacagatgtgcaggccgcccggctgggcaacatcatccacgccatgatcatgtacagaaggaagctggaccgggaggagatcaagcctgtgatggccctgggcatcgtgcccatgtgcagctaccagatggagaggatgttcaacaccacccgcatccctgggaaggacacagatgtgctgcagcacctgagtgacagcagacatgtggccgtgtaccacaagggccgcttcttcaagctgtggctgtatgagggcgcccggctgctgaagccccaggacctggagatgcagttccagaggatcctggatgaccccagccccccccagcctggagaggagaagctggccgccctgacagctgggggccgggtggagtgggcccaggcccggcaggccttcttcagcagcggcaagaacaaggccgccctggaggccatcgagcgggccgccttctttgtggccctggatgaggagagctacagctatgaccctgaagatgaggccagcctgagcctgtatggcaaggccctgctgcacggcaactgctacaaccgctggtttgacaagagcttcaccctcatctccttcaagaatggccagctgggcctgaatgctgagcacgcctgggcagatgcccccatcatcggccacctgtgggagtttgtgctgggcacagacagcttccacctgggctacacagagaccggccactgcctgggcaagcccaacccagccctggccccacccacccggctgcagtgggacatccccaagcaggccgtgattgagagcagctaccaggtggccaaggccctggctgatgatgtggagctgtactgcttccagttcctgccctttgggaagggcctcatcaagaagtgcaggaccagcccagatgcctttgtgcagatcgccctgcagctggcccacttccgggaccggggcaagttctgcctgacctatgaggcctccatgaccaggatgttccgggagggccgcacagaaacagtgcgcagctgcaccagcgagagcacagcctttgtgcaggccatgatggagggcagccacaccaaggctgacctgcgggacctcttccagaaggccgccaagaagcaccagaacatgtaccgcctggccatgaccggggccggcatcgacagacacctgttctgcctgtacctggtgtccaagtacctgggcgtgagcagccccttcctggccgaggtgctgtctgagccctggaggctgagcaccagccagatcccccagagccagatccgcatgtttgatcctgagcagcaccccaaccacctgggcgccggcggcggctttggacctgtggctgatgatggctatggagtgtcctacatgattgctggggagaacaccatcttcttccacatcagcagcaagttcagcagcagcgagaccaatgcccagagatttggaaaccacatcaggaaggccctgctggacattgctgacctcttccaggtgcccaaggcctacagctag

SEQ ID NO: 146305 - DNA, 2076 bp, Artificial Sequence
  Description of Artificial Sequence: Synthetic coding sequence
atggccgaggcccaccaggccgtggccttccagttcaccgtgaccccagatggagtggacttccggctgagccgggaggccctgaagcacgtgtacctgagcggcatcaacagctggaagaagaggctcatccgcatcaagaatggcatcctgcggggcgtgtacccaggcagccccacctcctggctggtggtgatcatggccaccgtgggcagcagcttctgcaatgtggacatcagcctgggcctggtgtcctgcatccagcgctgcctgccccagggctgcggcccctaccagaccccccagacccgggccctgctgtccatggccatcttcagcactggagtgtgggtgacaggcatcttcttcttccggcagaccctgaagctgctgctgtgctaccacggctggatgtttgagatgcacggcaagaccagcaacctgacccgcatctgggccatgtgcatccggctgctgagcagccgccaccccatgctgtacagcttccagaccagcctgcccaagctgcctgtgccccgggtgtctgccaccatccagcgctacctggagagcgtgcggcccctgctggatgatgaggagtactacaggatggagctgctggccaaggagttccaggacaagacagccccccggctgcagaagtacctggtgctgaagtcctggtgggccagcaactacgtgtctgactggtgggaggagtacatctacctgcggggccgcagccccctgatggtgaacagcaactactacgtgatggacctggtgctgatcaagaacacagatgtgcaggccgcccggctgggcaacatcatccacgccatgatcatgtacagaaggaagctggaccgggaggagatcaagcctgtgatggccctgggcatcgtgcccatgtgcagctaccagatggagaggatgttcaacaccacccgcatccctgggaaggacacagatgtgctgcagcacctgagtgacagccgccacgtggccgtgtaccacaagggccgcttcttcaagctgtggctgtatgaaggagcccggctgctgagcctgtatggcaaggccctgctgcacggcaactgctacaaccgctggtttgacaagagcttcaccctcatctccttcaagaatggccagctgggcctgaatgctgagcacgcctgggcagatgcccccatcatcggccacctgtgggagtttgtgctgggcacagacagcttccacctgggctacacagagaccggccactgcctgggcaagcccaacccagccctggccccacccacccggctgcagtgggacatccccaagcagtgccaggccgtgattgagagcagctaccaggtggccaaggccctggctgatgatgtggagctgtactgcttccagttcctgccctttgggaagggcctcatcaagaagtgcaggaccagcccagatgcctttgtgcagatcgccctgcagctggcccacttccgggaccggggcaagttctgcctgacctatgaggcctccatgaccaggatgttccgggagggccgcacagaaacagtgcgcagctgcaccagcgagagcacagcctttgtgcaggccatgatggagggcagccacaccaaggctgacctgcgggacctcttccagaaggccgccaagaagcaccagaacatgtaccgcctggccatgaccggggccggcatcgacagacacctgttctgcctgtacctggtgtccaagtacctgggcgtgagcagccccttcctggccgaggtgctgtctgagccctggaggctgagcaccagccagatcccccagagccagatccgcatgtttgatcctgagcagcaccccaaccacctgggcgccggcggcggctttggacctgtggctgatgatggctatggagtgtcctacatgattgctggggagaacaccatcttcttccacatcagcagcaagttcagcagcagcgagaccaatgcccagagatttggaaaccacatcaggaaggccctgctggacattgctgacctcttccaggtgcccaaggcctacagctag

SEQ ID NO: 146306 - DNA, 2217 bp, Artificial Sequence
  Description of Artificial Sequence: Synthetic coding sequence
atggccgaggcccaccaggccgtggccttccagttcaccgtgaccccagatggagtggacttccggctgagccgggaggccctgaagcacgtgtacctgagcggcatcaacagctggaagaagaggctcatccgcatcaagaatggcatcctgcggggcgtgtacccaggcagccccacctcctggctggtggtgatcatggccaccgtgggcagcagcttctgcaatgtggacatcagcctgggcctggtgtcctgcatccagcgctgcctgccccagggctgcggcccctaccagaccccccagacccgggccctgctgtccatggccatcttcagcactggagtgtgggtgacaggcatcttcttcttccggcagaccctgaagctgctgctgtgctaccacggctggatgtttgagatgcacggcaagaccagcaacctgacccgcatctgggcctacctggagagcgtgcggcccctgctggatgatgaggagtactacaggatggagctgctggccaaggagttccaggacaagacagccccccggctgcagaagtacctggtgctgaagtcctggtgggccagcaactacgtgtctgactggtgggaggagtacatctacctgcggggccgcagccccctgatggtgaacagcaactactacgtgatggacctggtgctgatcaagaacacagatgtgcaggccgcccggctgggcaacatcatccacgccatgatcatgtacagaaggaagctggaccgggaggagatcaagcctgtgatggccctgggcatcgtgcccatgtgcagctaccagatggagaggatgttcaacaccacccgcatccctgggaaggacacagatgtgctgcagcacctgagtgacagccgccacgtggccgtgtaccacaagggccgcttcttcaagctgtggctgtatgaaggagcccggctgctgaagccccaggacctggagatgcagttccagaggatcctggatgaccccagccccccccagcccggggaggagaagctggccgccctgacagctgggggccgggtggagtgggcccaggcccggcaggccttcttcagcagcggcaagaacaaggccgccctggaggccatcgagagagctgccttctttgtggccctggatgaggagagctacagctatgaccctgaagatgaggccagcctgagcctgtatggcaaggccctgctgcacggcaactgctacaaccgctggtttgacaagagcttcaccctcatctccttcaagaatggccagctgggcctgaatgctgagcacgcctgggcagatgcccccatcatcggccacctgtgggagtttgtgctgggcacagacagcttccacctgggctacacagaaacaggccactgcctgggcaagcccaacccagccctggccccacccacccggctgcagtgggacatccccaagcagtgccaggccgtcatcgagagcagctaccaggtggccaaggccctggctgatgatgtggagctgtactgcttccagttcctgccctttgggaagggcctcatcaagaagtgcaggaccagcccagatgcctttgtgcagatcgccctgcagctggcccacttccgggaccggggcaagttctgcctgacctatgaggcctccatgaccaggatgttccgggagggccgcacagagaccgtgcgcagctgcaccagcgagagcacagcctttgtgcaggccatgatggagggcagccacaccaaggctgacctgcgggacctcttccagaaggccgccaagaagcaccagaacatgtaccgcctggccatgactggagctggcatcgacagacacctgttctgcctgtacctggtgtccaagtacctgggcgtgagcagccccttcctggccgaggtgctgtctgagccctggaggctgagcaccagccagatcccccagagccagatccgcatgtttgatcctgagcagcaccccaaccacctgggcgctgggggcggcttcggccctgtggctgatgatggctacggcgtgtcctacatgattgctggggagaacaccatcttcttccacatcagcagcaagttcagcagcagcgagaccaatgcccagcgcttcggcaaccacatcaggaaggccctgctggacattgctgacctcttccaggtgcccaaggcctacagctag

SEQ ID NO: 146307 - DNA, 1458 bp, Artificial Sequence
  Description of Artificial Sequence: Synthetic coding sequence
atgctgttctcctaccagaggagcctgccccggcagcctgtgcccagcgtgcaggacacagtgaggaagtacctggagagcgtgcggcccatcctgagtgatgaagattttgactggacagctgtgctggcccaggagttcctgcggctgcaggccagcctgctgcagtggtacctgcggctgaagtcctggtgggccagcaactacgtgtctgactggtgggaggagtttgtgtacctgcggagcaggaaccccctgatggtgaacagcaactactacatgatggacttcctgtatgtgacccccacccccctgcaggccgcccgggctggaaatgctgtgcacgccctgctgctgtaccgccaccggctgaaccggcaggagatcccccctgtgcggggcccccagtgggtgagagatggcggcgtggtgctgtggcccctgggccacgtgggccctggccggcagctgacagcccacggcttcctgcagaccctgctgatgggcatgaggcccctgtgcagcgcccagtatgagaagatcttcaacaccacccgcatccctggggtgcagaaggactacatccgccacctgcatgacagccagcacgtggccgtgttccaccggggccgcttcttcaggatgggcacccacagcaggaacagcctgctgagcccccgggccctggagcagcagttccagaggatcctggatgaccccagccctgcctgcccccatgaggagcacctggccgccctgacagctgccccccggggcacctgggcccaggtgaggaccagcctgaagacccaggccgctgaggccctggaggccgtggagggcgccgccttctttgtgtccctggatgctgagcctgctggcctgacccgggaggaccctgctgccagcctggatgcctatgcccacgccctgctggccggccggggccatgaccgctggtttgacaagagcttcaccctcatcgtgttcagcaatggcaagctgggcctgtctgtggagcacagctgggccgactgccccatcagcggccacatgtgggagttcaccctggccacagagtgcttccagctgggctacagcacagatggccactgcaagggccacccagaccccaccctgccccagccccagaggctgcagtgggacctgcctgaccagatccacagcagcatcagcctggccctgcggggggccaagatcctgtctgaaaatgtggactgccacgtggtgcccttcagcctgtttgggaagagcttcatccgccgctgccacctgagcagtgacagcttcatccagatcgccctgcagctggcccacttccgggtgtcctgggtgccccacccccagcccccccagggcctgagccccccagagccccccaggcctgccccaccccgcttcctggtggtggccgccatcgtgggccggcccagctag

SEQ ID NO: 146308 - DNA, 2412 bp, Artificial Sequence
  Description of Artificial Sequence: Synthetic coding sequence
atggccgaggcccaccaggccgtgggcttccggcccagcctgaccagtgatggagctgaggtggagctgagcgcccctgtgctgcaggagatctacctgagcggcctgcgctcctggaagaggcacctgagccgcttctggaatgacttcctgactggagtcttccctgccagccccctgtcctggctgttcctgttcagcgccatccagctggcctggttcctgcagctggaccccagcctgggcctgatggagaagatcaaggagctgctgcctgactggggcggccagcaccacggcctgcggggcgtgctggccgccgccctgtttgccagctgcctgtggggcgccctgatcttcaccctgcacgtggccctgcggctgctgctgagctaccacggctggctgctggagccccacggggccatgagcagccccaccaagacctggctggccctggtgcgcatcttcagcggccgccaccccatgctgttctcctaccagaggagcctgccccggcagcctgtgcccagcgtgcaggacacagtgaggaagtacctggagagcgtgcggcccatcctgagtgatgaagattttgactggacagctgtgctggcccaggagttcctgcggctgcaggccagcctgctgcagtggtacctgcggctgaagtcctggtgggccagcaactacgtgtctgactggtgggaggagtttgtgtacctgcggagcaggaaccccctgatggtgaacagcaactactacatgatggacttcctgtatgtgacccccacccccctgcaggccgcccgggctggaaatgctgtgcacgccctgctgctgtaccgccaccggctgaaccggcaggagatcccccccaccctgctgatgggcatgaggcccctgtgcagcgcccagtatgagaagatcttcaacaccacccgcatccctggggtgcagaaggactacatccgccacctgcatgacagccagcacgtggccgtgttccaccggggccgcttcttcaggatgggcacccacagcaggaacagcctgctgagcccccgggccctggagcagcagttccagaggatcctggatgaccccagccctgcctgcccccatgaggagcacctggccgccctgacagctgccccccggggcacctgggcccaggtgaggaccagcctgaagacccaggccgctgaggccctggaggccgtggagggcgccgccttctttgtgtccctggatgctgagcccgccggcctgaccagagaagatcctgctgccagcctggatgcctatgcccacgccctgctggccggccggggccatgaccgctggtttgacaagagcttcaccctgattgtgttcagcaatggcaagctgggcctgtctgtggagcacagctgggccgactgccccatcagcggccacatgtgggagttcaccctggccacagagtgcttccagctgggctacagcacagatggccactgcaagggccacccagaccccaccctgccccagccccagaggctgcagtgggacctgcctgaccagatccacagcagcatcagcctggccctgcggggggccaagatcctgtctgaaaatgtggactgccacgtggtgcccttcagcctgtttgggaagagcttcatccgccgctgccacctgagcagtgacagcttcatccagatcgccctgcagctggcccacttccgggaccggggccagttctgcctgacctatgagagcgccatgaccaggctcttcctggagggccgcacagaaacagtgcgcagctgcacccgggaggcctgcaactttgtgcgggccatggaggacaaggagaagacagacccccagtgcctggccctcttccgggtggccgtggacaagcaccaggccctgctgaaggccgccatgagcggccagggcgtggacagacacctgtttgccctgtacatcgtgagccgcttcctgcacctgcagagccccttcctgacccaggtgcacagcgagcagtggcagctgagcaccagccagatccctgtgcagcagatgcacctgtttgatgtgcacaactacccagactatgtgtcctctgggggcggctttggaccagcagatgaccacggctatggagtgtcctacatcttcatgggagatggcatgatcaccttccacatcagcagcaagaagagcagcaccaagacagacagccaccggctgggccagcacattgaagatgccctgctggatgtggccagcctcttccaggccggccagcacttcaagaggcgcttccggggcagcggcaaggagaacagccgccaccgctgtggcttcctgagccggcagacaggagccagcaaggcctccatgaccagcacagacttctag

SEQ ID NO: 146309 - DNA, 2145 bp, Artificial Sequence
  Description of Artificial Sequence: Synthetic coding sequence
atggccgaggcccaccaggccgtgggcttccggcccagcctgaccagtgatggagctgaggtggagctgagcgcccctgtgctgcaggagatctacctgagcggcctgcgctcctggaagaggcacctgagccgcttctggaatgacttcctgactggagtcttccctgccagccccctgtcctggctgttcctgttcagcgccatccagctggcctggttcctgcagctggaccccagcctgggcctgatggagaagatcaaggagctgctgcctgactggggcggccagcaccacggcctgcggggcgtgctggccgccgccctgtttgccagctgcctgtggggcgccctgatcttcaccctgcacgtggccctgcggctgctgctgagctaccacggctggctgctggagccccacggggccatgagcagccccaccaagacctggctggccctggtgcgcatcttcagcggccgccaccccatgctgttctcctaccagaggagcctgccccggcagcctgtgcccagcgtgcaggacacagtgaggaagtacctggagagcgtgcggcccatcctgagtgatgaagattttgactggacagctgtgctggcccaggagttcctgcggctgcaggccagcctgctgcagtggtacctgcggctgaagtcctggtgggccagcaactacgtgtctgactggtgggaggagtttgtgtacctgcggagcaggaaccccctgatggtgaacagcaactactacatgatggacttcctgtatgtgacccccacccccctgcaggccgcccgggctggaaatgctgtgcacgccctgctgctgtaccgccaccggctgaaccggcaggagatcccccccaccctgctgatgggcatgaggcccctgtgcagcgcccagtatgagaagatcttcaacaccacccgcatccctggggtgcagaaggactacatccgccacctgcatgacagccagcacgtggccgtgttccaccggggccgcttcttcaggatgggcacccacagcaggaacagcctgctgagcccccgggccctggagcagcagttccagaggatcctggatgaccccagccctgcctgcccccatgaggagcacctggccgccctgacagctgccccccggggcacctgggcccaggtgaggaccagcctgaagacccaggccgctgaggccctggaggccgtggagggcgccgccttctttgtgtccctggatgctgagcccgccggcctgaccagagaagatcctgctgccagcctggatgcctatgcccacgccctgctggccggccggggccatgaccgctggtttgacaagagcttcaccctgattgtgttcagcaatggcaagctgggcctgtctgtggagcacagctgggccgactgccccatcagcggccacatgtgggagttcaccctggccacagagtgcttccagctgggctacagcacagatggccactgcaagggccacccagaccccaccctgccccagccccagaggctgcagtgggacctgcctgaccagatccacagcagcatcagcctggccctgcggggggccaagatcctgtctgaaaatgtggactgccacgtggtgcccttcagcctgtttgggaagagcttcatccgccgctgccacctgagcagtgacagcttcatccagatcgccctgcagctggcccacttccgggaccggggccagttctgcctgacctatgagagcgccatgaccaggctcttcctggagggccgcacagaaacagtgcgcagctgcacccgggaggcctgcaactttgtgcgggccatggaggacaaggagaagacagcagatgaccacggctacggcgtgtcctacatcttcatgggagatggcatgatcaccttccacatcagcagcaagaagagcagcaccaagacagacagccaccggctgggccagcacattgaagatgccctgctggatgtggccagcctcttccaggccggccagcacttcaagaggcgcttccggggcagcggcaaggagaacagccgccaccgctgtggcttcctgagccggcagacaggagccagcaaggcctccatgaccagcacagacttctag

SEQ ID NO: 146310 - DNA, 2412 bp, Artificial Sequence; identical to SEQ ID NO: 146308
  Description of Artificial Sequence: Synthetic coding sequence

SEQ ID NO: 146311 - DNA, 2379 bp, Artificial Sequence
  Description of Artificial Sequence: Synthetic coding sequence
atggccgaggcccaccaggccgtgggcttccggcccagcctgaccagtgatggagctgaggtggagctgagcgcccctgtgctgcaggagatctacctgagcggcctgcgctcctggaagaggcacctgagccgcttctggaatgacttcctgactggagtcttccctgccagccccctgtcctggctgttcctgttcagcgccatccagctggcctggttcctgcagctggaccccagcctgggcctgatggagaagatcaaggagctgctgcctgactggggcggccagcaccacggcctgcggggcgtgctggccgccgccctgtttgccagctgcctgtggggcgccctgatcttcaccctgcacgtggccctgcggctgctgctgagctaccacggctggctgctggagccccacggggccatgagcagccccaccaagacctggctggccctggtgcgcatcttcagcggccgccaccccatgctgttctcctaccagaggagcctgccccggcagcctgtgcccagcgtgcaggacacagtgaggaagtacctggagagcgtgcggcccatcctgagtgatgaagattttgactggacagctgtgctggcccaggagttcctgcggctgcaggccagcctgctgcagtggtacctgcggctgaagtcctggtgggccagcaactacgtgtctgactggtgggaggagtttgtgtacctgcggagcaggaaccccctgatggtgaacagcaactactacatgatggccgcccgggctggaaatgctgtgcacgccctgctgctgtaccgccaccggctgaaccggcaggagatcccccccaccctgctgatgggcatgaggcccctgtgcagcgcccagtatgagaagatcttcaacaccacccgcatccctggggtgcagaaggactacatccgccacctgcatgacagccagcacgtggccgtgttccaccggggccgcttcttcaggatgggcacccacagcaggaacagcctgctgagcccccgggccctggagcagcagttccagaggatcctggatgaccccagccctgcctgcccccatgaggagcacctggccgccctgacagctgccccccggggcacctgggcccaggtgaggaccagcctgaagacccaggccgctgaggccctggaggccgtggagggcgccgccttctttgtgtccctggatgctgagcctgctggcctgacccgggaggaccctgctgccagcctggatgcctatgcccacgccctgctggccggccggggccatgaccgctggtttgacaagagcttcaccctcatcgtgttcagcaatggcaagctgggcctgtctgtggagcacagctgggccgactgccccatcagcggccacatgtgggagttcaccctggccacagagtgcttccagctgggctacagcacagatggccactgcaagggccacccagaccccaccctgccccagccccagaggctgcagtgggacctgcctgaccagatccacagcagcatcagcctggccctgcggggggccaagatcctgtctgaaaatgtggactgccacgtggtgcccttcagcctgtttgggaagagcttcatccgccgctgccacctgagcagtgacagcttcatccagatcgccctgcagctggcccacttccgggaccggggccagttctgcctgacctatgaaagtgccatgaccaggctcttcctggagggccgcacagagaccgtgcgcagctgcacccgggaggcctgcaactttgtgcgggccatggaggacaaggagaagacagacccccagtgcctggccctcttccgggtggccgtggacaagcaccaggccctgctgaaggccgccatgagcggccagggcgtggacagacacctgtttgccctgtacatcgtgagccgcttcctgcacctgcagagccccttcctgacccaggtgcacagcgagcagtggcagctgagcaccagccagatccctgtgcagcagatgcacctgtttgatgtgcacaactacccagactatgtgagcagcggcggcggcttcggccctgcagatgaccacggctacggcgtgtcctacatcttcatgggagatggcatgatcaccttccacatcagcagcaagaagagcagcaccaagacagacagccaccggctgggccagcacattgaagatgccctgctggatgtggccagcctcttccaggccggccagcacttcaagaggcgcttccggggcagcggcaaggagaacagccgccaccgctgtggcttcctgagccggcagacaggagccagcaaggcctccatgaccagcacagacttctag

SEQ ID NO: 146312 - DNA, 2412 bp, Artificial Sequence; identical to SEQ ID NO: 146308
  Description of Artificial Sequence: Synthetic coding sequence

SEQ ID NO: 146313 - DNA, 1524 bp, Artificial Sequence
  Description of Artificial Sequence: Synthetic coding sequence
atggaccccaagctgggccgcatggccgccagcctgctggccgtgctgctgctgctgctggagcggggcatgttcagcagccccagccccccaccagccctgctggagaaggtgttccagtacatcgacctgcaccaggatgaatttgtgcagaccctgaaggagtgggtggccattgaaagtgacagcgtgcagcctgtgccccgcttccggcaggagctgttcaggatgatggctgtggccgctgacaccctgcagaggctgggcgcccgggtggcctctgtggacatgggcccccagcagctgcctgatggccagagcctgcccatcccccccatcatcctggccgagctgggcagtgaccccaccaagggcaccgtgtgcttctacggccacctggatgtgcagcctgctgacagaggagatggctggctgacagacccctacgtgctgacagaggtggatggcaagctgtatggccgcggggccacagacaacaagggccctgtgctggcctggatcaatgctgtgtctgccttccgggccctggagcaggacctgcctgtgaacatcaagttcatcatcgagggcatggaggaggccggctctgtggccctggaggagctggtggagaaggagaaggaccgcttcttctctggagtggactacatcgtcatcagtgacaacctgtggatcagccagaggaagccagccatcacctacggcacccggggcaacagctacttcatggtggaggtgaagtgccgggaccaggacttccacagcggcacctttggaggcatcctgcacgagcccatggctgacctggtggccctgctgggcagcctggtggacagcagcggccacatcctggtgcccggcatctatgatgaggtggtgcccctgacagaggaggagatcaacacctacaaggccatccacctggacctggaggagtacagaaacagcagccgggtggagaagttcctgtttgacaccaaggaggagatcctgatgcacctgtggagataccccagcctgagcatccacggcatcgagggcgcctttgatgagcccggcaccaagacagtcatccctggccgggtcatcggcaagttcagcatccggctggtgccccacatgaatgtgtctgctgtggagaagcaggtgaccaggcacctggaggatgtgttcagcaagaggaacagcagcaacaagatggtggtgtccatgaccctgggcctgcacccctggatcgccaacattgatgacacccagtacctggccgccaagagggccatcagaacagtgtttggaacagagccagacatgatcagagatggcagcaccatccccatcgccaagatgttccaggagatcgtgcacaagtctgtggtgctgatccccctgggcgctgtggatgatggagagcacagccagaatgagaagatcaaccgctggaactacatcgagggcaccaagctgtttgctgccttcttcctggagatggcccagctgcactag

SEQ ID NO: 146314 - DNA, 2484 bp, Artificial Sequence
  Description of Artificial Sequence: Synthetic coding sequence
atgctgctgtgcctgagccctgcctggctgatgaaggtgcctgcccctggccagcctggagaggccgccctgctggtgtccaaggctgtgtccttccaccctgggggcctgaccttcctggatgactttgtgcccccaagaagagccacctacttcctggccggcctgggcctgggccctggccggggccgggaggccgctgagctggcccgggacctgacctgccccactggagccagcgctgagctggcccggctgctggaggaccggctgctgacccggcagctgctggcccagcagggcggcgtggccgtgcctgccaccctggccttcacctacaagcccccaggcctgctgcggggaggagatgccagcctgggcctgcggctggtggagctgagcggcaaggagggccaggagaccctggtgaaggaggaggtggaggccttcctgcggtctgaggccctgggggacatcctgcaggtggccgtgaagctgagcggctggcgctggaggggccggcaggcctggaggctgcaccccagggctgagctgggcgctgtggtggacacagtgctggccctgctggagaagctggaggaggaggagagcgtgctggtggaggccgtgtaccccccagcccagctgccctgcagtgatggccccagccctggccctggcctggccgtgcgcatctgtgctgtggtgtgcaggacccagggcgaccggcccctgctgagcaaggtggtgtgtggggtgggccgcggggaccggcccctgcggcaccacaacagcctgcccaggaccctggaggtggccctggcccagtgtggcctgggggaggaggcccaggtggccgctgtgcggcagagggtgaaggctgctgctgaggccgccctggccgctgtgctggccctggaggccggcctgtctgctgagcagaggggcggccggcgggcccacacagacttcctgggcgtggactttgccctgacagctgctgggggcgtgctgacccctgtggccctggagctgaatggaggcctgtgcctggaggcctgtggggccctggagggcctgtgggccgccccccggctgggccctgctgctgatgaagctgtggccgcccccctggtggagaccatgctgcggcgcagcgcccgctgcctgatggagggcaagcagctgctggtggtgggcgctgggggcgtgtccaagaagtttgtgtgggaggccgcccgggactatggcctgcagctgcacctggtggagagtgaccccaaccactttgccagccagctggtgcagaccttcatccactttgacatgacagagcacagaagagatgaagaaaatgcccggctgctggccgagctggtgcgggcccggggcctgaagctggatggctgcttctcctactgggatgactgcctggtgctgacagccctgctgtgccaggagctgggcctgccctgcagcagccctgctgccatgaggctggccaagcagaagagcctgacccagctgcacctgctgcaccaccacggccccccctggccagcccccagcctgcatgctgtgccctgctgccccctggagagcgaggctgatgtggagagagctgtgcaccaggtgcccctgcccggggtgatgaagctggagtttggagctggagctgtgggcgtgcggctggtggaggatgccccccagtgccacgagcacttcagccgcatcacccgggacctgcagggcgaggccgaccaccctggcatcggcctgggctggggcaatgccatgctgctgatggagtttgtggagggcacagaacatgatgtggacctggtgctgtttggaggccgcctgctggccgcctttgtgtctgacaatggccccacccggctgcccggcttcacagaaacagctgcctgcatgcccaccggcctggcccctgagcaggaggcccagatggtgcaggccgccttccgctgctgcctgggctgcggcctgctggatggagtcttcaacgtggagctgaagctgactggagctggccccaggctcatcgagatcaaccccaggatgggcggcttctacctgcgggactggatcctggagctgtatggagtggacctgctgctggccgctgtgatggtggcctgtggcctgcggcctgccctgcccacccggccccgggcccggggccacctggtgggcgtgatgtgcctggtgtcccagcacctgcaggccctgagcagcacagccagccgggagaccctgcaggccctgcatgaccggggcctgctgcggctgaacctgctggaggaggccctggtgcctggagaatatgaggagccctactgcagcgtggcctgtgccggccccagccccacagaggcccggctgcggctgctgggcctgtgccagggcctgggcattgatggccccagctaccctgtggcccacttcctgagccacttcaagtag

SEQ ID NO: 146315 - DNA, 2484 bp, Artificial Sequence; identical to SEQ ID NO: 146314
  Description of Artificial Sequence: Synthetic coding sequence

SEQ ID NO: 146316 - DNA, 2853 bp, Artificial Sequence
  Description of Artificial Sequence: Synthetic coding sequence
atgctgagcctggaccccagcggccctgagtgggactgccccctgggcagcaaggacctggaggaggagggcccctggggcggcggcagcggcctgcccccaacaggctgcttccctggctcctggaggcaggatgtgggcctggactgcaagggcagccctgagggcgctgaggcccgggcctggacagtgtactactacagcctgctgcagagctgcctgcagcaggccggcctgcctgagacccaggaccggggccaggtgcccaggacaggctgccctggagctgaggtgaccctgtgtgtgctgggcagccccagcaccttcctgcctgtgctgctggagggcggcgtgcagagccctggcaacatgctgctgtgcctgagccctgcctggctgatgaaggtgcctgcccctggccagcccggggaggccgccctgctggtgtccaaggctgtgtccttccaccctgggggcctgaccttcctggatgactttgtgcccccccggcgggccacctacttcctggccggcctgggcctgggccctggccggggccgggaggccgctgagctggcccgggacctgacctgccccaccggggccagcgctgagctggcccggctgctggaggaccggctgctgacccggcagctgctggcccagcagggcggcgtggccgtgcctgccaccctggccttcacctacaagcccccaggcctgctgcggggaggagatgccagcctgggcctgcggctggtggagctgagcggcaaggagggccaggagaccctggtgaaggaggaggtggaggccttcctgcggtctgaggccctgggggacatcctgcaggtggccgtgaagctgagcggctggcgctggaggggccggcaggcctggaggctgcaccccagggctgagctgggcgctgtggtggacacagtgctggccctgctggagaagctggaggaggaggagagcgtgctggtggaggccgtgtaccccccagcccagctgccctgcagtgatggccccagccctggccctggcctggccgtgcgcatctgtgctgtggtgtgcaggacccagggcgaccggcccctgctgagcaaggtggtgtgtggggtgggccgcggggaccggcccctgcggcaccacaacagcctgcccaggaccctggaggtggccctggcccagtgtggcctgggggaggaggcccaggtggccgctgtgcggcagagggtgaaggctgctgctgaggccgccctggccgctgtgctggccctggaggccggcctgtctgctgagcagagaggaggaagaagagcccacacagacttcctgggcgtggactttgccctgacagctgctggaggagtgctgacccctgtggccctggagctgaatggaggcctgtgcctggaggcctgtggggccctggagggcctgtgggccgccccccggctgggccctgctgctgatgaggccgtggccgcccccctggtggagaccatgctgcggcgcagcgcccgctgcctgatggagggcaagcagctgctggtggtgggcgctgggggcgtgtccaagaagtttgtgtgggaggccgcccgggactatggcctgcagctgcacctggtggagagtgaccccaaccactttgccagccagctggtgcagaccttcatccactttgacatgacagagcacagaagagatgaggagaatgcccggctgctggccgagctggtgcgggcccggggcctgaagctggatggctgcttctcctactgggatgactgcctggtgctgacagccctgctgtgccaggagctgggcctgccctgcagcagccctgctgccatgaggctggccaagcagaagagcctgacccagctgcacctgctgcaccaccacggccccccctggccagcccccagcctgcatgctgtgccctgctgccccctggagagcgaggctgatgtggagagagctgtgcaccaggtgcccctgcccggggtgatgaagctggagtttggagctggagctgtgggcgtgcggctggtggaggatgccccccagtgccacgagcacttcagccgcatcacccgggacctgcagggcgaggccgaccaccctggcatcggcctgggctggggcaatgccatgctgctgatggagtttgtggagggcacagaacatgatgtggacctggtgctgtttggaggccgcctgctggccgcctttgtgtctgacaatggccccacccggctgcccggcttcacagaaacagctgcctgcatgcccaccggcctggcccctgagcaggaggcccagatggtgcaggccgccttccgctgctgcctgggctgcggcctgctggatggagtcttcaacgtggagctgaagctgaccggggccggcccccggctgattgagatcaaccccaggatgggcggcttctacctgcgggactggatcctggagctgtatggagtggacctgctgctggccgctgtgatggtggcctgtggcctgcggcctgccctgcccacccggccccgggcccggggccacctggtgggcgtgatgtgcctggtgtcccagcacctgcaggccctgagcagcacagccagccgggagaccctgcaggccctgcatgaccggggcctgctgcggctgaacctgctggaggaggccctggtgcctggagaatatgaggagccctactgcagcgtggcctgtgccggccccagccccacagaggcccggctgcggctgctgggcctgtgccagggcctgggcattgatggccccagctaccctgtggcccacttcctgagccacttcaagtag

SEQ ID NO: 146317 - DNA, 2775 bp, Artificial Sequence
  Description of Artificial Sequence: Synthetic coding sequence
atgctgagcctggaccccagcggccctgagtgggactgccccctgggcagcaaggacctggaggaggagggcccctggggcggcggcagcggcctgcccccaacaggctgcttccctggctcctggaggcaggatgtgggcctggactgcaagggcagccctgagggcgctgaggcccgggcctggacagtgtactactacagcctgctgcagagctgcctgcagcaggccggcctgcctgagacccaggaccggggccaggtgcccaggacaggctgccctggagctgaggtgaccctgtgtgtgctgggcagccccagcaccttcctgcctgtgctgctggagggcggcgtgcagagccctggcaacatgctgctgtgcctgagccctgcctggctgatgaaggtgcctgcccctggccagcccggggaggccgccctgctggtgtccaaggctgtgtccttccaccctgggggcctgaccttcctggatgactttgtgcccccccggcgggccacctacttcctggccggcctgggcctgggccctggccggggccgggaggccgctgagctggcccgggacctgacctgccccaccggggccagcgctgagctggcccggctgctggaggaccggctgctgacccggcagctgctggcccagcagggcggcgtggccgtgcctgccaccctggccttcacctacaagcccccaggcctgctgcggggaggagatgccagcctgggcctgcggctggtggagctgagcggcaaggagggccaggagaccctggtgaaggaggaggtggaggccttcctgcggtctgaggccctgggggacatcctgcaggtggccgtgaagctgagcggctggcgctggaggggccggcaggcctggaggctgcaccccagggctgagctgggcgctgtggtggacacagtgctggccctgctggagaagctggaggaggaggagagcgtgctggtggaggccgtgtaccccccagcccagctgccctgcagtgatggccccagccctggccctggcctggccgtgcgcatctgtgctgtggtgtgcaggacccagggcgaccggcccctgctgagcaaggtggtgtgtggggtgggccgcggggaccggcccctgcggcaccacaacagcctgcccaggaccctggaggccgccctggccgctgtgctggccctggaggccggcctgtctgctgagcagagaggaggaagaagagcccacacagacttcctgggcgtggactttgccctgacagctgctggaggagtgctgacccctgtggccctggagctgaatggaggcctgtgcctggaggcctgtggggccctggagggcctgtgggccgccccccggctgggccctgctgctgatgaggccgtggccgcccccctggtggagaccatgctgcggcgcagcgcccgctgcctgatggagggcaagcagctgctggtggtgggcgctgggggcgtgtccaagaagtttgtgtgggaggccgcccgggactatggcctgcagctgcacctggtggagagtgaccccaaccactttgccagccagctggtgcagaccttcatccactttgacatgacagagcacagaagagatgaggagaatgcccggctgctggccgagctggtgcgggcccggggcctgaagctggatggctgcttctcctactgggatgactgcctggtgctgacagccctgctgtgccaggagctgggcctgccctgcagcagccctgctgccatgaggctggccaagcagaagagcctgacccagctgcacctgctgcaccaccacggccccccctggccagcccccagcctgcatgctgtgccctgctgccccctggagagcgaggctgatgtggagagagctgtgcaccaggtgcccctgcccggggtgatgaagctggagtttggagctggagctgtgggcgtgcggctggtggaggatgccccccagtgccacgagcacttcagccgcatcacccgggacctgcagggcgaggccgaccaccctggcatcggcctgggctggggcaatgccatgctgctgatggagtttgtggagggcacagaacatgatgtggacctggtgctgtttggaggccgcctgctggccgcctttgtgtctgacaatggccccacccggctgcccggcttcacagaaacagctgcctgcatgcccaccggcctggcccctgagcaggaggcccagatggtgcaggccgccttccgctgctgcctgggctgcggcctgctggatggagtcttcaacgtggagctgaagctgaccggggccggcccccggctgattgagatcaaccccaggatgggcggcttctacctgcgggactggatcctggagctgtatggagtggacctgctgctggccgctgtgatggtggcctgtggcctgcggcctgccctgcccacccggccccgggcccggggccacctggtgggcgtgatgtgcctggtgtcccagcacctgcaggccctgagcagcacagccagccgggagaccctgcaggccctgcatgaccggggcctgctgcggctgaacctgctggaggaggccctggtgcctggagaatatgaggagccctactgcagcgtggcctgtgccggccccagccccacagaggcccggctgcggctgctgggcctgtgccagggcctgggcattgatggccccagctaccctgtggcccacttcctgagccacttcaagtag

SEQ ID NO: 146318 - DNA, 903 bp, Artificial Sequence
  Description of Artificial Sequence: Synthetic coding sequence
atgtgccccctggcccacccagcccaggacctgcccctgctgcccagccagctgagcctggaccccagcggccctgagtgggactgccccctgggcagcaaggacctggaggaggagggcccctggggcggcggcagcggcctgcccccaacaggctgcttccctggctcctggaggcaggatgtgggcctggactgcaagggcagccctgagggcgctgaggcccgggcctggacagtgtactactacagcctgctgcagagctgcctgcagcaggccggcctgcctgagacccaggaccggggccaggtgcccaggacaggctgccctggagctgaggtgaccctgtgtgtgctgggcagccccagcaccttcctgcctgtgctgctggagggcggcgtgcagagccctggcaacatgctgctgtgcctgagccctgcctggctgatgaaggtgcctgcccctggccagcccggggaggccgccctgctggtgtccaaggctgtgtccttccaccctgggggcctgaccttcctggatgactttgtgcccccccggcgggccacctacttcctggccggcctgggcctgggccctggccggggccgggaggccgctgagctggcccgggacctgacctgccccaccggggccagcgctgagctggcccggctgctggaggaccggctgctgacccggcagctgctggcccagcagggcggcgtggccgtgcctgccaccctggccttcacctacaagcccccaggcctgctgcggggaggagatgccagcctgggcctgcggctggtggagctgagcggcaaggagggccaggagaccctggtgaaggaggagaggacctggctgggccccaagccctggaccaaccctgggaagacctag

SEQ ID NO: 146319 - DNA, 2775 bp, Artificial Sequence
  Description of Artificial Sequence: Synthetic coding sequence
atgctgagcctggaccccagcggccctgagtgggactgccccctgggcagcaaggacctggaggaggagggcccctggggcggcggcagcggcctgcccccaacaggctgcttccctggctcctggaggcaggatgtgggcctggactgcaagggcagccctgagggcgctgaggcccgggcctggacagtgtactactacagcctgctgcagagctgcctgcagcaggccggcctgcctgagacccaggaccggggccaggtgcccaggacaggctgccctggagctgaggtgaccctgtgtgtgctgggcagccccagcaccttcctgcctgtgctgctggagggcggcgtgcagagccctggcaacatgctgctgtgcctgagccctgcctggctgatgaaggtgcctgcccctggccagcccggggaggccgccctgctggtgtccaaggctgtgtccttccaccctgggggcctgaccttcctggatgactttgtgcccccccggcgggccacctacttcctggccggcctgggcctgggccctggccggggccgggaggccgctgagctggcccgggacctgacctgccccaccggggccagcgctgagctggcccggctgctggaggaccggctgctgacccggcagctgctggcccagcagggcggcgtggccgtgcctgccaccctggccttcacctacaagcccccaggcctgctgcggggaggagatgccagcctgggcctgcggctggtggagctgagcggcaaggagggccaggagaccctggtgaaggaggaggtggaggccttcctgcggtctgaggccctgggggacatcctgcaggtggccgtgaagctgagcggctggcgctggaggggccggcaggcctggaggctgcaccccagggctgagctgggcgctgtggtggacacagtgctggccctgctggagaagctggaggaggaggagagcgtgctggtggaggccgtgtaccccccagcccagctgccctgcagtgatggccccagccctggccctggcctggccgtgcgcatctgtgctgtggtgtgcaggacccagggcgaccggcccctgctgagcaaggtggtgtgtggggtgggccgcggggaccggcccctgcggcaccacaacagcctgcccaggaccctggaggtggccctggccgctgtgctggccctggaggccggcctgtctgctgagcagagaggaggaagaagagcccacacagacttcctgggcgtggactttgccctgacagctgctggaggagtgctgacccctgtggccctggagctgaatggaggcctgtgcctggaggcctgtggggccctggagggcctgtgggccgccccccggctgggccctgctgctgatgaggccgtggccgcccccctggtggagaccatgctgcggcgcagcgcccgctgcctgatggagggcaagcagctgctggtggtgggcgctgggggcgtgtccaagaagtttgtgtgggaggccgcccgggactatggcctgcagctgcacctggtggagagtgaccccaaccactttgccagccagctggtgcagaccttcatccactttgacatgacagagcacagaagagatgaggagaatgcccggctgctggccgagctggtgcgggcccggggcctgaagctggatggctgcttctcctactgggatgactgcctggtgctgacagccctgctgtgccaggagctgggcctgccctgcagcagccctgctgccatgaggctggccaagcagaagagcctgacccagctgcacctgctgcaccaccacggccccccctggccagcccccagcctgcatgctgtgccctgctgccccctggagagcgaggctgatgtggagagagctgtgcaccaggtgcccctgcccggggtgatgaagctggagtttggagctggagctgtgggcgtgcggctggtggaggatgccccccagtgccacgagcacttcagccgcatcacccgggacctgcagggcgaggccgaccaccctggcatcggcctgggctggggcaatgccatgctgctgatggagtttgtggagggcacagaacatgatgtggacctggtgctgtttggaggccgcctgctggccgcctttgtgtctgacaatggccccacccggctgcccggcttcacagaaacagctgcctgcatgcccaccggcctggcccctgagcaggaggcccagatggtgcaggccgccttccgctgctgcctgggctgcggcctgctggatggagtcttcaacgtggagctgaagctgaccggggccggcccccggctgattgagatcaaccccaggatgggcggcttctacctgcgggactggatcctggagctgtatggagtggacctgctgctggccgctgtgatggtggcctgtggcctgcggcctgccctgcccacccggccccgggcccggggccacctggtgggcgtgatgtgcctggtgtcccagcacctgcaggccctgagcagcacagccagccgggagaccctgcaggccctgcatgaccggggcctgctgcggctgaacctgctggaggaggccctggtgcctggagaatatgaggagccctactgcagcgtggcctgtgccggccccagccccacagaggcccggctgcggctgctgggcctgtgccagggcctgggcattgatggccccagctaccctgtggcccacttcctgagccacttcaagtag

SEQ ID NO: 146320 - DNA, 1206 bp, Artificial Sequence
  Description of Artificial Sequence: Synthetic coding sequence
atggagcctggaagaagaggagctgctgccctgctggccctgctgtgtgtggcctgtgccctgcgggccggccgggcccagtatgaaagatacagcttccgctccttccccagagatgagctgatgcccctggagagcgcctacagacatgccctggacaagtacagcggggagcactgggccgagagcgtgggctacctggagatcagcctgcggctgcaccggctgctgcgggacagcgaggccttctgccacaggaactgcagcgctgccccccagcctgagcctgctgctggcctggccagctacccagagctgcggctgtttggaggcctgctgcggcgggcccactgcctgaagcgctgcaagcagggcctgcctgccttccggcagagccagcccagccgggaggtgctggccgacttccagaggcgggagccctacaagttcctgcagtttgcctacttcaaggccaacaacctgcccaaggccatcgctgctgcccacaccttcctgctgaagcacccagatgatgagatgatgaagaggaacatggcctactacaagagcctgcccggggctgaggactacatcaaggacctggagaccaagagctatgagagcctcttcatccgggctgtgcgggcctacaacggggagaactggaggaccagcatcacagacatggagctggccctgcctgacttcttcaaggccttctatgagtgcctggccgcctgtgagggcagccgggagatcaaggacttcaaggacttctacctgagcattgctgaccactacgtggaggtgctggagtgcaagatccagtgtgaggagaacctgacccctgtgattggaggctaccctgtggagaagtttgtggccaccatgtaccactacctgcagtttgcctactacaagctgaatgacctgaagaatgctgccccctgtgctgtgtcctacctgctgtttgaccagaatgacaaggtgatgcagcagaacctggtgtactaccagtaccaccgggacacctggggcctgagtgatgagcacttccagcccaggcctgaggccgtgcagttcttcaacgtgaccaccctgcagaaggagctgtatgactttgccaaggagaacatcatggatgatgatgaaggagaggtggtggagtatgtggatgacctgctggagctggaggagaccagctag

SEQ ID NO: 146321 - DNA, 789 bp, Artificial Sequence
  Description of Artificial Sequence: Synthetic coding sequence
atggagcctggaagaagaggagctgctgccctgctggccctgctgtgtgtggcctgtgccctgcgggccggccgggcccagtatgaaagatacagcttccgctccttccccagagatgagctgatgcccctggagagcgcctacagacatgccctggacaagtacagcggggagcactgggccgagagcgtgggctacctggagatcagcctgcggctgcaccggctgctgcgggacagcgaggccttctgccacaggaactgcagcgctgccccccagcctgagcctgctgctggcctggccagctacccagagctgcggctgtttggaggcctgctgcggcgggcccactgcctgaagcgctgcaagcagggcctgcctgccttccggcagagccagcccagccgggaggtgctggccgacttccagaggcgggagccctacaagttcctgcagtttgcctacttcaaggccaacaacctgcccaaggccatcgctgctgcccacaccttcctgctgaagcacccagatgatgagatgatgaagaggaacatggcctactacaagagcctgcccggggctgaggactacctgaagacctggaagcccagccacatgaaggcctgcagcagcgagcagtgtggccacaccaccgtgaggactggagagcaccccagccagacctggagctggcccttccccaccagcagcaagcccttcacctctgtgtcccagcctgcccgggtgcccggccgcagcaggaccagccgcatcagcaccttcccctag

SEQ ID NO: 146322 - DNA, 789 bp, Artificial Sequence
  Description of Artificial Sequence: Synthetic coding sequence
atggagcctggaagaagaggagctgctgccctgctggccctgctgtgtgtggcctgtgccctgcgggccggccgggcccagtatgaaagatacagcttccgctccttccccagagatgagctgatgcccctggagagcgcctacagacatgccctggacaagtacagcggggagcactgggccgagagcgtgggctacctggagatcagcctgcggctgcaccggctgctgcgggacagcgaggccttctgccacaggaactgcagcgctgccccccagcctgagcctgctgctggcctggccagctacccagagctgcggctgtttggaggcctgctgcggcgggcccactgcctgaagcgctgcaagcagggcctgcctgccttccggcagagccagcccagccgggaggtgctggccgacttccagaggcgggagccctacaagttcctgcagtttgcctacttcaaggccaacaacctgcccaaggccatcgctgctgcccacaccttcctgctgaagcacccagatgatgagatgatgaagaggaacatggcctactacaagagcctgcccggggctgaggactacatcaaggacctggagaccaagagctatgagagcctcttcatcgagcagtgtggccacaccaccgtgaggactggagagcaccccagccagacctggagctggcccttccccaccagcagcaagcccttcacctctgtgtcccagcctgcccgggtgcccggccgcagcaggaccagccgcatcagcaccttcccctag

SEQ ID NO: 146323 - DNA, 1167 bp, Artificial Sequence
  Description of Artificial Sequence: Synthetic coding sequence
atggagcctggaagaagaggagctgctgccctgctggccctgctgtgtgtggcctgtgccctgcgggccggccgggcccagtatgaaagatacagcttccgctccttccccagagatgagctgatgcccctggagagcgcctacagacatgccctggacaagtacagcggggagcactgggccgagagcgtgcgggacagcgaggccttctgccacaggaactgcagcgctgccccccagcctgagcctgctgctggcctggccagctacccagagctgcggctgtttggaggcctgctgcggcgggcccactgcctgaagcgctgcaagcagggcctgcctgccttccggcagagccagcccagccgggaggtgctggccgacttccagaggcgggagccctacaagttcctgcagtttgcctacttcaaggccaacaacctgcccaaggccatcgccgccgcccacaccttcctgctgaagcacccagatgatgagatgatgaagaggaacatggcctactacaagagcctgcctggagctgaggactacatcaaggacctggagaccaagagctatgagagcctcttcatccgggctgtgcgggcctacaatggagagaactggaggaccagcatcacagacatggagctggccctgcctgacttcttcaaggccttctatgaatgtctggccgcctgtgagggcagccgggagatcaaggacttcaaggacttctacctgagcattgctgaccactacgtggaggtgctggagtgcaagatccagtgtgaggagaacctgacccctgtgattggaggctaccctgtggagaagtttgtggccaccatgtaccactacctgcagtttgcctactacaagctgaatgacctgaagaatgctgccccctgtgctgtgtcctacctgctgtttgaccagaatgacaaggtgatgcagcagaacctggtgtactaccagtaccaccgggacacctggggcctgagtgatgagcacttccagcccaggcctgaggccgtgcagttcttcaacgtgaccaccctgcagaaggagctgtatgactttgccaaggagaacatcatggatgatgatgaaggagaggtggtggagtatgtggatgacctgctggagctggaggagaccagctag

SEQ ID NO: 146324 - DNA, 3471 bp, Artificial Sequence
  Description of Artificial Sequence: Synthetic coding sequence
atggccagcctgctgcccctgctgtgcctgtgtgtggtggccgcccacctggccggggccagagatgccacccccacagaggagcccatggccacagccctgggcctggagcggcgctctgtgtacacaggccagcccagccctgccctggaggactgggaggaggccagcgagtggacctcctggttcaacgtggaccaccctggaggagatggagactttgagagcctggccgccatccgcttctactacggccctgcccgggtgtgcccccggcccctggccctggaggcccggaccacagactgggccctgcccagcgctgtgggggagcgggtgcacctgaaccccacccggggcttctggtgcctgaaccgggagcagccccggggccgccgctgcagcaactaccacgtgcgcttccgctgccccctggaggcctcctggggcgcctggggcccctggggcccctgcagcggcagctgtggccctggccggcggctgcggcggcggcactgccccagccctgctggagatgcctgccccggccggcccctggaggcccagaagtgtgtgcggccccgctgccccggctgcagcctggacacctgtgaatgtcctgaccacatcctgctgggctctgtggtgaccccatctggccagcccctgctgggcgcccgggtgtccctgcgggaccagcccggcaccgtggccaccagtgatgcccacggcaccttccgggtgcctggggtgtgtgccgacagccgggccaacatccgggcccagatggatggcttctctgctggggaggcccaggcccaggccaacggcagcatctctgtggtgaccatcatcctggacaagctggagaagccctacctggtgaagcaccctgagagccgggtgcgggaggccggccagaatgtgaccttctgctgcaaggccagcggcacccccatgcccaagaagtacagctggttccacaacggcaccctgctggacagaagagcccacggctacggggcccacctggagctgcggggcctgcggccagaccaggccggcatctaccactgcaaggcctggaatgaagctggagctgtgcgcagcggcacagcccggctgactgtgctggcccctggccagcctgcctgtgacccccggccccgggagtacctgatcaagctgcctgaggactgtggccagcccggcagcggccctgcctacctggatgtgggcctgtgcccagacacccgctgccccagcctggccggcagcagcccccgctgtggagatgccagcagccgctgctgcagcgtgcggcggctggagcggcgggagatccactgccccggctacgtgctgcctgtgaaggtggtggccgagtgtggctgccagaagtgcctgcccccccggggcctggtgcggggccgggtggtggccgctgacagcggggagcccctgcgctttgcccgcatcctgctgggccaggagcccatcggcttcaccgcctaccagggcgacttcaccatcgaggtgccccccagcacccagaggctggtggtgacctttgtggaccccagcggggagttcatggatgctgtgcgggtgctgccctttgaccccagaggagctggggtgtaccacgaggtgaaggccatgaggaagaaggcccctgtgatcctgcacaccagccagagcaacaccatccccctgggggagctggaggatgaggcccccctgggggagctggtgctgcccagcggggccttccggcgggcagatggcaagccctacagcggccctgtggaggcccgggtgacctttgtggacccccgggacctgaccagcgctgccagcgcccccagcgacctgcgctttgtggacagtgatggagagctggcccccctgcggacctacggcatgttttctgtggacctgcgggcccctggcagcgctgagcagctgcaggtgggccctgtggccgtgcgggtggccgccagccagatccacatgcctggccacgtggaggccctgaagctgtggagcctgaaccctgagaccggcctgtgggaggaggagagcggcttccggcgggagggcagcagcggcccccgggtgcggcgggaggagagggtcttcctggtgggcaatgtggagatccgggagcggcggctcttcaacctggatgtgcctgagcggcggcgctgctttgtgaaggtgcgggcctatgccaatgacaagttcacccccagcgagcaggtggagggcgtggtggtgaccctggtgaacctggagcccgcccctggcttcagcgccaacccccgggcctggggccgctttgattctgctgtgacaggccccaatggagcctgcctgcctgccttctgtgatgctgacagaccagatgcctacacagccctggtgacagccaccctgggcggggaggagctggagcccgcccccagcctgccccggcccctgcctgccaccgtgggcgtgacccagccctacctggaccggctgggctacagaagaacagaccatgatgatcctgccttcaagagaaatggcttccgcatcaacctggccaagcccaggcctggggaccctgctgaggccaatggacctgtgtacccctggaggagcctgcgggagtgccagggcgcccctgtgacagccagccacttccgctttgcccgggtggaggccgacaagtatgagtacaacgtggtgcccttccgggagggcaccccagcctcctggacaggagacctgctggcctggtggcccaacccccaggagttccgggcctgcttcctgaaggtgaagatccagggcccccaggagtacatggtgcgcagccacaatgctgggggcagccaccccaggacccggggccagctgtatggcctgagagatgcccggtctgtgcgggaccctgagcggcccggcaccagcgctgcctgtgtggagttcaagtgcagcggcatgctgtttgaccagaggcaggtggacaggaccctggtgaccatcatgccccagggcagctgcagaagagtggccgtgaatggcctgctgcgggactacctgaccaggcaccccccacctgtgcctgcagaagatcctgctgccttctccatgctggcccccctggaccccctgggccacaactatggagtgtacacagtgacagaccagagcccccggctggccaaggagatcgccatcggccgctgctttgatggcagcagtgatggcttcagccgggagatgaaggcagatgctggaacagctgtgaccttccagtgccgggagcccccagctggccggcccagcctcttccagaggctgctggagagccctgccacagccctgggggacatccggcgggagatgtctgaggccgcccaggcccaggcccgggccagcggccccctgcggacccggcggggccgggtgcggcagtag

SEQ ID NO: 146325 - DNA, 3555 bp, Artificial Sequence
  Description of Artificial Sequence: Synthetic coding sequence
atggtgggcaccaaggcctgggtgttctccttcctggtgctggaggtgacctctgtgctgggccggcagaccatgctgacccagagcgtgagaagagtgcagcccgggaagaagaaccccagcatctttgccaagccagctgacaccctggagagccctggagagtggaccacctggttcaacatcgactacccaggcggcaagggggactatgagcggctggatgccatccgcttctactatggagacagagtgtgtgcccggcccctgcggctggaggcccggaccacagactggaccccagctggcagcacaggccaggtggtgcacggcagcccccgggagggcttctggtgcctgaaccgggagcagaggcctggccagaactgcagcaactacacagtgcgcttcctgtgccccccaggcagcctgcggcgggacacagagcgcatctggagcccctggagcccctggagcaagtgcagcgctgcctgtggccagacaggagtgcagaccaggacccgcatctgcctggccgagatggtgtccctgtgcagcgaggccagcgaggagggccagcactgcatgggccaggactgcacagcctgtgacctgacctgccccatgggccaggtgaatgctgactgtgatgcctgcatgtgccaggacttcatgctgcatggagctgtgtccctgcctggaggagccccagccagcggggccgccatctacctgctgaccaagacccccaagctgctgacccagacagacagtgatggccgcttccgcatccctggcctgtgcccagatggcaagagcatcctgaagatcaccaaggtgaagtttgcccccatcgtgctgaccatgcccaagaccagcctgaaggccgccaccatcaaggccgagtttgtgcgggcagagaccccctacatggtgatgaaccctgagaccaaggcccggcgggccggccagagcgtgtccctgtgctgcaaggccaccgggaagcccaggccagacaagtacttctggtaccacaatgacaccctgctggaccccagcctgtacaagcatgagagcaagctggtgctgaggaagctgcagcagcaccaggccggggagtacttctgcaaggcccagagtgatgctggagctgtgaagagcaaggtggcccagctgattgtgattgccagtgatgagaccccctgcaaccctgtgcctgagagctacctgatccggctgccccatgactgcttccagaatgccaccaacagcttctactatgatgtgggccgctgccctgtgaagacctgtgccggccagcaggacaatggcatccgctgcagagatgctgtgcagaactgctgcggcatcagcaagacagaggagcgggagatccagtgcagcggctacaccctgcccaccaaggtggccaaggaatgtagctgccagcgctgcacagagaccaggagcatcgtgcggggccgggtgtctgctgctgacaatggagagcccatgagatttggacatgtgtacatgggcaacagccgggtgtccatgacaggctacaagggcaccttcaccctgcacgtgccccaggacacagagcggctggtgctgacctttgtggaccggctgcagaagtttgtgaacaccaccaaggtgctgcccttcaacaagaagggcagcgctgtgttccacgagatcaagatgctgcggaggaagaagcccatcaccctggaggccatggagaccaacatcatccccctgggggaggtggtgggggaggaccccatggccgagctggagatccccagccgctccttctaccggcagaatggagagccctacatcggcaaggtgaaggcctctgtgaccttcctggaccccaggaacatcagcacagccacagctgcccagacagacctgaacttcatcaatgatgaaggagacaccttccccctgcggacctacggcatgttttctgtggacttcagagatgaggtgaccagcgagcccctgaatgccggcaaggtgaaggtgcacctggacagcacccaggtgaagatgcctgagcacatcagcacagtgaagctgtggagcctgaacccagacaccggcctgtgggaggaggagggggacttcaagtttgagaaccagaggaggaacaagcgggaggacaggaccttcctggtgggcaacctggagatccgggagaggaggctcttcaacctggatgtgcctgagagccgccgctgctttgtgaaggtgcgggcctacagaagtgagcgcttcctgcccagcgagcagatccagggcgtggtgatcagcgtcatcaacctggagcccaggacaggcttcctgagcaacccccgggcctggggccgctttgacagcgtcatcaccggccccaacggggcctgtgtgcctgccttctgtgatgaccagagcccagatgcctacagcgcctacgtgctggccagcctggccggggaggagctgcaggccgtggagagcagccccaagttcaaccccaatgccatcggcgtgccccagccctacctgaacaagctgaactacagaagaacagaccacgaggacccccgggtgaagaagacagccttccagatctccatggccaagccccggcccaacagcgctgaggagagcaatggccccatctatgcctttgagaacctgcgggcctgtgaggaggccccacccagcgctgcccacttccgcttctaccagattgaaggagacagatatgactacaacacagtgcccttcaatgaagatgaccccatgtcctggacagaggactacctggcctggtggcccaagcccatggagttccgggcctgctacatcaaggtgaagatcgtgggccccctggaggtgaatgtgcgcagcaggaacatgggcggcacccaccggcagacagtgggcaagctgtatggcatcagagatgtgcgcagcacccgggaccgggaccagcccaacgtgtctgctgcctgcctggagttcaagtgcagcggcatgctgtatgaccaggacagagtggacaggaccctggtgaaggtgatcccccagggcagctgccggcgggcctctgtgaaccccatgctgcacgagtacctggtgaaccacctgcccctggccgtgaacaatgacaccagcgagtacaccatgctggcccccctggaccccctgggccacaactacggcatctacacagtgacagaccaggaccccaggacagccaaggagatcgccctgggccgctgctttgatggcaccagtgatggcagcagccgcatcatgaagagcaatgtgggcgtggccctgaccttcaactgtgtggagcggcaggtgggccggcagagcgccttccagtacctgcagagcaccccagcccagagccctgctgctggcaccgtgcagggccgggtgcccagccggcggcagcagagggccagcagaggaggccagaggcagggcggcgtggtggccagcctgcgcttcccccgggtggcccagcagcccctcatcaactag

SEQ ID NO: 146326 - DNA, 8148 bp, Artificial Sequence
  Description of Artificial Sequence: Synthetic coding sequence
atggctgctgctgctgggggcggcagctgccccggccctggcagcgcccggggccgcttccctggccggcccagaggagctgggggcggcggcggccggggcggcagaggaaatggagctgagcgggtgcgggtggccctgcggcggggcggcggggccaccggccctgggggcgctgagcctggagaggacacagccctgctgcggctgctgggcctgcggcggggcctgcggcggctgcggcggctgtgggccggcccccgggtgcagaggggccggggccggggccggggccggggctggggccccagccggggctgtgtgcctgaggaggagagcagtgatggagagagtgatgaggaggagttccagggcttccacagtgatgaagatgtggcccccagcagcctgcggagcgccctgcggagccagaggggccgggccccccggggccggggcaggaagcacaagaccacccccctgcccccaccccggctggctgatgtggcccccaccccacccaagaccccagccaggaagagaggagaggagggcacagagaggatggtgcaggccctgacagagctgctgcggcgggcccaggccccccaggcccccaggagccgggcctgtgagcccagcaccccaagaagaagccggggccggcccccaggccggcctgctggcccctgcaggaggaagcagcaggccgtggtggtggccgaggccgctgtgaccatccccaagccagagcccccacctcctgtggtgcctgtgaagcaccagacaggctcctggaagtgcaaggagggccctggccctggccctggcaccccccggcggggcggccagagcagccggggcggccggggcggccggggccggggccggggcggcggcctgccctttgtgatcaagtttgtgtcccgggccaagaaggtgaagatgggccagctgagcctgggcctggagagcggccagggccagggccagcacgaggagagctggcaggatgtgccccagaggagagtgggcagcggccagggcggcagcccctgctggaagaagcaggagcagaagctggatgatgaggaggaggagaagaaggaggaggaggagaaggacaaggagggggaggagaaggaggagagagctgtggccgaggagatgatgcctgctgctgagaaggaggaggccaagctgcccccaccacccctgaccccaccagcccccagccccccaccacccctgcccccacccagcaccagccccccaccacccctgtgccccccacctcctcctcctgtgagccccccacccctgcccagccccccacctcctccagcccaggaggagcaggaggagagccccccacctgtggtgcctgccacctgcagcaggaagaggggccggccccccctgacccccagccagagagctgagcgggaggccgcccgggccggccctgagggcaccagcccccccacccccacccccagcacagccactggaggccccccagaggacagccccaccgtggcccccaagagcaccaccttcctgaagaacatccggcagttcatcatgcctgtggtgtctgcccggagcagcagggtcatcaagaccccccggcgcttcatggatgaagatcctcccaagccacccaaggtggaggtgtcccctgtgctgcggccccccatcaccaccagcccccctgtgccccaggagcccgcccctgtgcccagccccccccgggcccccaccccacccagcacccctgtgcccctgcctgagaagaggaggagcatcctgcgggagcccaccttccgctggaccagcctgacccgggagctgcccccacctcctccagcccctcctcctcctccagcccccagccccccaccagccccagccaccagcagccggcggcccctgctgctgcgggccccccagttcaccccatctgaggcccacctgaagatctatgagagcgtgctgaccccaccacccctgggcgcccctgaggcccctgagcctgagcccccaccagcagatgacagccctgctgagcctgagcccagggctgtgggccgcaccaaccacctgagcctgcccaggtttgcccctgtggtgaccacccctgtgaaggccgaggtgagcccccacggggccccagccctgagcaatggcccccagacccaggcccagctgctgcagcccctgcaggccctgcagacccagctgctgccccaggccctgcccccaccccagccccagctgcagcccccacccagcccccagcagatgccacccctggagaaggccagaattgctggggtgggcagcctgcccctgagcggcgtggaggagaagatgttcagcctgctgaagagggccaaggtgcagctgttcaagattgaccagcagcagcagcagaaggtggccgcctccatgcccctgagccctgggggccagatggaggaggtggccggggctgtgaagcagatcagtgaccggggccctgtgcgctcagaagatgagagcgtggaggccaagcgggagcggcccagcggccctgagagccctgtgcagggcccccgcatcaagcacgtgtgcagacatgctgctgtggccctgggccaggcccgggccatggtgcctgaagatgtgccccggctgagcgccctgcccctgcgggaccggcaggacctggccacagaggacaccagcagcgccagcgagacagaatctgtgcccagccgcagcagaagaggcaaggtggaggccgccggccctggaggagagagcgagcccactggaagtggcggcaccctggcccacaccccccggcgcagcctgcccagccaccacggcaagaagatgaggatggcccgctgtggccactgccggggctgcctgcgggtgcaggactgtggcagctgtgtgaactgcctggacaagcccaagtttggaggccccaacaccaagaagcagtgctgcgtgtacagaaaatgtgacaagattgaggccaggaagatggagcggctggccaagaagggccgcaccatcgtgaagaccctgctgccctgggacagtgatgagagccctgaggccagccctggccccccaggccccaggagaggagctggagctgggggcccccgggaggaggtggtggcccaccctggccctgaggagcaggacagcctgctgcagaggaagagcgcccggcgctgtgtgaagcagaggcccagctatgacatctttgaggacagtgatgattctgagcccggcggccccccagcccccaggaggaggaccccccgggagaatgagctgcccctgcctgagcctgaggagcagagccggcccaggaagcccaccctgcagcctgtgctgcagctgaaggcccggcggcggctggacaaggatgccctggcccctggcccctttgccagcttccccaacggctggacaggcaagcagaagagcccagatggagtgcaccgggtgcgggtggacttcaaggaggactgtgacctggagaatgtgtggctgatgggcggcctgtctgtgctgacctctgtgcctgggggcccccccatggtgtgcctgctgtgtgccagcaagggcctgcacgagctggtgttctgccaggtgtgctgtgaccccttccaccccttctgcctggaggaggccgagcggcccctgccccagcaccacgacacctggtgctgccgccgctgcaagttctgccacgtgtgtggcaggaagggccggggcagcaagcacctgctggagtgtgagcgctgcagacatgcctaccacccagcctgcctgggccccagctaccccacccgggccaccaggaagaggaggcactggatctgcagcgcctgtgtgcgctgcaagagctgtggggccacccctgggaagaactgggatgtggagtggagcggggactacagcctgtgcccccgctgcacccagctgtatgagaagggcaactactgccccatctgcacccgctgctatgaggacaatgactatgagagcaagatgatgcagtgtgcccagtgtgaccactgggtgcacgccaagtgtgagggcctgagtgatgaggactatgagatcctgagcggcctgcctgattctgtgctgtacacctgtggcccctgtgccggggccgcccagccccgctggagggaggccctgagcggggccctgcagggcggcctgcggcaggtgctgcagggcctgctgagcagcaaggtggtgggccccctgctgctgtgcacccagtgtggcccagatggcaagcagctgcaccctggcccctgtggcctgcaggccgtgtcccagagatttgaagatggccactacaagtctgtgcacagcttcatggaggacatggtgggcatcctgatgaggcacagcgaggagggggagaccccagacagaagagctgggggccagatgaagggcctgctgctgaagctgctggagagcgccttcggctggtttgatgcccatgaccccaagtactggaggaggagcacccggctgcccaacggggtgctgcccaatgctgtgctgccccccagcctggaccacgtgtatgcccagtggaggcagcaggagcctgagaccccagagagcggccagcccccaggggaccccagcgctgccttccagggcaaggaccctgctgccttcagccacctggaggacccccggcagtgtgccctgtgcctgaagtatggagatgctgacagcaaggaggccggccgcctgctgtacatcggccagaatgagtggacccacgtgaactgtgccatctggagcgctgaggtgtttgaagaaaatgatggcagcctgaagaatgtgcatgctgctgtggcccggggccggcagatgagatgtgagctgtgcctgaagccaggggccaccgtgggctgctgcctgagcagctgcctgagcaacttccacttcatgtgtgcccgggccagctactgcatcttccaggatgacaagaaggtgttctgccagaagcacacagacctgctggatggcaaggagatcgtgaacccagatggctttgatgtgctgcggcgggtgtatgtggactttgagggcatcaacttcaagaggaagttcctgaccggcctggagccagatgccatcaacgtgctgattggcagcatcagaattgacagcctgggcaccctgagtgacctgagtgactgtgagggccgcctcttccccatcggctaccagtgcagccggctgtactggagcacagtggatgcccggcggcgctgctggtaccgctgccgcatcctggagtaccggccctggggcccccgggaggagcccgcccacctggaggccgctgaggagaaccagaccatcgtgcacagccctgcccccagcagcgagcccccaggaggagaggacccccccctggacacagatgtgctggtgcctggggcccctgagcggcacagccccatccagaacctggacccccccctgcggccagattctggcagcgcccctcctccagcccccaggagcttcagcggggcccgcatcaaggtgcccaactacagccccagccggcggcccctgggcggcgtgtcctttggccccctgcccagccctggcagccccagcagcctgacccaccacatccccaccgtgggggaccctgacttccctgcccccccaagaagaagccggcggcccagccccctggccccccggcccccacccagccgctgggccagcccccccctgaagaccagcccccagctgcgggtgcccccacccacctctgtggtgacagccctgacccccaccagcggggagctggcccctcctggccctgcccccagccccccacctcctgaggacctgggccctgactttgaggacatggaggtggtgtctggcctgtctgctgctgacctggactttgctgccagcctgctgggcacagagcccttccaggaggagatcgtggccgccggggccatgggcagcagccatggaggccctggggacagcagcgaggaggagagcagccccaccagccgctacatccacttccctgtgacagtggtgtctgcccctggcctggcccccagcgccacccctggggccccccgcatcgagcagctggatggagtggatgatggaacagacagcgaggccgaggccgtgcagcagccccggggccagggcaccccacccagcggccctggggtggtgcgggccggcgtgctgggcgctgctggggaccgggcccggcccccagaggacctgcccagcgagatcgtggactttgtgctgaagaacctgggcggccctggagatggaggagctggcccccgggaggagagcctgcccccagccccacccctggccaacggcagccagcccagccagggcctgacagccagccctgctgaccccaccaggacctttgcctggctgcccggggcccctggggtgcgggtgctgagcctgggccctgcccctgagccccccaagccagccaccagcaagatcatcctggtgaacaagctgggccaggtgtttgtgaagatggccggggagggggagcctgtgcccccacctgtgaagcagccccccctgccccccaccatcagccccacagcccccacctcctggaccctgcccccaggccccctgctgggcgtgctgcctgtggtgggcgtggtgcggcctgcccctcctcctcctcctccacccctgaccctggtgctgagcagcggccctgccagccccccccggcaggccatccgggtgaagagggtgtccaccttcagcggccgcagccccccagcccccccaccctacaaggccccccggctggatgaagatggagaggccagcgaggacaccccccaggtgcccggcctgggcagcggcggcttcagccgggtgaggatgaagacccccaccgtgcggggcgtgctggacctggacaggcctggagagcctgctggggaggagagccctggccccctgcaggagaggagccccctgctgcccctgcctgaagatggccccccccaggtgcctgatggccccccagacctgctgctggagagccagtggcaccactacagcggggaggccagcagcagcgaggaggagccccccagcccagatgacaaggagaaccaggcccccaagaggacaggcccccacctgcgctttgagatcagcagtgaagatggcttctctgtggaggccgagagcctggagggcgcctggaggaccctgattgagaaggtgcaggaggcccggggccacgcccggctgcggcacctgtccttcagcggcatgtctggggcccggctgctgggcatccaccatgatgctgtgatcttcctggccgagcagctgcccggggcccagcgctgccagcactacaagttccgctaccaccagcagggcgagggccaggaggagccccccctgaacccccatggagctgcccgggcagaggtgtacctgaggaagtgcacctttgacatgttcaacttcctggccagccagcaccgggtgctgcctgagggcgccacctgtgatgaggaggaggatgaggtgcagctgcggagcacccggcgggccaccagcctggagctgcccatggccatgaggttccgccacctgaagaagaccagcaaggaggccgtgggcgtgtaccgcagcgccatccacggccggggcctcttctgcaagagaaatattgatgctggggagatggtgattgagtacagcggcatcgtcatccgctctgtgctgacagacaagcgggagaagttctatgatggcaagggcatcggctgctacatgttcaggatggatgactttgatgtggtggatgccaccatgcacggcaatgctgcccgcttcatcaaccacagctgtgagcccaactgcttcagcagggtcatccacgtggagggccagaagcacatcgtcatctttgccctgcggcgcatcctgcggggggaggagctgacctatgactacaagttccccattgaagatgccagcaacaagctgccctgcaactgtggggccaagcgctgccgccgcttcctgaactag

SEQ ID NO: 146327 - DNA, 2115 bp, Artificial Sequence
  Description of Artificial Sequence: Synthetic coding sequence
atggtgcctgacacagcctgtgtgctgctgctgaccctggccgccctgggcgccagcggccagggccagagccccctgggcagtgacctgggcccccagatgctgcgggagctgcaggagaccaatgctgccctgcaggatgtgcgggagctgctgcggcagcaggtgcgggagatcaccttcctgaagaacacagtgatggagtgtgatgcctgtggcatgcagcagagcgtgaggacaggcctgcccagcgtgcggcccctgctgcactgtgcccctggcttctgcttccctggggtggcctgcatccagacagaaagtggggcccgctgtggcccctgcccagctggcttcaccggaaatggcagccactgcacagatgtgaatgaatgtgaaacaggccagcacaactgtgtgcccaacagcgtgtgcatcaacacccggggcagcttccagtgtggcccctgccagcccggctttgtgggggaccaggccagcggctgccagaggcgggcccagcgcttctgcccagatggcagccccagtgaatgtcatgaacatgctgactgtgtgctggagagagatggcagccgcagctgtgtgtgtgctgtgggctgggccggaaatggcatcctgtgtggccgggacacagacctggatggcttcccagatgagaagctgcgctgcccagagcggcagtgcaggaaggacaactgtgtgacagtgcccaacagcggccaggaggatgtggacagagatggcattggagatgcctgtgaccctgatgctgatggagatggagtgcccaatgagaaggacaactgccccctggtgagaaatccagaccagaggaacacagatgaggacaagtggggagatgcctgtgacaactgccgcagccagaagaatgatgaccagaaggacacagaccaggacggcagaggagatgcctgtgatgatgacattgatggagaccgcatccggaaccaggccgacaactgcccccgggtgcccaacagcgaccagaaggacagtgatggagatggcattggagatgcctgtgacaactgcccccagaagagcaacccagaccaggctgatgtggaccatgactttgtgggagatgcctgtgacagcgaccaggaccaggatggagatggccaccaggacagccgggacaactgccccaccgtgcccaacagcgcccaggaggacagcgaccatgatggccagggagatgcctgtgatgatgatgatgacaatgatggagtgcctgacagccgggacaactgccgcctggtgcccaaccctggccaggaggatgctgacagagatggagtgggagatgtgtgccaggatgactttgatgctgacaaggtggtggacaagattgatgtgtgcccagaaaatgctgaggtgaccctgacagacttccgggccttccagacagtggtgctggaccctgaaggagatgcccagattgaccccaactgggtggtgctgaaccagggccgggagatcgtgcagaccatgaacagcgaccccggcctggccgtgggctacacagccttcaatggagtggactttgagggcaccttccacgtgaacacagtgacagatgatgattatgccggcttcatcttcggctaccaggacagcagcagcttctacgtggtgatgtggaagcagatggagcagacctactggcaggccaaccccttccgggctgtggccgagcccggcatccagctgaaggctgtgaagagcagcactggacctggagagcagctgagaaatgccctgtggcacactggagacacagagagccaggtgcggctgctgtggaaggaccccagaaatgtgggctggaaggacaagaagagctaccgctggttcctgcagcaccggccccaggtgggctacatccgggtgcgcttctatgagggccctgagctggtggccgacagcaatgtggtgctggacaccaccatgaggggcggccgcctgggcgtcttctgcttcagccaggagaacatcatctgggccaacctgcgctaccgctgcaatgacaccatccctgaggactatgagacccaccagctgcggcaggcctag

SEQ ID NO: 146328 - DNA, 2235 bp, Artificial Sequence
  Description of Artificial Sequence: Synthetic coding sequence
atggtgcctgacacagcctgtgtgctgctgctgaccctggccgccctgggcgccagcggccagggccagagccccctgggcagtgacctgggcccccagatgctgcgggagctgcaggagaccaatgctgccctgcaggatgtgcgggagctgctgcggcagcaggtgcgggagatcaccttcctgaagaacacagtgatggagtgtgatgcctgtggcatgcagcagagcgtgaggacaggcctgcccagcgtgcggcccctgctgcactgtgcccctggcttctgcttccctggcccctgcccagctggcttcaccggaaatggcagccactgcacagatgtgaatgaatgtaatgcccacccctgcttcccccgggtgcgctgcatcaacaccagccctggcttccgctgtgaggcctgccccccaggctacagcggccccacccaccagggcgtgggcctggcctttgccaaggccaacaagcaggtgtgcacagacatcaatgaatgtgaaacaggccagcacaactgtgtgcccaacagcgtgtgcatcaacacccggggcagcttccagtgtggcccctgccagcccggctttgtgggggaccaggccagcggctgccagaggcgggcccagcgcttctgcccagatggcagccccagtgaatgtcatgaacatgctgactgtgtgctggagagagatggcagccgcagctgtgtgtgtgctgtgggctgggccggaaatggcatcctgtgtggccgggacacagacctggatggcttcccagatgagaagctgcgctgcccagagcggcagtgcaggaaggacaactgtgtgacagtgcccaacagcggccaggaggatgtggacagagatggcattggagatgcctgtgaccctgatgctgatggagatggagtgcccaatgagaaggacaactgccccctggtgagaaatccagaccagaggaacacagatgaggacaagtggggagatgcctgtgacaactgccgcagccagaagaatgatgaccagaaggacacagaccaggacggcagaggagatgcctgtgatgatgacattgatggagaccgcatccggaaccaggccgacaactgcccccgggtgcccaacagcgaccagaaggacagtgatggagatggcattggagatgcctgtgacaactgcccccagaagagcaacccagaccaggctgatgtggaccatgactttgtgggagatgcctgtgacagcgaccaggaccaggatggagatggccaccaggacagccgggacaactgccccaccgtgcccaacagcgcccaggaggacagcgaccatgatggccagggagatgcctgtgatgatgatgatgacaatgatggagtgcctgacagccgggacaactgccgcctggtgcccaaccctggccaggaggatgctgacagagatggagtgggagatgtgtgccaggatgactttgatgctgacaaggtggtggacaagattgatgtgtgcccagaaaatgctgaggtgaccctgacagacttccgggccttccagacagtggtgctggaccctgaaggagatgcccagattgaccccaactgggtggtgctgaaccagggccgggagatcgtgcagaccatgaacagcgaccccggcctggccgtgggctacacagccttcaatggagtggactttgagggcaccttccacgtgaacacagtgacagatgatgattatgccggcttcatcttcggctaccaggacagcagcagcttctacgtggtgatgtggaagcagatggagcagacctactggcaggccaaccccttccgggctgtggccgagcccggcatccagctgaaggctgtgaagagcagcactggacctggagagcagctgagaaatgccctgtggcacactggagacacagagagccaggtgcggctgctgtggaaggaccccagaaatgtgggctggaaggacaagaagagctaccgctggttcctgcagcaccggccccaggtgggctacatccgggtgcgcttctatgagggccctgagctggtggccgacagcaatgtggtgctggacaccaccatgaggggcggccgcctgggcgtcttctgcttcagccaggagaacatcatctgggccaacctgcgctaccgctgcaatgacaccatccctgaggactatgagacccaccagctgcggcaggcctag

SEQ ID NO: 146329 - DNA, 2394 bp, Artificial Sequence
  Description of Artificial Sequence: Synthetic coding sequence
atggccgccctggcctacaacctgggcaagcgggagatcaaccactacttctctgtgcgcagcgccaaggtgctggccctggtggccgtgctgctgctggccgcctgccacctggccagccgccgctacagaggaaatgacagctgtgagtacctgctgagcagcggccgcttcctgggggagaaggtgtggcagccccacagctgcatgatgcacaagtacaagatcagcgaggccaagaactgcctggtggacaagcacatcgccttcatcggggacagccgcatccggcagctgttctacagctttgtgaagatcatcaacccccagttcaaggaggagggcaacaagcatgagaacatcccctttgaggacaagacagcctctgtgaaggtggacttcctgtggcaccctgaggtgaatggctccatgaagcagtgcatcaaggtgtggacagaagattccatcgccaagccccacgtgattgtggccggggccgccacctggagcatcaagatccacaacggcagcagcgaggccctgagccagtacaagatgaacatcaccagcatcgcccccctgctggagaagctggccaagaccagtgatgtgtactgggtgctgcaggaccctgtgtatgaggacctgctgtctgaaaataggaagatgatcaccaatgagaagattgatgcctacaatgaagctgctgtgtccatcctgaacagcagcaccaggaacagcaagagcaatgtgaagatgttttctgtgtccaagctgattgcccaggagaccatcatggagagcctggatggcctgcacctgcctgagagcagccgggagaccacagccatgatcctgatgaatgtgtactgcaacaagatcctgaagcctgtggatggcagctgctgccagcccaggcctcctgtgaccctcatccagaagctggccgcctgcttcttcaccctgagcatcatcggctacctgatcttctacatcatccacagaaatgcccacaggaagaacaagccctgcacagacctggagagcggggaggagaagaagaacatcatcaacacccctgtgagcagcctggagatcctgctgcagagcttctgcaagctgggcctcatcatggcctacttctacatgtgtgaccgggccaacctcttcatgaaggagaacaagttctacacccacagcagcttcttcatccccatcatctacatcctggtgctgggcgtcttctacaatgaaaacaccaaggagaccaaggtgctgaaccgggagcagacagatgagtggaagggctggatgcagctggtgatcctgatctaccacatcagcggggccagcaccttcctgcctgtgtacatgcacatccgggtgctggtggccgcctacctgttccagacaggctacggccacttctcctacttctggatcaagggggactttggcatctacagagtgtgccaggtgctcttccggctgaacttcctggtggtggtgctgtgcatcgtgatggaccggccctaccagttctactactttgtgcccctggtgacagtgtggttcatggtgatctacgtgaccctggccctgtggccccagatcatccagaagaaggccaacggcaactgcttctggcacttcggcctgctgctgaagctgggcttcctgctgctcttcatctgcttcctggcctacagccagggcgcctttgagaagatcttcagcctgtggcccctgagcaaatgttttgagctgaagggaaatgtgtatgagtggtggttccgctggaggctggacagatatgtggtgttccacggcatgctgtttgccttcatctacctggccctgcagaagaggcagatcctgtctgagggcaagggggagcccctcttcagcaacaagatcagcaacttcctgctcttcatctctgtggtgtccttcctgacctacagcatctgggccagcagctgcaagaacaaggccgagtgcaatgagctgcaccccagcgtgtctgtggtgcagatcctggccttcatcctgatccggaacatccctggctacgcccggtctgtgtacagcagcttctttgcctggtttgggaagatcagcctggagctgttcatctgccagtaccacatctggctggccgctgacacccggggcatcctggtgctgatccctggcaaccccatgctgaacatcatcgtgtccaccttcatctttgtgtgtgtggcccacgagatcagccagatcaccaatgacctggcccagatcatcatccccaaggacaacagcagcctgctgaagaggctggcctgcatcgccgccttcttctgtggcctgctgatcctgagcagcatccaggacaagagcaagcactag

SEQ ID NO: 146330 - DNA, 2721 bp, Artificial Sequence
  Description of Artificial Sequence: Synthetic coding sequence
atggctggaaatgtgaagaagagcagtggagctgggggcggcagcggcagcggcggcagcggcagcggcggcctcatcggcctgatgaaggatgccttccagccccaccaccaccaccaccaccacctgagcccccaccccccaggcaccgtggacaagaagatggtggagaagtgctggaagctgatggacaaggtggtgcggctgtgccagaaccccaagctggccctgaagaacagccccccctacatcctggacctgctgcctgacacctaccagcacctgcggaccatcctgagccgctatgagggcaagatggagaccctgggagaaaatgagtacttccgggtcttcatggagaacctgatgaagaagaccaagcagaccatcagcctcttcaaggagggcaaggagaggatgtatgaggagaacagccagcccaggaggaacctgaccaagctgagcctcatcttcagccacatgctggccgagctgaagggcatcttccccagcggcctcttccagggcgacaccttccgcatcaccaaggcagatgctgctgagttctggaggaaggccttcggggagaagaccatcgtgccctggaagagcttccggcaggccctgcacgaggtgcaccccatcagcagcggcctggaggccatggccctgaagagcaccatcgacctgacctgcaatgactacatctctgtgtttgaatttgacatcttcaccaggctcttccagccctggagcagcctgctgaggaactggaacagcctggccgtgacccaccctggctacatggccttcctgacctatgatgaggtgaaggcccggctgcagaagttcatccacaagccaggcagctacatcttccggctgagctgcacccggctgggccagtgggccatcggctacgtgacagcagatggcaacatcctgcagaccatcccccacaacaagcccctcttccaggccctgattgatggcttccgggagggcttctacctgttcccagatggaagaaaccagaacccagacctgaccggcctgtgtgagcccaccccccaggaccacatcaaggtgacccaggagcagtatgagctgtactgtgagatgggcagcaccttccagctgtgcaagatctgtgccgagaatgacaaggatgtgaagattgagccctgtggccacctgatgtgcaccagctgcctgacctcctggcaggagagcgagggccagggctgccccttctgccgctgtgagatcaagggcacagagcccatcgtggtggacccctttgacccccggggcagcggcagcctgctgcggcagggcgctgagggcgcccccagccccaactatgatgatgatgatgatgaaagagcagatgacaccctcttcatgatgaaggagctggccggggccaaggtggagaggcctcccagccccttctccatggccccccaggccagcctgccccctgtgcccccccggctggacctgctgccccagagggtgtgtgtgcccagcagcgccagcgccctgggcacagccagcaaggccgccagcggcagcctgcacaaggacaagcccctgcctgtgccccccaccctgcgggacctgcccccacctcctcctccagaccggccctacagcgtgggcgctgagagccggccccagaggcggcccctgccctgcacccctggggactgccccagccgggacaagctgccccctgtgcccagcagccggctgggggacagctggctgccccggcccatccccaaggtgcctgtgtctgcccccagcagcagtgacccctggacaggccgggagctgaccaacagacacagcctgcccttcagcctgcccagccagatggagcccaggccagatgtgccccggctgggcagcaccttcagcctggacacctccatgtccatgaacagcagccccctggtgggcccagaatgtgaccaccccaagatcaagcccagcagcagcgccaatgccatctacagcctggccgcccggcccctgcctgtgcccaagctgcccccaggagagcagtgtgagggggaggaggacacagagtacatgacccccagcagccggcccctgcggcccctggacaccagccagagcagccgggcctgtgactgtgaccagcagattgacagctgcacctatgaggccatgtacaacatccagagccaggcccccagcatcacagagagcagcaccttcggggagggcaacctggccgccgcccacgccaacacaggccctgaggagagtgaaaatgaagatgatggctatgatgtgcccaagccccctgtgcctgctgtgctggcccggaggaccctgagtgacatcagcaatgccagcagcagctttggctggctgagcctggatggagaccccaccaccaacgtgacagagggcagccaggtgcctgagaggcctcccaagcccttcccccggcgcatcaacagcgagaggaaggccggcagctgccagcagggcagcggccctgctgccagcgctgccacagccagcccccagctgagcagcgagattgagaacctgatgagccagggctacagctaccaggacatccagaaggccctggtgattgcccagaacaacatcgagatggccaagaacatcctgcgggagtttgtgtccatcagcagccctgcccacgtggccacctag

SEQ ID NO: 146331 - DNA, 2949 bp, Artificial Sequence
  Description of Artificial Sequence: Synthetic coding sequence
atggccaacagcatgaatggaagaaatcctgggggccggggcggcaaccccaggaagggccgcatcctgggcatcattgatgccatccaggatgctgtgggcccccccaagcaggccgctgctgacagaagaacagtggagaagacctggaagctgatggacaaggtggtgcggctgtgccagaaccccaagctgcagctgaagaacagccccccctacatcctggacatcctgcctgacacctaccagcacctgcggctcatcctgagcaaatatgatgacaaccagaagctggcccagctgtctgaaaatgagtacttcaagatctacatcgacagcctgatgaagaagagcaagagggccatccgcctcttcaaggagggcaaggagaggatgtatgaggagcagagccaggacagaagaaacctgaccaagctgagcctcatcttcagccacatgctggccgagatcaaggccatcttccccaacggccagttccagggcgacaacttccgcatcaccaaggcagatgctgctgagttctggaggaagttcttcggggacaagaccatcgtgccctggaaggtgttccggcagtgcctgcacgaggtgcaccagatcagcagcggcctggaggccatggccctgaagagcaccatcgacctgacctgcaatgactacatctctgtgtttgaatttgacatcttcaccaggctcttccagccctggggcagcatcctgaggaactggaacttcctggccgtgacccaccctggctacatggccttcctgacctatgatgaggtgaaggcccggctgcagaagtacagcaccaagccaggcagctacatcttccggctgagctgcacccggctgggccagtgggccatcggctacgtgactggagatggcaacatcctgcagaccatcccccacaacaagcccctcttccaggccctgattgatggcagccgggagggcttctacctgtacccagatggccgcagctacaacccagacctgaccggcctgtgtgagcccacccctcatgaccacatcaaggtgacccaggagcagtatgagctgtactgtgagatgggcagcaccttccagctgtgcaagatctgtgccgagaatgacaaggatgtgaagattgagccctgtggccacctgatgtgcaccagctgcctgacagcctggcaggagagtgatggccagggctgccccttctgccgctgtgagatcaagggcacagagcccatcatcgtggacccctttgaccccagagatgagggcagccgctgctgcagcatcatcgaccccttcggcatgcccatgctggacctggatgatgatgatgaccgggaggagagcctgatgatgaaccggctggccaacgtgaggaaatgtacagaccggcagaacagccctgtgaccagccctggcagcagccccctggcccagaggaggaagccccagcctgaccccctgcagatcccccacctgagcctgccccctgtgcccccccggctggacctgatccagaagggcatcgtgcgcagcccctgtggcagccccaccggcagccccaagagcagcccctgcatggtgaggaagcaggacaagcccctgcctgcccctcctccacccctgcgggaccccccacctcctcctcctgagcggcccccacccatccccccagacaaccggctgagccgccacatccaccacgtggagagcgtgcccagccgggacccccccatgcccctggaggcctggtgccccagagatgtgtttggcaccaaccagctggtgggctgccgcctgctgggggagggcagccccaagccaggcatcacagccagcagcaatgtgaatggccgccacagccgggtgggcagtgaccctgtgctgatgaggaagcacagaagacatgacctgcccctggagggcgccaaggtgttcagcaatggccacctgggcagcgaggagtatgatgtgcccccccggctgagccccccacctcctgtgaccaccctgctgcccagcatcaagtgcaccggccccctggccaacagcctgtctgagaagacccgggaccctgtggaggaggatgatgatgagtacaagatccccagcagccaccctgtgtccctgaacagccagcccagccactgccacaacgtgaagccccctgtgcgcagctgtgacaatggccactgcatgctgaatggcacccacggccccagcagcgagaagaagagcaacatcccagacctgagcatctacctgaagggagatgtgtttgattctgccagtgaccctgtgcccctgcccccagcccggccccccacccgggacaaccccaagcacggcagcagcctgaacagaacacccagcgactatgacctgctgatcccccccctgggagaagatgcctttgatgccctgccccccagcctgcccccacctcctcctccagcccggcacagcctgattgagcacagcaagcccccaggcagcagcagccggcccagcagcggccaggacctcttcctgctgcccagcgacccctttgtggacctggccagcggccaggtgcccctgcccccagcccggcggctgcccggggagaatgtgaagaccaacagaaccagccaggactatgaccagctgcccagctgcagtgatggcagccaggccccagcccggccccccaagccccggcccaggagaacagcccctgagatccaccacaggaagccccacggccctgaggccgccctggagaatgtggatgccaagatcgccaagctgatgggagagggctacgcctttgaggaggtgaagagggccctggagatcgcccagaacaacgtggaggtggcccggagcatcctgcgggagtttgccttccccccacctgtgagcccccggctgaacctgtag

SEQ ID NO: 146332 - DNA, 2883 bp, Artificial Sequence
  Description of Artificial Sequence: Synthetic coding sequence
atggccctggcccctggcccagatgcccacgcccacctgccccccctgattgagctgaagttccagatggccaacagcatgaatggaagaaatcctgggggccggggcggcaaccccaggaagggccgcatcctgggcatcattgatgccatccaggatgctgtgggcccccccaagcaggccgctgctgacagaagaacagtggagaagacctggaagctgatggacaaggtggtgcggctgtgccagaaccccaagctgcagctgaagaacagccccccctacatcctggacatcctgcctgacacctaccagcacctgcggctcatcctgagcaaatatgatgacaaccagaagctggcccagctgtctgaaaatgagtacttcaagatctacatcgacagcctgatgaagaagagcaagagggccatccgcctcttcaaggagggcaaggagaggatgtatgaggagcagagccaggacagaagaaacctgaccaagctgagcctcatcttcagccacatgctggccgagatcaaggccatcttccccaacggccagttccagggcgacaacttccgcatcaccaaggcagatgctgctgagttctggaggaagttcttcggggacaagaccatcgtgccctggaaggtgttccggcagtgcctgcacgaggtgcaccagatcagcagcggcctggaggccatggccctgaagagcaccatcgacctgacctgcaatgactacatctctgtgtttgaatttgacatcttcaccaggctcttccagccctggggcagcatcctgaggaactggaacttcctggccgtgacccaccctggctacatggccttcctgacctatgatgaggtgaaggcccggctgcagaagtacagcaccaagccaggcagctacatcttccggctgagctgcacccggctgggccagtgggccatcggctacgtgactggagatggcaacatcctgcagaccatcccccacaacaagcccctcttccaggccctgattgatggcagccgggagggcttctacctgtacccagatggccgcagctacaacccagacctgaccggcctgtgtgagcccacccctcatgaccacatcaaggtgacccaggagcagtatgagctgtactgtgagatgggcagcaccttccagctgtgcaagatctgtgccgagaatgacaaggatgtgaagattgagccctgtggccacctgatgtgcaccagctgcctgacagcctggcaggagagtgatggccagggctgccccttctgccgctgtgagatcaagggcacagagcccatcatcgtggacccctttgaccccagagatgagggcagccgctgctgcagcatcatcgaccccttcggcatgcccatgctggacctggatgatgatgatgaccgggaggagagcctgatgatgaaccggctggccaacgtgaggaaatgtacagaccggcagaacagccctgtgaccagccctggcagcagccccctggcccagaggaggaagccccagcctgaccccctgcagatcccccacctgagcctgccccctgtgcccccccggctggacctgatccagaagggcatcgtgcgcagcccctgtggcagccccaccggcagccccaagagcagcccctgcatggtgaggaagcaggacaagcccctgcctgcccctcctccacccctgcgggaccccccacctcctcctcctgagcggcccccacccatccccccagacaaccggctgagccgccacatccaccacgtggagagcgtgcccagccgggacccccccatgcccctggaggcctggtgccccagagatgtgtttggcaccaaccagctggtgggctgccgcctgctgggggagggcagccccaagccaggcatcacagccagcagcaatgtgaatggccgccacagccgggtgggcagtgaccctgtgctgatgaggaagcacagaagacatgacctgcccctggagggcgccaaggtgttcagcaatggccacctgggcagcgaggagtatgatgtgcccccccggctgagccccccacctcctgtgaccaccctgctgcccagcatcaagtgcaccggccccctggccaacagcctgtctgagaagacccgggaccctgtggaggaggatgatgatgagtacaagatccccagcagccaccctgtgtccctgaacagccagcccagccactgccacaacgtgaagccccctgtgcgcagctgtgacaatggccactgcatgctgaatggcacccacggccccagcagcgagaagaagagcaacatcccagacctgagcatctacctgaagggagaagatgcctttgatgccctgccccccagcctgcccccacctcctcctccagcccggcacagcctgattgagcacagcaagcccccaggcagcagcagccggcccagcagcggccaggacctcttcctgctgcccagcgacccctttgtggacctggccagcggccaggtgcccctgcccccagcccggcggctgcccggggagaatgtgaagaccaacagaaccagccaggactatgaccagctgcccagctgcagtgatggcagccaggccccagcccggccccccaagccccggcccaggagaacagcccctgagatccaccacaggaagccccacggccctgaggccgccctggagaatgtggatgccaagatcgccaagctgatgggagagggctacgcctttgaggaggtgaagagggccctggagatcgcccagaacaacgtggaggtggcccggagcatcctgcgggagtttgccttccccccacctgtgagcccccggctgaacctgtag

SEQ ID NO: 146333 - DNA, 2313 bp, Artificial Sequence
  Description of Artificial Sequence: Synthetic coding sequence
atggccaacagcatgaatggaagaaatcctgggggccggggcggcaaccccaggaagggccgcatcctgggcatcattgatgccatccaggatgctgtgggcccccccaagcaggccgctgctgacagaagaacagtggagaagacctggaagctgatggacaaggtggtgcggctgtgccagaaccccaagctgcagctgaagaacagccccccctacatcctggacatcctgcctgacacctaccagcacctgcggctcatcctgagcaaatatgatgacaaccagaagctggcccagctgtctgaaaatgagtacttcaagatctacatcgacagcctgatgaagaagagcaagagggccatccgcctcttcaaggagggcaaggagaggatgtatgaggagcagagccaggacagaagaaacctgaccaagctgagcctcatcttcagccacatgctggccgagatcaaggccatcttccccaacggccagttccagggcgacaacttccgcatcaccaaggcagatgctgctgagttctggaggaagttcttcggggacaagaccatcgtgccctggaaggtgttccggcagtgcctgcacgaggtgcaccagatcagcagcggcctggaggccatggccctgaagagcaccatcgacctgacctgcaatgactacatctctgtgtttgaatttgacatcttcaccaggctcttccagccctggggcagcatcctgaggaactggaacttcctggccgtgacccaccctggctacatggccttcctgacctatgatgaggtgaaggcccggctgcagaagtacagcaccaagccaggcagctacatcttccggctgagctgcacccggctgggccagtgggccatcggctacgtgactggagatggcaacatcctgcagaccatcccccacaacaagcccctcttccaggccctgattgatggcagccgggagggcttctacctgtacccagatggccgcagctacaacccagacctgaccggcctgtgtgagcccacccctcatgaccacatcaaggtgacccaggagcagtatgagctgtactgtgagatgggcagcaccttccagctgtgcaagatctgtgccgagaatgacaaggatgtgaagattgagccctgtggccacctgatgtgcaccagctgcctgacagcctggcaggagagtgatggccagggctgccccttctgccgctgtgagatcaagggcacagagcccatcatcgtggacccctttgaccccagagatgagggcagccgctgctgcagcatcatcgaccccttcggcatgcccatgctggacctggatgatgatgatgaccgggaggagagcctgatgatgaaccggctggccaacgtgaggaaatgtacagaccggcagaacagccctgtgaccagccctggcagcagccccctggcccagaggaggaagccccagcctgaccccctgcagatcccccacctgagcctgccccctgtgcccccccggctggacctgatccagaagggcatcgtgcgcagcccctgtggcagccccaccggcagccccaagagcagcccctgcatggtgaggaagcaggacaagcccctgcctgcccctcctccacccctgcgggaccccccacctcctcctcctgagcggcccccacccatccccccagacaaccggctgagccgccacatccaccacgtggagagcgtgcccagccgggacccccccatgcccctggaggcctggtgccccagagatgtgtttggcaccaaccagctggtgggctgccgcctgctgggggagggcagccccaagccaggcatcacagccagcagcaatgtgaatggccgccacagccgggtgggcagtgaccctgtgctgatgaggaagcacagaagacatgacctgcccctggagggcgccaaggtgttcagcaatggccacctgggcagcgaggagtatgatgtgcccccccggctgagccccccacctcctgtgaccaccctgctgcccagcatcaagtgcaccggccccctggccaacagcctgtctgagaagacccgggaccctgtggaggaggatgatgatgagtacaagatccccagcagccaccctgtgtccctgaacagccagcccagccactgccacaacgtgaagccccctgtgcgcagctgtgacaatggccactgcatgctgaatggcacccacggccccagcagcgagaagaagagcaacatcccagacctgagcatctacctgaagggcacctaccgcatctag

SEQ ID NO: 146334 - DNA, 2433 bp, Artificial Sequence
  Description of Artificial Sequence: Synthetic coding sequence
atggccaacagcatgaatggaagaaatcctgggggccggggcggcaaccccaggaagggccgcatcctgggcatcattgatgccatccaggatgctgtgggcccccccaagcaggccgctgctgacagaagaacagtggagaagacctggaagctgatggacaaggtggtgcggctgtgccagaaccccaagctgcagctgaagaacagccccccctacatcctggacatcctgcctgacacctaccagcacctgcggctcatcctgagcaaatatgatgacaaccagaagctggcccagctgtctgaaaatgagtacttcaagatctacatcgacagcctgatgaagaagagcaagagggccatccgcctcttcaaggagggcaaggagaggatgtatgaggagcagagccaggacagaagaaacctgaccaagctgagcctcatcttcagccacatgctggccgagatcaaggccatcttccccaacggccagttccagggcgacaacttccgcatcaccaaggcagatgctgctgagttctggaggaagttcttcggggacaagaccatcgtgccctggaaggtgttccggcagtgcctgcacgaggtgcaccagatcagcagcggcctggaggccatggccctgaagagcaccatcgacctgacctgcaatgactacatctctgtgtttgaatttgacatcttcaccaggctcttccagccctggggcagcatcctgaggaactggaacttcctggccgtgacccaccctggctacatggccttcctgacctatgatgaggtgaaggcccggctgcagaagtacagcaccaagccaggcagctacatcttccggctgagctgcacccggctgggccagtgggccatcggctacgtgactggagatggcaacatcctgcagaccatcccccacaacaagcccctcttccaggccctgattgatggcagccgggagggcttctacctgtacccagatggccgcagctacaacccagacctgaccggcctgtgtgagcccacccctcatgaccacatcaaggtgacccaggagcagtatgagctgtactgtgagatgggcagcaccttccagctgtgcaagatctgtgccgagaatgacaaggatgtgaagattgagccctgtggccacctgatgtgcaccagctgcctgacagcctggcaggagagtgatggccagggctgccccttctgccgctgtgagatcaagggcacagagcccatcatcgtggacccctttgaccccagagatgagggcagccgctgctgcagcatcatcgaccccttcggcatgcccatgctggacctggatgatgatgatgaccgggaggagagcctgatgatgaaccggctggccaacgtgaggaaatgtacagaccggcagaacagccctgtgaccagccctggcagcagccccctggcccagaggaggaagccccagcctgaccccctgcagatcccccacctgagcctgccccctgtgcccccccggctggacctgatccagaagggcatcgtgcgcagcccctgtggcagccccaccggcagccccaagagcagcccctgcatggtgaggaagcaggacaagcccctgcctgcccctcctccacccctgcgggaccccccacctcctcctcctgagcggcccccacccatccccccagacaaccggctgagccgccacatccaccacgtggagagcgtgcccagccgggacccccccatgcccctggaggcctggtgccccagagatgtgtttggcaccaaccagctggtgggctgccgcctgctgggggagggcagccccaagccaggcatcacagccagcagcaatgtgaatggccgccacagccgggtgggcagtgaccctgtgctgatgaggaagcacagaagacatgacctgcccctggagggcgccaaggtgttcagcaatggccacctgggcagcgaggagtatgatgtgcccccccggctgagccccccacctcctgtgaccaccctgctgcccagcatcaagtgcaccggccccctggccaacagcctgtctgagaagacccgggaccctgtggaggaggatgatgatgagtacaagatccccagcagccaccctgtgtccctgaacagccagcccagccactgccacaacgtgaagccccctgtgcgcagctgtgacaatggccactgcatgctgaatggcacccacggccccagcagcgagaagaagagcaacatcccagacctgagcatctacctgaagggagatgtgtttgattctgccagtgaccctgtgcccctgcccccagcccggccccccacccgggacaaccccaagcacggcagcagcctgaacagaacacccagcgactatgacctgctgatcccccccctgggctag

SEQ ID NO: 146335 - DNA, 420 bp, Artificial Sequence
  Description of Artificial Sequence: Synthetic coding sequence
atggccaacagcatgaatggaagaaatcctgggggccggggcggcaaccccaggaagggccgcatcctgggcatcattgatgccatccaggatgctgtgggcccccccaagcaggccgctgctgacagaagaacagtggagaagacctggaagctgatggacaaggtggtgcggctgtgccagaaccccaagctgcagctgaagaacagccccccctacatcctggacatcctgcctgacacctaccagcacctgcggctcatcctgagcaaatatgatgacaaccagaagctggcccagctgtctgaaaatgagtacttcaagatctacatcgacagcctgatgaagaagagcaagagggccatccgcctcttcaaggagggcaaggagaggatgtatgaggagcagagccaggactag

SEQ ID NO: 146336 - DNA, 684 bp, Artificial Sequence
  Description of Artificial Sequence: Synthetic coding sequence
atggccctggcccctggcccagatgcccacgcccacctgccccccctgattgagctgaagttccagatggccaacagcatgaatggaagaaatcctgggggccggggcggcaaccccaggaagggccgcatcctgggcatcattgatgccatccaggatgctgtgggcccccccaagcaggccgctgctgacagaagaacagtggagaagacctggaagctgatggacaaggtggtgcggctgtgccagaaccccaagctgcagctgaagaacagccccccctacatcctggacatcctgcctgacacctaccagcacctgcggctcatcctgagcaaatatgatgacaaccagaagctggcccagctgtctgaaaatgagtacttcaagatctacatcgacagcctgatgaagaagagcaagagggccatccgcctcttcaaggagggcaaggagaggatgtatgaggagcagagccaggacaggaccatcgtgccctggaaggtgttccggcagtgcctgcacgaggtgcaccagatcagcagcggcctggaggccatggccctgaagagcaccatcgacctgacctgcaatgactacatctctgtgtttgaatttgacatcttcaccaggctcttccaggtgtctgacaacttcacagagtacctgatctacctgacctag

SEQ ID NO: 146337 - DNA, 1425 bp, Artificial Sequence
  Description of Artificial Sequence: Synthetic coding sequence
atggccctggccgtggccccctggggccggcagtgggaggaggcccgggccctgggccgggctgtgaggatgctgcagaggctggaggagcagtgtgtggacccccggctgtctgtgtccccacccagcctgcgggacctgctgcccaggacagcccagctgctgcgggaggtggcccacagccggcgggctgctgggggcggcggccctgggggccctgggggcagcggggacttcctgctgatctacctggccaacctggaggccaagagccggcaggtggccgccctgctgcccccccggggcagaagaagtgccaatgatgagctgttccgggccggcagccggctgcggcggcagctggccaagctggccatcatcttcagccacatgcatgctgagctgcacgccctcttccctgggggcaagtactgcggccacatgtaccagctgaccaaggccccagcccacaccttctggagggagagctgtggggcccgctgtgtgctgccctgggccgagtttgagagcctgctgggcacctgccaccctgtggagcccggctgcacagccctggccctgcggaccaccatcgacctgacctgcagcggccacgtgtccatctttgaatttgatgtgttcaccaggctcttccagccctggcccaccctgctgaagaactggcagctgctggccgtgaaccaccctggctacatggccttcctgacctatgatgaggtgcaggagcggctgcaggcctgccgggacaagccaggcagctacatcttccggcccagctgcacccggctgggccagtgggccatcggctacgtgtccagtgatggcagcatcctgcagaccatcccagccaacaagcccctgagccaggtgctgctggagggccagaaggatggcttctacctgtacccagatggcaagacccacaacccagacctgacagagctgggccaggccgagccccagcagaggatccacgtgtctgaggagcagctgcagctgtactgggccatggacagcacctttgagctgtgcaagatctgtgccgagagcaacaaggatgtgaagattgagccctgtggccacctgctgtgcagctgctgcctggccgcctggcagcacagcgacagccagacctgccccttctgccgctgtgagatcaagggctgggaggccgtgtccatctaccagttccacggccaggccacagcagaagattctggcaacagcagtgaccaggagggccgggagctggagctgggccaggtgcccctgagcgccccacccctgccccccaggccagacctgccccccaggaagcccagaaatgcccagcccaaggtgcggctgctgaagggcaacagccccccagctgccctgggcccccaggaccctgccccagcctag

SEQ ID NO: 146338 - DNA, 1287 bp, Artificial Sequence
  Description of Artificial Sequence: Synthetic coding sequence
atggccctggccgtggccccctggggccggcagtgggaggaggcccgggccctgggccgggctgtgaggatgctgcagaggctggaggagcagtgtgtggacccccggctgtctgtgtccccacccagcctgcgggacctgctgcccaggacagcccagctgctgcgggaggtggcccacagccggcgggctgctgggggcggcggccctgggggccctgggggcagcggggacttcctgctgatctacctggccaacctggaggccaagagccggcaggtggccgccctgctgcccccccggggcagaagaagtgccaatgatgagctgttccgggccggcagccggctgcggcggcagctggccaagctggccatcatcttcagccacatgcatgctgagctgcacgccctcttccctgggggcaagtactgcggccacatgtaccagctgaccaaggccccagcccacaccttctggagggagagctgtggggcccgctgtgtgctgccctgggccgagtttgagagcctgctgggcacctgccaccctgtggagcccggctgcacagccctggccctgcggaccaccatcgacctgacctgcagcggccacgtgtccatctttgaatttgatgtgttcaccaggctcttccagccctggcccaccctgctgaagaactggcagctgctggccgtgaaccaccctggctacatggccttcctgacctatgatgaggtgcaggagcggctgcaggcctgccgggacaagccaggcagctacctgtacccagatggcaagacccacaacccagacctgacagagctgggccaggccgagccccagcagaggatccacgtgtctgaggagcagctgcagctgtactgggccatggacagcacctttgagctgtgcaagatctgtgccgagagcaacaaggatgtgaagattgagccctgtggccacctgctgtgcagctgctgcctggccgcctggcagcacagcgacagccagacctgccccttctgccgctgtgagatcaagggctgggaggccgtgtccatctaccagttccacggccaggccacagcagaagattctggcaacagcagtgaccaggagggccgggagctggagctgggccaggtgcccctgagcgccccacccctgccccccaggccagacctgccccccaggaagcccagaaatgcccagcccaaggtgcggctgctgaagggcaacagccccccagctgccctgggcccccaggaccctgccccagcctag

SEQ ID NO: 146339 - DNA, 2355 bp, Artificial Sequence
  Description of Artificial Sequence: Synthetic coding sequence
atgtctgaccagaagaaggaggaggaggaggaggccgctgctgctgctgccatggccacagagggcggcaagaccagcgagcctgagaacaacaacaagaagcccaagaccagcggcagccaggacagccagcccagccccctggccctgctggccgccacctgcagcaagattggcaccccaggagagaaccaggccaccggccagcagcagatcatcatcgaccccagccagggcctggtgcagctgcagaaccagccccagcagctggagctggtgaccacccagctggccggaaatgcctggcagctggtggccagcaccccaccagccagcaaggagaacaacgtgtcccagcctgccagcagcagcagcagcagcagcagcagcaacaacggcagcgccagccccaccaagaccaagagcggcaacagcagcaccccaggccagttccaggtgatccaggtgcagaaccccagcggctctgtgcagtaccaggtgatcccccagctgcagacagtggagggccagcagatccagatcaaccccaccagcagcagcagcctgcaggacctgcagggccagatccagctgatctctgctggcaacaaccaggccatcctgacagctgccaacagaacagccagcggcaacatcctggcccagaacctggccaaccagacagtgcctgtgcagatccggcctggggtgtccatccccctgcagctgcagaccctgcccggcacccaggcccaggtggtgaccaccctgcccatcaacattggaggagtgaccctggccctgcctgtgatcaacaacgtggccgccggcggcggcaccggccaggtgggccagcctgctgccacagctgacagcggcaccagcaatggaaaccagctggtgtccacccccaccaacaccaccaccagcgccagcaccatgcctgagagccccagcagcagcaccacctgcaccaccacagccagcaccagcctgaccagcagtgacaccctggtgtcctctgctgacaccggccagtatgccagcaccagcgccagcagcagcgagaggaccatcgaggagagccagaccccagctgccacagagagcgaggcccagagcagcagccagctgcagcccaacggcatgcagaatgcccaggaccagagcaacagcctgcagcaggtgcagatcgtgggccagcccatcctgcagcagatccagatccagcagccccagcagcagatcatccaggccatccccccccagagcttccagctgcagagcggccagaccatccagaccatccagcagcagcccctgcagaatgtgcagctgcaggccgtgaaccccacccaggtgctgatccgggcccccaccctgacccccagcggccagatctcctggcagacagtgcaggtgcagaacatccagagcctgagcaacctgcaggtgcagaatgccggcctgagccagcagctgaccatcacccctgtgagcagcagcggcggcaccaccctggcccagatcgcccctgtggccgtggccggggcccccatcaccctgaacacagcccagctggcctctgtgcccaacctgcagacagtgtctgtggccaacctgggcgccgccggcgtgcaggtgcagggcgtgcctgtgaccatcacctctgtggccggccagcagcagggccaggatggagtgaaggtgcagcaggccaccatcgcccctgtgacagtggccgtgggcggcatcgccaatgccaccatcggggctgtgtccccagaccagctgacccaggtgcacctgcagcagggccagcagaccagtgaccaggaggtgcagcccgggaagaggctgcggcgggtggcctgcagctgccccaactgccgggagggggagggccggggcagcaatgaacctgggaagaagaagcagcacatctgccacatcgagggctgtgggaaggtgtatggcaagaccagccacctgcgggcccacctgcgctggcacactggagagcggcccttcatctgcaactggatgttctgtgggaagcgcttcaccaggagtgatgagctgcagaggcacaggaggacccacactggagagaagagatttgagtgcccagaatgttccaagcgcttcatgagaagtgaccacctgagcaagcacgtgaagacccaccagaacaagaagggcggcggcacagccctggccatcgtgaccagcggggagctggacagctctgtgacagaggtgctgggcagcccccgcatcgtgacagtggccgccatcagccaggacagcaacccagccacccccaacgtgtccaccaacatggaggagttctag

SEQ ID NO: 146340 - DNA, 1476 bp, Artificial Sequence
  Description of Artificial Sequence: Synthetic coding sequence
atggaccacacagacaatgagctgcagggcaccaacagcagcggcagcctgggcggcctggatgtgagaagacgcatccccatcaagctgatcagcaagcaggccaacaaggccaagccagcccccaggacccagaggaccatcaacaggatgcctgccaaggcccctcctggagatgaggagggctttgactacaatgaggaggagagatatgactgcaagggcggggagctgtttgccaaccagaggcgcttccctggccacctgttctgggacttccagatcaacatcctgggggagaaggatgacacccctgtgcacttctgtgacaagtgtggcctgcccatcaagatctacggccgcatgatcccctgcaagcacgtgttctgctatgactgtgccatcctgcacgagaagaagggggacaagatgtgccccggctgcagcgaccctgtgcagagaattgagcagtgcacccggggcagcctcttcatgtgcagcatcgtgcagggctgcaagaggacctacctgagccagagggacctgcaggcccacatcaaccaccgccacatgagagctgggaagcctgtgacccgggccagcctggagaatgtgcacccccccatcgcccccccacccacagagatccctgagcgcttcatcatgcccccagacaagcaccacatgagccacatcccccccaagcagcacatcatgatgcctcctccacccctgcagcacgtgccccatgagcactacaaccagccccatgaggacatccgggcccctcctgctgagctgtccatggcccctcctccacccaggtctgtgtcccaggagaccttccgcatcagcaccaggaagcacagcaacctgatcaccgtgcccatccaggatgacagcaacagcggggcccgggagcccccacctccagccccagccccagcccaccaccaccctgagtaccagggccagcctgtggtgagccacccccaccacatcatgccaccccagcagcactacgcccctcctcctcctcctcctccacccatcagccaccccatgccccaccccccccaggccgccggcaccccccacctggtgtacagccaggcccctcctccacccatgaccagcgcccccccacccatcaccccacctcctggccacatcatcgcccagatgccaccctacatgaaccaccccccacctggccccccaccaccccagcacggcggcccccctgtgacagcccccccaccccaccactacaaccccaacagcctgccccagttcacagaggaccagggcaccctgagcccccccttcacccagcccggcggcatgagccctggcatctggccagccccccggggccccccacctccaccccggctgcagggcccccccagccagacccccctgcccggcccccaccacccagaccagacccgctaccggccctactaccagtag

SEQ ID NO: 146341 - DNA, 1113 bp, Artificial Sequence
  Description of Artificial Sequence: Synthetic coding sequence
atgatcccctgcaagcacgtgttctgctatgactgtgccatcctgcacgagaagaagggggacaagatgtgccccggctgcagcgaccctgtgcagagaattgagcagtgcacccggggcagcctcttcatgtgcagcatcgtgcagggctgcaagaggacctacctgagccagagggacctgcaggcccacatcaaccaccgccacatgagagctgggaagcctgtgacccgggccagcctggagaatgtgcacccccccatcgcccccccacccacagagatccctgagcgcttcatcatgcccccagacaagcaccacatgagccacatcccccccaagcagcacatcatgatgcctcctccacccctgcagcacgtgccccatgagcactacaaccagccccatgaggacatccgggcccccccagctgagctgtccatggcccctcctccacccaggtctgtgtcccaggagaccttccgcatcagcaccaggaagcacagcaacctgatcaccgtgcccatccaggatgacagcaacagcggggcccgggagcccccacctccagccccagccccagcccaccaccaccctgagtaccagggccagcctgtggtgagccacccccaccacatcatgccaccccagcagcactacgcccctcctcctcctcctcctccacccatcagccaccccatgccccaccccccccaggccgccggcaccccccacctggtgtacagccaggcccctcctccacccatgaccagcgcccccccacccatcaccccacctcctggccacatcatcgcccagatgccaccctacatgaaccaccccccacctggccccccaccaccccagcacggcggcccccctgtgacagcccccccaccccaccactacaaccccaacagcctgccccagttcacagaggaccagggcaccctgagcccccccttcacccagcccggcggcatgagccctggcatctggccagccccccggggccccccacctccaccccggctgcagggcccccccagccagacccccctgcccggcccccaccacccagaccagacccgctaccggccctactaccagtag

SEQ ID NO: 146342 - DNA, 681 bp, Artificial Sequence
  Description of Artificial Sequence: Synthetic coding sequence
atgaaggtgctgatcctggcctgcctggtggccctggccctggcccgggagaccatcgagagcctgagcagcagcgaggagagcatcacagagtacaagcagaaggtggagaaggtgaagcatgaggaccagcagcagggagaagatgagcaccaggacaagatctaccccagcttccagccccagcccctcatctacccctttgtggagcccatcccctacggcttcctgccccagaacatcctgcccctggcccagcctgctgtggtgctgcctgtgccccagcctgagatcatggaggtgcccaaggccaaggacacagtgtacaccaagggccgggtgatgcctgtgctgaagagccccaccatccccttctttgacccccagatccccaagctgacagacctggagaacctgcacctgcccctgcccctgctgcagcccctgatgcagcaggtgccccagcccatcccccagaccctggccctgcccccccagcccctgtggagcgtgccccagcccaaggtgctgcccatcccccagcaggtggtgccctacccccagagagctgtgcctgtgcaggccctgctgctgaaccaggagctgctgctgaaccccacccaccagatctaccctgtgacccagcccctggcccctgtgcacaaccccatctctgtgtag

SEQ ID NO: 146343 - DNA, 549 bp, Artificial Sequence
  Description of Artificial Sequence: Synthetic coding sequence
atgaagagcttcctgctggtggtgaatgccctggccctgaccctgcccttcctggccgtggaggtgcagaaccagaagcagcctgcctgccatgaaaatgatgagcggcccttctaccagaagacagccccctacgtgcccatgtactacgtgcccaacagctacccctactacggcaccaacctgtaccagaggaggcctgccatcgccatcaacaacccctacgtgcccaggacctactatgccaacccagctgtggtgcggccccacgcccagatcccccagaggcagtacctgcccaacagccacccccccaccgtggtgagaagacccaacctgcaccccagcttcatcgccatcccccccaagaagatccaggacaagatcatcatccccaccatcaacaccatcgccaccgtggagcccaccccagccccagccacagagcccaccgtggacagcgtggtgaccccagaggccttcagcgagagcatcatcaccagcaccccagagaccaccaccgtggccgtgaccccacccacagcctag

SEQ ID NO: 146344 - DNA, 978 bp, Artificial Sequence
  Description of Artificial Sequence: Synthetic coding sequence
atggccagcagcagcggcagcaaggccgagttcatcgtgggcggcaagtacaagctggtgaggaagattggcagcggcagctttggagacatctacctggccatcaacatcaccaatggagaggaggtggccgtgaagctggagagccagaaggcccggcacccccagctgctgtatgagagcaagctgtacaagatcctgcagggcggcgtgggcatcccccacatccgctggtacggccaggagaaggactacaacgtgctggtgatggacctgctgggccccagcctggaggacctcttcaacttctgcagccgccgcttcaccatgaagacagtgctgatgctggccgaccagatgatcagccgcatcgagtatgtgcacaccaagaacttcatccaccgggacatcaagccagacaacttcctgatgggcatcggccgccactgcaacaagctgttcctgattgactttggcctggccaagaagtacagagacaacagaacccggcagcacatcccctaccgggaggacaagaacctgaccggcacagcccgctatgccagcatcaatgcccacctgggcatcgagcagagcagaagagatgacatggagagcctgggctacgtgctgatgtacttcaacagaaccagcctgccctggcagggcctgaaggccgccaccaagaagcagaagtatgagaagatcagcgagaagaagatgagcacccctgtggaggtgctgtgcaagggcttccctgctgagtttgccatgtacctgaactactgccggggcctgcgctttgaggaggccccagactacatgtacctgcggcagctgttccgcatcctcttccgcaccctgaaccaccagtatgactacacctttgactggaccatgctgaagcagaaggccgcccagcaggccgccagcagcagcggccagggccagcaggcccagacccccaccggcttctag

SEQ ID NO: 146345 - DNA, 978 bp, Artificial Sequence; identical to SEQ ID NO: 146344
  Description of Artificial Sequence: Synthetic coding sequence

SEQ ID NO: 146346 - DNA, 1014 bp, Artificial Sequence
  Description of Artificial Sequence: Synthetic coding sequence
atggccagcagcagcggcagcaaggccgagttcatcgtgggcggcaagtacaagctggtgaggaagattggcagcggcagctttggagacatctacctggccatcaacatcaccaatggagaggaggtggccgtgaagctggagagccagaaggcccggcacccccagctgctgtatgagagcaagctgtacaagatcctgcagggcggcgtgggcatcccccacatccgctggtacggccaggagaaggactacaacgtgctggtgatggacctgctgggccccagcctggaggacctcttcaacttctgcagccgccgcttcaccatgaagacagtgctgatgctggccgaccagatgatcagccgcatcgagtatgtgcacaccaagaacttcatccaccgggacatcaagccagacaacttcctgatgggcatcggccgccactgcaacaagctgttcctgattgactttggcctggccaagaagtacagagacaacagaacccggcagcacatcccctaccgggaggacaagaacctgaccggcacagcccgctatgccagcatcaatgcccacctgggcatcgagcagagcagaagagatgacatggagagcctgggctacgtgctgatgtacttcaacagaaccagcctgccctggcagggcctgaaggccgccaccaagaagcagaagtatgagaagatcagcgagaagaagatgagcacccctgtggaggtgctgtgcaagggcttccctgctgagtttgccatgtacctgaactactgccggggcctgcgctttgaggaggccccagactacatgtacctgcggcagctgttccgcatcctcttccgcaccctgaaccaccagtatgactacacctttgactggaccatgctgaagcagaaggccgcccagcaggccgccagcagcagcggccagggccagcaggcccagacccccaccgggaagcagacagacaagaccaagagcaacatgaagggcttctag

SEQ ID NO: 146347 - DNA, 1098 bp, Artificial Sequence
  Description of Artificial Sequence: Synthetic coding sequence
atggccagcagcagcggcagcaaggccgagttcatcgtgggcggcaagtacaagctggtgaggaagattggcagcggcagctttggagacatctacctggccatcaacatcaccaatggagaggaggtggccgtgaagctggagagccagaaggcccggcacccccagctgctgtatgagagcaagctgtacaagatcctgcagggcggcgtgggcatcccccacatccgctggtacggccaggagaaggactacaacgtgctggtgatggacctgctgggccccagcctggaggacctcttcaacttctgcagccgccgcttcaccatgaagacagtgctgatgctggccgaccagatgatcagccgcatcgagtatgtgcacaccaagaacttcatccaccgggacatcaagccagacaacttcctgatgggcatcggccgccactgcaacaagtgcctggagagccctgtgggcaagaggaagaggtccatgacagtgtccaccagccaggaccccagcttcagcggcctgaaccagctgttcctgattgactttggcctggccaagaagtacagagacaacagaacccggcagcacatcccctaccgggaggacaagaacctgaccggcacagcccgctatgccagcatcaatgcccacctgggcatcgagcagagcagaagagatgacatggagagcctgggctacgtgctgatgtacttcaacagaaccagcctgccctggcagggcctgaaggccgccaccaagaagcagaagtatgagaagatcagcgagaagaagatgagcacccctgtggaggtgctgtgcaagggcttccctgctgagtttgccatgtacctgaactactgccggggcctgcgctttgaggaggccccagactacatgtacctgcggcagctgttccgcatcctcttccgcaccctgaaccaccagtatgactacacctttgactggaccatgctgaagcagaaggccgcccagcaggccgccagcagcagcggccagggccagcaggcccagacccccaccgggaagcagacagacaagaccaagagcaacatgaagggcttctag

SEQ ID NO: 146348 - DNA, 1029 bp, Artificial Sequence
  Description of Artificial Sequence: Synthetic coding sequence
tgccgggaggagatcagccgcatcgagtacatccacagcaagaacttcatccacagagatgtgaagccagacaacttcctgatgggcctgggcaagaagggcaacctggtgtacatcatcgactttggcctggccaagaagtacagagatgcccggacccaccagcacatcccctaccgggagaacaagaacctgaccggcacagcccgctatgccagcatcaacacccacctgggcatcgagcagagcagaagagatgacctggagagcctgggctacgtgctgatgtacttcaacctgggcagcctgccctggcagggcctgaaggccgccaccaagaggcagaagtatgagcgcatcagcgagaagaagatgagcacccccatcgaggtgctgtgcaagggctaccccagcgagtttgccacctacctgaacttctgccgcagcctgcgctttgatgacaagccagactacagctacctgcggcagctgttcaggaacctcttccaccggcagggcttctcctatgactatgtgtttgactggaacatgctgaagtttggagccagcagagctgctgatgatgctgagcgggagcggcgggaccgggaggagcggctgcggcacagcagaaatcctgccacccggggcctgcccagcacagccagcggccgcctgcggggcacccaggaggtggccccacccacccccctgacccccaccagccacacagccaacaccagccccaggcctgtgtctggcatggagcgggagaggaaggtgtccatgaggctgcacagaggagcccctgtgaacatcagcagcagtgacctgaccggccggcaggacaccagcaggatgagcaccagccaggtgggcgctgagctgcccggcggccgctgggccagcggctaccctgtgcgggtgaagagcggcctgtggttcctgcagggcttcttcttccccttcttcccccccttcctgcgggtcttcaacctggcccgggtgtggaggctgggctgcaggtag

SEQ ID NO: 146349 - DNA, 1248 bp, Artificial Sequence
  Description of Artificial Sequence: Synthetic coding sequence
atggagctgcgggtgggcaaccgctaccgcctgggcaggaagattggcagcggcagctttggagacatctacctgggcacagacattgctgctggggaggaggtggccatcaagctggagtgtgtgaagaccaagcacccccagctgcacatcgagagcaagatctacaagatgatgcagggcggcgtgggcatccccaccatccgctggtgtggggctgagggggactacaacgtgatggtgatggagctgctgggccccagcctggaggacctcttcaacttctgcagcaggaagttcagcctgaagacagtgctgctgctggccgaccagatgatcagccgcatcgagtacatccacagcaagaacttcatccacagagatgtgaagccagacaacttcctgatgggcctgggcaagaagggcaacctggtgtacatcatcgactttggcctggccaagaagtacagagatgcccggacccaccagcacatcccctaccgggagaacaagaacctgaccggcacagcccgctatgccagcatcaacacccacctgggcatcgagcagagcagaagagatgacctggagagcctgggctacgtgctgatgtacttcaacctgggcagcctgccctggcagggcctgaaggccgccaccaagaggcagaagtatgagcgcatcagcgagaagaagatgagcacccccatcgaggtgctgtgcaagggctaccccagcgagtttgccacctacctgaacttctgccgcagcctgcgctttgatgacaagccagactacagctacctgcggcagctgttcaggaacctcttccaccggcagggcttctcctatgactatgtgtttgactggaacatgctgaagtttggagccagcagagctgctgatgatgctgagcgggagcggcgggaccgggaggagcggctgcggcacagcagaaatcctgccacccggggcctgcccagcacagccagcggccgcctgcggggcacccaggaggtggccccacccacccccctgacccccaccagccacacagccaacaccagccccaggcctgtgtctggcatggagcgggagaggaaggtgtccatgaggctgcacagaggagcccctgtgaacatcagcagcagtgacctgaccggccggcaggacaccagcaggatgagcaccagccagatccctggccgggtggccagcagcggcctgcagagcgtggtgcacaggtag

SEQ ID NO: 146350 - DNA, 1230 bp, Artificial Sequence
  Description of Artificial Sequence: Synthetic coding sequence
atggagctgcgggtgggcaaccgctaccgcctgggcaggaagattggcagcggcagctttggagacatctacctgggcacagacattgctgctggggaggaggtggccatcaagctggagtgtgtgaagaccaagcacccccagctgcacatcgagagcaagatctacaagatgatgcagggcggcgtgggcatccccaccatccgctggtgtggggctgagggggactacaacgtgatggtgatggagctgctgggccccagcctggaggacctcttcaacttctgcagcaggaagttcagcctgaagacagtgctgctgctggccgaccagatgatcagccgcatcgagtacatccacagcaagaacttcatccacagagatgtgaagccagacaacttcctgatgggcctgggcaagaagggcaacctggtgtacatcatcgactttggcctggccaagaagtacagagatgcccggacccaccagcacatcccctaccgggagaacaagaacctgaccggcacagcccgctatgccagcatcaacacccacctgggcatcgagcagagcagaagagatgacctggagagcctgggctacgtgctgatgtacttcaacctgggcagcctgccctggcagggcctgaaggccgccaccaagaggcagaagtatgagcgcatcagcgagaagaagatgagcacccccatcgaggtgctgtgcaagggctaccccagcgagtttgccacctacctgaacttctgccgcagcctgcgctttgatgacaagccagactacagctacctgcggcagctgttcaggaacctcttccaccggcagggcttctcctatgactatgtgtttgactggaacatgctgaagtttggagccagcagagctgctgatgatgctgagcgggagcggcgggaccgggaggagcggctgcggcacagcagaaatcctgccacccggggcctgcccagcacagccagcggccgcctgcggggcacccaggaggtggccccacccacccccctgacccccaccagccacacagccaacaccagccccaggcctgtgtctggcatggagcgggagaggaaggtgtccatgaggctgcacagaggagcccctgtgaacatcagcagcagtgacctgaccggccggcaggacaccagcaggatgagcaccagccagaacagcatcccctttgagcaccacggcaagtag

SEQ ID NO: 146351 - DNA, 1077 bp, Artificial Sequence
  Description of Artificial Sequence: Synthetic coding sequence
atgatgcagggcggcgtgggcatccccaccatccgctggtgtggggctgagggggactacaacgtgatggtgatggagctgctgggccccagcctggaggacctcttcaacttctgcagcaggaagttcagcctgaagacagtgctgctgctggccgaccagatgatcagcagaattgagtacatccacagcaagaacttcatccacagagatgtgaagccagacaacttcctgatgggcctgggcaagaagggcaacctggtgtacatcatcgactttggcctggccaagaagtacagagatgcccggacccaccagcacatcccctaccgggagaacaagaacctgactggaacagcccgctatgccagcatcaacacccacctgggcatcgagcagagcagaagagatgacctggagagcctgggctacgtgctgatgtacttcaacctgggcagcctgccctggcagggcctgaaggccgccaccaagaggcagaagtatgaaagaatcagcgagaagaagatgagcacccccatcgaggtgctgtgcaagggctaccccagcgagtttgccacctacctgaacttctgccgcagcctgcgctttgatgacaagccagactacagctacctgcggcagctgttcaggaacctcttccaccggcagggcttctcctatgactatgtgtttgactggaacatgctgaagtttggagccagcagagctgctgatgatgctgagcgggagcggcgggaccgggaggagcggctgcggcacagcaggaacccagccacccggggcctgcccagcacagccagcggccgcctgcggggcacccaggaggtggccccacccacccccctgacccccaccagccacacagccaacaccagccccaggcctgtgtctggcatggagcgggagaggaaggtgtccatgaggctgcacagaggagcccctgtgaacatcagcagcagtgacctgaccggccggcaggacaccagcaggatgagcaccagccagatccctggccgggtggccagcagcggcctgcagagcgtggtgcacaggtag

SEQ ID NO: 146352 - DNA, 381 bp, Artificial Sequence
  Description of Artificial Sequence: Synthetic coding sequence
atggagctgcgggtgggcaaccgctaccgcctgggcaggaagattggcagcggcagctttggagacatctacctgggcacagacattgctgctggggaggaggtggccatcaagctggagtgtgtgaagaccaagcacccccagctgcacatcgagagcaagatctacaagatgatgcagggcggcgtgggcatccccaccatccgctggtgtggggctgagggggactacaacgtgatggtgatggagctgctgggccccagcctggaggacctcttcaacttctgcagcaggaagttcagcctgaagacagtgctgctgctggccgaccagatgaacaaccctgaggagatgacctggagcctgtgggccacctgctag

SEQ ID NO: 146353 - DNA, 1251 bp, Artificial Sequence
  Description of Artificial Sequence: Synthetic coding sequence
atggagctgcgggtgggcaacaagtaccgcctgggcaggaagattggcagcggcagctttggagacatctacctgggcgccaacatcgccagcggggaggaggtggccatcaagctggagtgtgtgaagaccaagcacccccagctgcacatcgagagcaagttctacaagatgatgcagggcggcgtgggcatccccagcatcaagtggtgtggggctgagggggactacaacgtgatggtgatggagctgctgggccccagcctggaggacctcttcaacttctgcagcaggaagttcagcctgaagacagtgctgctgctggccgaccagatgatcagccgcatcgagtacatccacagcaagaacttcatccacagagatgtgaagccagacaacttcctgatgggcctgggcaagaagggcaacctggtgtacatcatcgactttggcctggccaagaagtacagagatgcccggacccaccagcacatcccctaccgggagaacaagaacctgaccggcacagcccgctatgccagcatcaacacccacctgggcatcgagcagagcagaagagatgacctggagagcctgggctacgtgctgatgtacttcaacctgggcagcctgccctggcagggcctgaaggccgccaccaagaggcagaagtatgagcgcatcagcgagaagaagatgagcacccccatcgaggtgctgtgcaagggctaccccagcgagttcagcacctacctgaacttctgccgcagcctgcgctttgatgacaagccagactacagctacctgcggcagctgttcaggaacctcttccaccggcagggcttctcctatgactatgtgtttgactggaacatgctgaagtttggagctgccagaaatccagaagatgtggaccgggagcggcgggagcacgagcgggaggagaggatgggccagctgcggggcagcgccacccgggccctgcccccaggcccccccaccggggccacagccaaccggctgcggtctgctgctgagcctgtggccagcaccccagccagccgcatccagcctgctggcaacaccagcccccgggccatcagccgggtggaccgggagaggaaggtgtccatgaggctgcacagaggagccccagccaacgtgagcagcagtgacctgaccggccggcaggaggtgagccgcatcccagccagccagacctctgtgccctttgaccacctgggcaagtag

SEQ ID NO: 146354 - DNA, 360 bp, Artificial Sequence
  Description of Artificial Sequence: Synthetic coding sequence
tgaagaaatccagaagatgtggaccgggagcggcgggagcacgagcgggaggagaggatgggccagctgcggggcagcgccacccgggccctgcccccaggccccccaactggagccacagccaaccggctgcggtctgctgctgagcctgtggccagcaccccagccagccgcatccagcctgctggcaacaccagcccccgggccatcagccgggtggaccgggagaggaaggtgtccatgaggctgcacagaggagccccagccaacgtgagcagcagtgacctgaccggccggcaggaggtgagccgcatcccagccagccagacctctgtgccctttgaccacctgggcaagtag

SEQ ID NO: 146355 - DNA, 1251 bp, Artificial Sequence; identical to SEQ ID NO: 146353
  Description of Artificial Sequence: Synthetic coding sequence

SEQ ID NO: 146356 - DNA, 1251 bp, Artificial Sequence; identical to SEQ ID NO: 146353
  Description of Artificial Sequence: Synthetic coding sequence

SEQ ID NO: 146357 - DNA, 1251 bp, Artificial Sequence; identical to SEQ ID NO: 146353
  Description of Artificial Sequence: Synthetic coding sequence

SEQ ID NO: 146358 - DNA, 1251 bp, Artificial Sequence; identical to SEQ ID NO: 146353
  Description of Artificial Sequence: Synthetic coding sequence

SEQ ID NO: 146359 - DNA, 678 bp, Artificial Sequence
  Description of Artificial Sequence: Synthetic coding sequence
atggagctgcgggtgggcaacaagtaccgcctgggcaggaagattggcagcggcagctttggagacatctacctgggcgccaacatcgccagcggggaggaggtggccatcaagctggagtgtgtgaagaccaagcacccccagctgcacatcgagagcaagttctacaagatgatgcagggcggcgtgggcatccccagcatcaagtggtgtggggctgagggggactacaacgtgatggtgatggagctgctgggccccagcctggaggacctcttcaacttctgcagcaggaagttcagcctgaagacagtgctgctgctggccgaccagatgatcagccgcatcgagtacatccacagcaagaacttcatccacagagatgtgaagccagacaacttcctgatgggcctgggcaagaagggcaacctggtgtacatcatcgactttggcctggccaagaagtacagagatgcccggacccaccagcacatcccctaccgggagaacaagaacctgaccggcacagcccgctatgccagcatcaacacccacctgggcatcgagcagagcagaagagatgacctggagagcctgggctacgtgctgatgtacttcaacctgggcagcctgccctggcagggcctgaaggccgccaccaagaggcagaagtactag

SEQ ID NO: 146360 - DNA, 435 bp, Artificial Sequence
  Description of Artificial Sequence: Synthetic coding sequence
tgaagaaacctcttccaccggcagggcttctcctatgactatgtgtttgactggaacatgctgaagtttggagctgccagaaatccagaagatgtggaccgggagcggcgggagcacgagcgggaggagaggatgggccagctgcggggcagcgccacccgggccctgcccccaggcccccccaccggggccacagccaaccggctgcggtctgctgctgagcctgtggccagcaccccagccagccgcatccagcctgctggcaacaccagcccccgggccatcagccgggtggaccgggagaggaaggtgtccatgaggctgcacagaggagccccagccaacgtgagcagcagtgacctgaccggccggcaggaggtgagccgcatcccagccagccagacctctgtgccctttgaccacctgggcaagtag

SEQ ID NO: 146361 - DNA, 1182 bp, Artificial Sequence
  Description of Artificial Sequence: Synthetic coding sequence
atggaccaccccagccgggagaaggatgagcggcagaggaccaccaagcccatggcccagaggtctgcccactgcagccggcccagcggcagcagcagcagcagtggagtgctgatggtgggccccaacttccgggtgggcaagaagattggctgcggcaactttggagagctgcggctgggcaagaacctgtacaccaatgaatatgtggccatcaagctggagcccatcaagagccgggccccccagctgcacctggagtaccgcttctacaagcagctgggcagcgctggggagggcctgccccaggtgtactacttcggcccctgtgggaagtacaatgccatggtgctggagctgctgggccccagcctggaggacctgtttgacctgtgtgacaggaccttcaccctgaagacagtgctgatgattgccatccagctgctgagcaggatggagtatgtgcacagcaagaacctgatctacagagatgtgaagccagagaacttcctgattggccggcagggcaacaagaaggagcacgtgatccacatcatcgactttggcctggccaaggagtacattgatcctgagaccaagaagcacatcccctaccgggagcacaagagcctgaccggcacagcccgctacatgagcatcaacacccacctgggcaaggagcagagcagaagagatgacctggaggccctgggccacatgttcatgtacttcctgcggggcagcctgccctggcagggcctgaaggctgacaccctgaaggagcgctaccagaagatcggggacaccaagaggaacacccccatcgaggccctgtgtgagaacttccctgaggagatggccacctacctgcgctacgtgcggcggctggacttctttgagaagccagactatgagtacctgcggaccctcttcacagacctgtttgagaagaagggctacacctttgattatgcctatgactgggtgggccggcccatccccacccctgtgggctctgtgcacgtggacagcggggccagcgccatcacccgggagagccacacccaccgggaccggcccagccagcagcagcccctgaggaaccagagcctgaggacagtgacagctgagcactatgatgtgaacaacagcgccatctggcaccggggccggggcacctag

SEQ ID NO: 146362 - DNA, 1269 bp, Artificial Sequence
  Description of Artificial Sequence: Synthetic coding sequence
atggaccaccccagccgggagaaggatgagcggcagaggaccaccaagcccatggcccagaggtctgcccactgcagccggcccagcggcagcagcagcagcagtggagtgctgatggtgggccccaacttccgggtgggcaagaagattggctgcggcaactttggagagctgcggctgggcaagaacctgtacaccaatgaatatgtggccatcaagctggagcccatcaagagccgggccccccagctgcacctggagtaccgcttctacaagcagctgggcagcgctggggagggcctgccccaggtgtactacttcggcccctgtgggaagtacaatgccatggtgctggagctgctgggccccagcctggaggacctgtttgacctgtgtgacaggaccttcaccctgaagacagtgctgatgattgccatccagctgctgagcaggatggagtatgtgcacagcaagaacctgatctacagagatgtgaagccagagaacttcctgattggccggcagggcaacaagaaggagcacgtgatccacatcatcgactttggcctggccaaggagtacattgatcctgagaccaagaagcacatcccctaccgggagcacaagagcctgaccggcacagcccgctacatgagcatcaacacccacctgggcaaggagcagagcagaagagatgacctggaggccctgggccacatgttcatgtacttcctgcggggcagcctgccctggcagggcctgaaggctgacaccctgaaggagcgctaccagaagatcggggacaccaagaggaacacccccatcgaggccctgtgtgagaacttccctgaggagatggccacctacctgcgctacgtgcggcggctggacttctttgagaagccagactatgagtacctgcggaccctcttcacagacctgtttgagaagaagggctacacctttgattatgcctatgactgggtgggccggcccatccccacccctgtgggctctgtgcacgtggacagcggggccagcgccatcacccgggagagccacacccaccgggaccggcccagccagcagcagcccctgaggaaccaggtggtgagcagcaccaatggagagctgaatgtggatgaccccaccggggcccacagcaatgcccccatcacagcccacgccgaggtggaggtggtggaggaggccaagtgctgctgcttcttcaagaggaagaggaagaagacagcccagaggcacaagtag

SEQ ID NO: 146363 - DNA, 1137 bp, Artificial Sequence
  Description of Artificial Sequence: Synthetic coding sequence
atggaccaccccagccgggagaaggatgagcggcagaggaccaccaagcccatggcccagaggtctgcccactgcagccggcccagcggcagcagcagcagcagtggagtgctgatggtgggccccaacttccgggtgggcaagaagattggctgcggcaactttggagagctgcggctgggcaagaacctgtacaccaatgaatatgtggccatcaagctggagctgctgggccccagcctggaggacctgtttgacctgtgtgacaggaccttcaccctgaagacagtgctgatgattgccatccagctgctgagcaggatggagtatgtgcacagcaagaacctgatctacagagatgtgaagccagagaacttcctgattggccggcagggcaacaagaaggagcacgtgatccacatcatcgactttggcctggccaaggagtacattgatcctgagaccaagaagcacatcccctaccgggagcacaagagcctgaccggcacagcccgctacatgagcatcaacacccacctgggcaaggagcagagcagaagagatgacctggaggccctgggccacatgttcatgtacttcctgcggggcagcctgccctggcagggcctgaaggctgacaccctgaaggagcgctaccagaagatcggggacaccaagaggaacacccccatcgaggccctgtgtgagaacttccctgaggagatggccacctacctgcgctacgtgcggcggctggacttctttgagaagccagactatgagtacctgcggaccctcttcacagacctgtttgagaagaagggctacacctttgattatgcctatgactgggtgggccggcccatccccacccctgtgggctctgtgcacgtggacagcggggccagcgccatcacccgggagagccacacccaccgggaccggcccagccagcagcagcccctgaggaaccaggtggtgagcagcaccaatggagagctgaatgtggatgaccccaccggggcccacagcaatgcccccatcacagcccacgccgaggtggaggtggtggaggaggccaagtgctgctgcttcttcaagaggaagaggaagaagacagcccagaggcacaagtag

SEQ ID NO: 146364 - DNA, 1248 bp, Artificial Sequence
  Description of Artificial Sequence: Synthetic coding sequence
atggactttgacaagaagggcggcaaaggagaaacagaggagggccgcaggatgagcaaggccggcggcggccgcagcagccacggcatccgcagcagcggcaccagcagtggagtgctgatggtgggccccaacttccgggtgggcaagaagattggctgcggcaactttggagagctgcggctgggcaagaacctgtacaccaatgaatatgtggccatcaagctggagcccatcaagagccgggccccccagctgcacctggagtaccgcttctacaagcagctgagcgccacagaaggagtgccccaggtgtactacttcggcccctgtgggaagtacaatgccatggtgctggagctgctgggccccagcctggaggacctgtttgacctgtgtgacaggaccttcaccctgaagacagtgctgatgattgccatccagctgatcaccaggatggagtatgtgcacaccaagagcctcatctacagagatgtgaagccagagaacttcctggtgggccggcccggcaccaagaggcagcacgccatccacatcatcgactttggcctggccaaggagtacatcgaccctgagaccaagaagcacatcccctaccgggagcacaagagcctgactggaacagcccgctacatgagcatcaacacccacctgggcaaggagcagagcagaagagatgacctggaggccctgggccacatgttcatgtacttcctgcggggcagcctgccctggcagggcctgaaggctgacaccctgaaggagcgctaccagaagattggagacaccaagagggccacccccatcgaggtgctgtgtgagaacttccctgaggagatggccacctacctgcgctacgtgcggcggctggacttctttgagaagccagactatgactacctgaggaagctgttcacagacctgtttgacagaagtggctttgtgtttgattatgaatatgactgggccggcaagcccctgcccacccccatcggcaccgtgcacacagacctgcccagccagccccagctgcgggacaagacccagccccacagcaagaaccaggccctgaacagcaccaacggggagctgaatgctgatgaccccacagctggccacagcaatgcccccatcacagccccagctgaggtggaggtggctgatgagaccaagtgctgctgcttcttcaagaggaggaagaggaagagcctgcagaggcacaagtag

SEQ ID NO: 146365 - DNA, 645 bp, Artificial Sequence
  Description of Artificial Sequence: Synthetic coding sequence
atgagcatcaacacccacctgggcaaggagcagagcagaagagatgacctggaggccctgggccacatgttcatgtacttcctgcggggcagcctgccctggcagggcctgaaggctgacaccctgaaggagcgctaccagaagattggagacaccaagagggccacccccatcgaggtgctgtgtgagaacttccctgaggagatggccacctacctgcgctacgtgcggcggctggacttctttgagaagccagactatgactacctgaggaagctgttcacagacctgtttgacagaagtggctttgtgtttgattatgaatatgactgggccggcaagcccctgcccacccccatcggcaccgtgcacacagacctgcccagccagccccagctgcgggacaagacccagcccccagagagcagcccctgcagccccctgggccgggacctggtgcggggcccccggggccccccaacagctgcccagggccagaccctggccggcagccagaatgctgactgccggggccgggcctggctgcggcggccccaccccagagatgtgggcagcctgcccagctgcaagaccctggccgagatcagcacccctgtgagcagcccccccctgcaggagcactag

SEQ ID NO: 146366 - DNA, 1272 bp, Artificial Sequence
  Description of Artificial Sequence: Synthetic coding sequence
atggagaacaagaagaaggacaaggacaagagtgatgacaggatggcccggcccagcggccgcagcggccacaacacccggggcaccggcagcagcagcagcggcgtgctgatggtgggccccaacttccgggtgggcaagaagattggctgcggcaactttggagagctgcggctgggcaagaacctgtacaccaatgaatatgtggccatcaagctggagcccatgaagagccgggccccccagctgcacctggagtaccgcttctacaagcagctgggcagcggagatggcatcccccaggtgtactacttcggcccctgtgggaagtacaatgccatggtgctggagctgctgggccccagcctggaggacctgtttgacctgtgtgacaggaccttcagcctgaagacagtgctgatgattgccatccagctgatcagcaggatggagtatgtgcacagcaagaacctgatctacagagatgtgaagccagagaacttcctgattggccggcccggcaacaagacccagcaggtgatccacatcatcgactttggcctggccaaggagtacattgatcctgagaccaagaagcacatcccctaccgggagcacaagagcctgaccggcacagcccgctacatgagcatcaacacccacctgggcaaggagcagagcagaagagatgacctggaggccctgggccacatgttcatgtacttcctgcggggcagcctgccctggcagggcctgaaggctgacaccctgaaggagcgctaccagaagatcggggacaccaagagggccacccccatcgaggtgctgtgtgagaacttccctgagatggccacctacctgcgctacgtgcggcggctggacttctttgagaagccagactatgactacctgaggaagctgttcacagacctgtttgacaggaagggctacatgtttgattatgaatatgactggattggcaagcagctgcccacccctgtgggcgctgtgcagcaggaccctgccctgagcagcaaccgggaggcccaccagcaccgggacaagatgcagcagagcaagaaccaggtggtgagcagcaccaacggggagctgaacacagatgaccccacagctggccgcagcaatgcccccatcacagcccccacagaggtggaggtgatggatgagaccaactgccagaaggtgctgaacatgtggtgctgctgcttcttcaagaggaggaagaggaagaccatccagaggcacaagtag

SEQ ID NO: 146367 - DNA, 1368 bp, Artificial Sequence
  Description of Artificial Sequence: Synthetic coding sequence
atggagaacaagaagaaggacaaggacaagagtgatgacaggatggcccggcccagcggccgcagcggccacaacacccggggcaccggcagcagcagcagcggcgtgctgatggtgggccccaacttccgggtgggcaagaagattggctgcggcaactttggagagctgcggctgggcaagaacctgtacaccaatgaatatgtggccatcaagctggagcccatgaagagccgggccccccagctgcacctggagtaccgcttctacaagcagctgggcagcggagatggcatcccccaggtgtactacttcggcccctgtgggaagtacaatgccatggtgctggagctgctgggccccagcctggaggacctgtttgacctgtgtgacaggaccttcagcctgaagacagtgctgatgattgccatccagctgatcagcaggatggagtatgtgcacagcaagaacctgatctacagagatgtgaagccagagaacttcctgattggccggcccggcaacaagacccagcaggtgatccacatcatcgactttggcctggccaaggagtacattgatcctgagaccaagaagcacatcccctaccgggagcacaagagcctgaccggcacagcccgctacatgagcatcaacacccacctgggcaaggagcagagcagaagagatgacctggaggccctgggccacatgttcatgtacttcctgcggggcagcctgccctggcagggcctgaaggctgacaccctgaaggagcgctaccagaagatcggggacaccaagagggccacccccatcgaggtgctgtgtgagaacttccctgagatggccacctacctgcgctacgtgcggcggctggacttctttgagaagccagactatgactacctgaggaagctgttcacagacctgtttgacaggaagggctacatgtttgattatgaatatgactggattggcaagcagctgcccacccctgtgggcgctgtgcagcaggaccctgccctgagcagcaaccgggaggcccaccagcaccgggacaagatgcagcagagcaagaaccagagcgctgaccaccgggccgcctgggacagccagcaggccaacccccaccacctgcgggcccacctggccgctgacagacatggaggctctgtgcaggtggtgagcagcaccaacggggagctgaacacagatgaccccacagctggccgcagcaatgcccccatcacagcccccacagaggtggaggtgatggatgagaccaactgccagaaggtgctgaacatgtggtgctgctgcttcttcaagaggaggaagaggaagaccatccagaggcacaagtag

SEQ ID NO: 146368 - DNA, 1344 bp, Artificial Sequence
  Description of Artificial Sequence: Synthetic coding sequence
atggagaacaagaagaaggacaaggacaagagtgatgacaggatggcccggcccagcggccgcagcggccacaacacccggggcaccggcagcagcagcagcggcgtgctgatggtgggccccaacttccgggtgggcaagaagattggctgcggcaactttggagagctgcggctgggcaagaacctgtacaccaatgaatatgtggccatcaagctggagcccatgaagagccgggccccccagctgcacctggagtaccgcttctacaagcagctgggcagcggagatggcatcccccaggtgtactacttcggcccctgtgggaagtacaatgccatggtgctggagctgctgggccccagcctggaggacctgtttgacctgtgtgacaggaccttcagcctgaagacagtgctgatgattgccatccagctgatcagcaggatggagtatgtgcacagcaagaacctgatctacagagatgtgaagccagagaacttcctgattggccggcccggcaacaagacccagcaggtgatccacatcatcgactttggcctggccaaggagtacattgatcctgagaccaagaagcacatcccctaccgggagcacaagagcctgaccggcacagcccgctacatgagcatcaacacccacctgggcaaggagcagagcagaagagatgacctggaggccctgggccacatgttcatgtacttcctgcggggcagcctgccctggcagggcctgaaggctgacaccctgaaggagcgctaccagaagatcggggacaccaagagggccacccccatcgaggtgctgtgtgagaacttccctgagatggccacctacctgcgctacgtgcggcggctggacttctttgagaagccagactatgactacctgaggaagctgttcacagacctgtttgacaggaagggctacatgtttgattatgaatatgactggattggcaagcagctgcccacccctgtgggcgctgtgcagcaggaccctgccctgagcagcaaccgggaggcccaccagcaccgggacaagatgcagcagagcaagaaccagagcgctgaccaccgggccgcctgggacagccagcaggccaacccccaccacctgcgggcccacctggccgctgacagacatggaggctctgtgcaggtggtgagcagcaccaacggggagctgaacacagatgaccccacagctggccgcagcaatgcccccatcacagcccccacagaggtggaggtgatggatgagaccaagtgctgctgcttcttcaagaggaggaagaggaagaccatccagaggcacaagtag

SEQ ID NO: 146369 - DNA, 1344 bp, Artificial Sequence; identical to SEQ ID NO: 146368
  Description of Artificial Sequence: Synthetic coding sequence

SEQ ID NO: 146370 - DNA, 1368 bp, Artificial Sequence; identical to SEQ ID NO: 146367
  Description of Artificial Sequence: Synthetic coding sequence

SEQ ID NO: 146371 - DNA, 1275 bp, Artificial Sequence
  Description of Artificial Sequence: Synthetic coding sequence
atggagaacaagaagaaggacaaggacaagagtgatgacaggatggcccggcccagcggccgcagcggccacaacacccggggcaccggcagcagcagcagcggcgtgctgatggtgggccccaacttccgggtgggcaagaagattggctgcggcaactttggagagctgcggctgggcaagaacctgtacaccaatgaatatgtggccatcaagctggagcccatgaagagccgggccccccagctgcacctggagtaccgcttctacaagcagctgggcagcggagatggcatcccccaggtgtactacttcggcccctgtgggaagtacaatgccatggtgctggagctgctgggccccagcctggaggacctgtttgacctgtgtgacaggaccttcagcctgaagacagtgctgatgattgccatccagctgatcagcaggatggagtatgtgcacagcaagaacctgatctacagagatgtgaagccagagaacttcctgattggccggcccggcaacaagacccagcaggtgatccacatcatcgactttggcctggccaaggagtacattgatcctgagaccaagaagcacatcccctaccgggagcacaagagcctgaccggcacagcccgctacatgagcatcaacacccacctgggcaaggagcagagcagaagagatgacctggaggccctgggccacatgttcatgtacttcctgcggggcagcctgccctggcagggcctgaaggctgacaccctgaaggagcgctaccagaagatcggggacaccaagagggccacccccatcgaggtgctgtgtgagaacttccctgaggagatggccacctacctgcgctacgtgcggcggctggacttctttgagaagccagactatgactacctgaggaagctgttcacagacctgtttgacaggaagggctacatgtttgattatgaatatgactggattggcaagcagctgcccacccctgtgggcgctgtgcagcaggaccctgccctgagcagcaaccgggaggcccaccagcaccgggacaagatgcagcagagcaagaaccaggtggtgagcagcaccaatggagagctgaacacagatgaccccacagctggccgcagcaatgcccccatcacagcccccacagaggtggaggtgatggatgagaccaactgccagaaggtgctgaacatgtggtgctgctgcttcttcaagaggaggaagaggaagaccatccagaggcacaagtag

SEQ ID NO: 146372 - DNA, 1272 bp, Artificial Sequence; identical to SEQ ID NO: 146366
  Description of Artificial Sequence: Synthetic coding sequence

SEQ ID NO: 146373 - DNA, 648 bp, Artificial Sequence
  Description of Artificial Sequence: Synthetic coding sequence
atgagcagcagcgaggaggtgtcctggatctcctggttctgtggcctgcggggaaatgagttcttctgtgaggtggatgaggactacatccaggacaagttcaacctgaccggcctgaatgagcaggtgccccactaccggcaggccctggacatgatcctggacctggagccagatgaggagctggaggacaaccccaaccagagcgacctgattgagcaggccgctgagatgctgtatggcctcatccacgcccgctacatcctgaccaacagaggcatcgcccagatgctggagaagtaccagcagggcgactttggctactgcccccgggtgtactgtgagaaccagcccatgctgcccatcggcctgagtgacatccctggagaggccatggtgaagctgtactgccccaagtgcatggatgtgtacacccccaagagcagccgccaccaccacacagatggagcctactttggaacaggcttcccccacatgctgttcatggtgcaccctgagtaccggcccaagaggcctgccaaccagtttgtgccccggctgtatggcttcaagatccaccccatggcctaccagctgcagctgcaggccgccagcaacttcaagagccctgtgaagaccatcagatag

SEQ ID NO: 146374 - DNA, 648 bp, Artificial Sequence; identical to SEQ ID NO: 146373
  Description of Artificial Sequence: Synthetic coding sequence

SEQ ID NO: 146375 - DNA, 648 bp, Artificial Sequence; identical to SEQ ID NO: 146373
  Description of Artificial Sequence: Synthetic coding sequence

SEQ ID NO: 146376 - DNA, 648 bp, Artificial Sequence; identical to SEQ ID NO: 146373
  Description of Artificial Sequence: Synthetic coding sequence

SEQ ID NO: 146377 - DNA, 687 bp, Artificial Sequence
  Description of Artificial Sequence: Synthetic coding sequence
atgagcagcagcgaggaggtgtcctggatctcctggttctgtggcctgcggggaaatgagttcttctgtgaggtggatgaggactacatccaggacaagttcaacctgaccggcctgaatgagcaggtgccccactaccggcaggccctggacatgatcctggacctggagccagatgaggagctggaggacaaccccaaccagagcgacctgattgagcaggccgctgagatgctgtatggcctcatccacgcccgctacatcctgaccaacagaggcatcgcccagatgctggagaagtaccagcagggcgactttggctactgcccccgggtgtactgtgagaaccagcccatgctgcccatcggcctgagtgacatccctggagaggccatggtgaagctgtactgccccaagtgcatggatgtgtacacccccaagagcagccgccaccaccacacagatggagcctactttggaacaggcttcccccacatgctgttcatggtgcaccctgagtaccggcccaagaggcctgccaaccagtttgtgcccagcagctgcagccgccacccagatgtgcccctgctgccccggcggcggcccttctgcaggatgcacttccggctgcgggaggtgtaccaccagcagctgatccctgtgcacggggaccaccacctgctgtag

SEQ ID NO: 146378 - DNA, 648 bp, Artificial Sequence; identical to SEQ ID NO: 146373
  Description of Artificial Sequence: Synthetic coding sequence

SEQ ID NO: 146379 - DNA, 648 bp, Artificial Sequence; identical to SEQ ID NO: 146373
  Description of Artificial Sequence: Synthetic coding sequence

SEQ ID NO: 146380 - DNA, 705 bp, Artificial Sequence
  Description of Artificial Sequence: Synthetic coding sequence
atggagaagtgcaagggcaccagcaggatggccggcaccaccagcgcagatgtgaagatgagcagcagcgaggaggtgtcctggatctcctggttctgtggcctgcggggaaatgagttcttctgtgaggtggatgaggactacatccaggacaagttcaacctgaccggcctgaatgagcaggtgccccactaccggcaggccctggacatgatcctggacctggagccagatgaggagctggaggacaaccccaaccagagcgacctgattgagcaggccgctgagatgctgtatggcctcatccacgcccgctacatcctgaccaacagaggaattgcccagatgctggagaagtaccagcagggcgactttggctactgcccccgggtgtactgtgagaaccagcccatgctgcccatcggcctgagtgacatccctggagaggccatggtgaagctgtactgccccaagtgcatggatgtgtacacccccaagagcagccgccaccaccacacagatggagcctacttcggcaccggcttcccccacatgctgttcatggtgcaccctgagtaccggcccaagaggcctgccaaccagtttgtgccccggctgtatggcttcaagatccaccccatggcctaccagctgcagctgcaggccgccagcaacttcaagagccctgtgaagaccatcagatag

SEQ ID NO: 146381 - DNA, 648 bp, Artificial Sequence; identical to SEQ ID NO: 146373
  Description of Artificial Sequence: Synthetic coding sequence

SEQ ID NO: 146382 - DNA, 687 bp, Artificial Sequence; identical to SEQ ID NO: 146377
  Description of Artificial Sequence: Synthetic coding sequence

SEQ ID NO: 146383 - DNA, 687 bp, Artificial Sequence; identical to SEQ ID NO: 146377
  Description of Artificial Sequence: Synthetic coding sequence

SEQ ID NO: 146384 - DNA, 648 bp, Artificial Sequence; identical to SEQ ID NO: 146373
  Description of Artificial Sequence: Synthetic coding sequence

SEQ ID NO: 146385 - DNA, 705 bp, Artificial Sequence; identical to SEQ ID NO: 146380
  Description of Artificial Sequence: Synthetic coding sequence

SEQ ID NO: 146386 - DNA, 648 bp, Artificial Sequence; identical to SEQ ID NO: 146373
  Description of Artificial Sequence: Synthetic coding sequence

SEQ ID NO: 146387 - DNA, 705 bp, Artificial Sequence; identical to SEQ ID NO: 146380
  Description of Artificial Sequence: Synthetic coding sequence

SEQ ID NO: 146388 - DNA, 705 bp, Artificial Sequence; identical to SEQ ID NO: 146380
  Description of Artificial Sequence: Synthetic coding sequence

SEQ ID NO: 146389 - DNA, 648 bp, Artificial Sequence; identical to SEQ ID NO: 146373
  Description of Artificial Sequence: Synthetic coding sequence

SEQ ID NO: 146390 - DNA, 648 bp, Artificial Sequence; identical to SEQ ID NO: 146373
  Description of Artificial Sequence: Synthetic coding sequence

SEQ ID NO: 146391 - DNA, 705 bp, Artificial Sequence; identical to SEQ ID NO: 146380
  Description of Artificial Sequence: Synthetic coding sequence

SEQ ID NO: 146392 - DNA, 648 bp, Artificial Sequence; identical to SEQ ID NO: 146373
  Description of Artificial Sequence: Synthetic coding sequence

SEQ ID NO: 146393 - DNA, 687 bp, Artificial Sequence; identical to SEQ ID NO: 146377
  Description of Artificial Sequence: Synthetic coding sequence

SEQ ID NO: 146394 - DNA, 705 bp, Artificial Sequence; identical to SEQ ID NO: 146380
  Description of Artificial Sequence: Synthetic coding sequence

SEQ ID NO: 146395 - DNA, 648 bp, Artificial Sequence; identical to SEQ ID NO: 146373
  Description of Artificial Sequence: Synthetic coding sequence

SEQ ID NO: 146396 - DNA, 648 bp, Artificial Sequence; identical to SEQ ID NO: 146373
  Description of Artificial Sequence: Synthetic coding sequence

SEQ ID NO: 146397 - DNA, 648 bp, Artificial Sequence; identical to SEQ ID NO: 146373
  Description of Artificial Sequence: Synthetic coding sequence

SEQ ID NO: 146398 - DNA, 648 bp, Artificial Sequence; identical to SEQ ID NO: 146373
  Description of Artificial Sequence: Synthetic coding sequence

SEQ ID NO: 146399 - DNA, 648 bp, Artificial Sequence; identical to SEQ ID NO: 146373
  Description of Artificial Sequence: Synthetic coding sequence

SEQ ID NO: 146400 - DNA, 648 bp, Artificial Sequence; identical to SEQ ID NO: 146373
  Description of Artificial Sequence: Synthetic coding sequence

SEQ ID NO: 146401 - DNA, 648 bp, Artificial Sequence; identical to SEQ ID NO: 146373
  Description of Artificial Sequence: Synthetic coding sequence

SEQ ID NO: 146402 - DNA, 648 bp, Artificial Sequence; identical to SEQ ID NO: 146373
  Description of Artificial Sequence: Synthetic coding sequence

SEQ ID NO: 146403 - DNA, 648 bp, Artificial Sequence; identical to SEQ ID NO: 146373
  Description of Artificial Sequence: Synthetic coding sequence

SEQ ID NO: 146404 - DNA, 4296 bp, Artificial Sequence
  Description of Artificial Sequence: Synthetic coding sequence
atgggcaaggagcaggagctggtgcaggccgtgaaggccgaggatgtgggcacagcccagaggctgctgcagaggcccaggcctgggaaggccaagctgctgggcagcaccaagaagatcaacgtgaacttccaggaccctgatggcttcagcgccctgcaccacgccgccctgaatggaaacacagagctgatcagcctgctgctggaggcccaggccgctgtggacatcaaggacaacaagggcatgaggcccctgcactatgctgcctggcagggcaggaaggagcccatgaagctggtgctgaaggccggcagcgctgtgaacatccccagtgatgagggccacatccccctgcacctggccgcccagcacggccactatgatgtgtctgagatgctgctgcagcaccagagcaacccctgcatggtggacaacagcggcaagacccccctggacctggcctgtgaatttggccgggtgggcgtggtgcagctgctgctgagcagcaacatgtgtgccgccctgctggagcccaggcctggagatgccacagaccccaacggcaccagccccctgcacctggccgccaagaatggccacatcgacatcatccggctgctgctgcaggccggcatcgacatcaaccggcagaccaagtctggaacagccctgcacgaggccgccctgtgtgggaagacagaggtggtgcggctgctgctggacagcggcatcaatgcccacgtgaggaacacctacagccagacagccctggacatcgtgcaccagttcaccaccagccaggccagccgggagatcaagcagctgctgcgggaggccagcgctgccctgcaggtgcgggccaccaaggactactgcaacaactatgacctgaccagcctgaatgtgaaggccggggacatcatcaccgtgctggagcagcacccagatggccgctggaagggctgcatccatgacaacagaactggaaatgacagagtgggctacttccccagcagcctgggggaggccatcgtgaagagagctggcagcagagctggaacagagcccagcctgccccagggcagcagcagcagcggccccagcgcccctcctgaggagatctgggtgctgaggaagccctttgctggaggagacaggagcggcagcatcagcggcatggccggcggccggggcagcggcggccacgccctgcatgctggcagcgagggcgtgaagctgctggccaccgtgctgagccagaagtctgtgtctgagagcggccctggggacagccctgccaagcccccagagggcagcgctggggtggcccggagccagccccctgtggcccatgctggccaggtgtatggagagcagccccccaagaagctggagcccgccagcgagggcaagagcagcgaggccgtgtcccagtggctgacagccttccagctgcagctgtatgcccccaacttcatctctgctggctatgacctgcccaccatcagcaggatgaccccagaggacctgacagccatcggcgtgaccaagccaggccacaggaagaagattgctgctgagatcagcggcctgagcatcccagactggctgcctgagcacaagccagccaacctggccgtgtggctgtccatgattggcctggcccagtactacaaggtgctggtggacaatggctatgagaacatcgacttcatcacagacatcacctgggaggacctgcaggagatcggcatcaccaagctgggccaccagaagaagctgatgctggccgtgaggaagctggccgagctgcagaaggccgagtatgccaagtatgaaggaggccccctgcggaggaaggccccccagagcctggaggtgatggccatcgagagccccccacctcctgagcccaccccagctgactgccagagccccaagatgaccaccttccaggacagcgagctgagtgatgagctgcaggccgccatgacaggccctgctgaggtgggccccaccacagagaagcccagcagccacctgccccccaccccccgggccaccacccggcaggacagcagcctgggcggccgggcccggcacatgagcagcagccaggagctgctgggagatggccccccaggccccagcagccccatgagccgcagccaggagtacctgctggatgagggccctgcccctggcaccccaccccgggaggcccggcccggcagacatggccacagcatcaagagggcctctgtgccccctgtgcctgggaagccccggcaggtgctgcccccaggcaccagccacttcaccccaccccagacccccaccaagaccaggcctggcagcccccaggccctgggcggcccccacggccctgccccagccacagccaaggtgaagcccaccccccagctgctgcccccaacagagcggcccatgagccccaggagcctgccccagagccccacccaccggggctttgcctacgtgctgccccagcctgtggagggggaggtgggccctgctgcccctggccctgcccctcctcctgtgcccacagctgtgcccaccctgtgcctgcccccagaggctgatgctgagcccggccggcccaagaagagggcccacagcctgaacagatatgctgccagtgacagcgagcctgagagagatgagctgctggtgcctgctgctgctggcccctatgccaccgtgcagaggagagtgggccgcagccacagcgtgcgggccccagctggagctgacaagaatgtgaacagaagccagagctttgctgtgcggcccaggaagaagggccccccacctcctccacccaagaggagcagcagcgccctggccagcgccaacctggctgatgagcctgtgcctgatgctgagccagaagatggcctgctgggcgtgcgggcccagtgccggcgggccagtgacctggccggctctgtggacaccggcagcgctggctctgtgaagagcattgctgccatgctggagctgagcagcattggaggcggcggccgggccgcccggcggcccccagagggccaccccacccccaggcctgccagccctgagcccggccgggtggccaccgtgctggcctctgtgaagcacaaggaggccatcggccctggaggagaggtggtgaacagaagaaggaccctgagcggccctgtgacaggcctgctggccacagcccggcggggccctggagagagcgctgaccccggcccctttgtggaggatggcaccggccggcagaggccccggggccccagcaaaggagaggccggcgtggagggcccccccctggccaaggtggaggccagcgccaccctgaagaggcgcatccgggccaagcagaaccagcaggagaatgtgaagttcatcctgacagaaagtgacacagtgaagaggcggcccaaggccaaggagcgggaggccggccctgagcccccaccacccctgtctgtgtaccacaacggcaccggcaccgtgagaagaagacctgccagcgagcaggccggccccccagagctgcccccacctcctcctcctgctgagcccccacccacagacctggcccacctgccccccctgcccccacctgagggggaggccaggaagccagccaagccccctgtgagccccaagcctgtgctgacccagcctgtgcccaagctgcagggcagccccacccccaccagcaagaaggtgcccctgcccggccctggcagccctgaggtgaagagggcccacggcaccccacctcctgtgagccccaagcccccacctccacccacagcccccaagcctgtgaaggctgtggccggcctgcccagcggcagcgctggccccagccctgcccccagccctgcccggcagcccccagctgccctggccaagcccccaggcaccccacccagcctgggcgccagccctgccaagccacccagccctggggccccagccctgcacgtgcctgccaagccacccagggctgctgctgctgctgctgctgctgctgctgcccccccagcccctcctgagggcgccagccctggggacagcgcccggcagaagctggaggagaccagcgcctgcctggccgccgccctgcaggccgtggaggagaagatccggcaggaggatgcccagggcccccgggacagcgctgctgagaagagcacaggcagcatcctggatgacatcggctccatgtttgatgacctggccgaccagctggatgccatgctggagtag

SEQ ID NO: 146405 - DNA, 2115 bp, Artificial Sequence
  Description of Artificial Sequence: Synthetic coding sequence
atgtgtgccgccctgctggagcccaggcctggagatgccacagaccccaacggcaccagccccctgcacctggccgccaagaatggccacatcgacatcatccggctgctgctgcaggccggcatcgacatcaaccggcagaccaagagcggcacagccctgcatgaagctgccctgtgtgggaagacagaggtggtgcggctgctgctggacagcggcatcaatgcccacgtgaggaacacctacagccagacagccctggacatcgtgcaccagttcaccaccagccaggccagccgggagatcaagcagctgctgcgggaggccagcgctgccctgcaggtgcgggccaccaaggactactgcaacaactatgacctgaccagcctgaatgtgaaggccggggacatcatcaccgtgctggagcagcacccagatggccgctggaagggctgcatccatgacaacagaactggaaatgacagagtgggctacttccccagcagcctgggggaggccatcgtgaagagagctggcagccgggccggcacagagcccagcctgccccagggcagcagcagcagcggccccagcgcccctcctgaggagatctgggtgctgaggaagccctttgctggaggagacagaagtggcagcatcagcggcatggccggcggccggggcagcggcggccacgccctgcacgccggcagcgagggcgtgaagctgctggccaccgtgctgagccagaagtctgtgtctgagagcggccctggggacagccctgccaagcccccagagggcagcgctggggtggcccggagccagccccctgtggcccacgccggccaggtgtatggagagcagccccccaagaagctggagcccgccagcgagggcaagagcagcgaggccgtgtcccagtggctgacagccttccagctgcagctgtatgcccccaacttcatctctgctggctatgacctgcccaccatcagcaggatgaccccagaggacctgacagccatcggcgtgaccaagccaggccacaggaagaagattgctgctgagatcagcggcctgagcatcccagactggctgcctgagcacaagccagccaacctggccgtgtggctgtccatgattggcctggcccagtactacaaggtgctggtggacaatggctatgaaaatattgacttcatcacagacatcacctgggaggacctgcaggagatcggcatcaccaagctgggccaccagaagaagctgatgctggccgtgaggaagctggccgagctgcagaaggccgagtatgccaagtatgagggcggccccctgcggaggaaggccccccagagcctggaggtgatggccatcgagagccccccacctcctgagcccaccccagctgactgccagagccccaagatgaccaccttccaggacagcgagctgagtgatgagctgcaggccgccatgactggacctgctgaggtgggccccaccacagagaagcccagcagccacctgccccccaccccccgggccaccacccggcaggacagcagcctgggcggccgggcccggcacatgagcagcagccaggagctgctgggagatggccccccaggccccagcagccccatgagccgcagccaggagtacctgctggatgagggccctgcccctggcaccccaccccgggaggcccggcccggccgccacggccacagcatcaagagggcctctgtgccccctgtgcctgggaagccccggcaggtgctgcccccaggcaccagccacttcaccccaccccagacccccaccaagacccggcccggcagcccccaggccctgggcggcccccacggccctgccccagccacagccaaggtgaagcccaccccccagctgctgcccccaacagagcggcccatgagccccaggagcctgccccagagccccacccagaggacaggccctggccctgcccagaactgccccagcggccgcccagccagccgctctggagctgcccagggcactggagaccagggccagggccccccagccccaccccacccccagaacatctcctaccaggagtactag

SEQ ID NO: 146406 - DNA, 3609 bp, Artificial Sequence
  Description of Artificial Sequence: Synthetic coding sequence
atgggccgggagcaggacctgatcctggccgtgaagaatggagatgtgactggagtgcagaagctggtggccaaggtgaaggccaccaagaccaagctgctgggcagcaccaagaggctgaatgtgaactaccaggatgctgatggcttcagcgccctgcaccacgccgccctgggcggcagcctggagctgattgccctgctgctggaggcccaggccaccgtggacatcaaggacagcaatggcatgaggcccctgcactatgctgcctggcagggccgcctggagcctgtgcggctgctgctgcgggccagcgctgctgtgaatgctgccagcctggatggccagatccccctgcacctggccgcccagtatggccactatgaggtgtctgagatgctgctgcagcaccagagcaacccctgcctggtgaacaaggccaagaagacccccctggacctggcctgtgaatttggccgcctgaaggtggcccagctgctgctgaacagccacctgtgtgtggccctgctggagggggaggccaaggacccctgtgaccccaactacaccacccccctgcacctggccgccaagaatggccaccgggaggtgatccggcagctgctgcgggccggcatcgagatcaaccggcagaccaagacaggaacagccctgcacgaggccgccctgtatggcaagacagaggtggtgcggctgctgctggagggcggcgtggatgtgaacatccggaacacctacaaccagacagccctggacatcgtgaaccagttcaccaccagccaggccagccgggagatcaagcagctgctgcgggaggccagcggcatcctgaaggtgcgggccctgaaggacttctggaacctgcatgaccccacagccctgaatgtgcgggctggagatgtgatcaccgtgctggagcagcacccagatggccgctggaagggccacatccacgagagccagaggggcacagaccgcatcggctacttccccccaggcatcgtggaggtggtgtccaagagggtgggcatcccagctgcccggctgcccagcgcccccacccccctgcggcccggcttcagcaggaccccccagcccccagctgaggagcccccccaccccctgacctacagccagctgccccgggtgggcctgagcccagacagccctgctggggacagaaattctgtgggcagcgagggctctgtgggcagcatccgctctgctggcagcggccagagcagcgagggcaccaacggccacggccctggcctgctgattgaaaatgcccagcccctgcccagcgctggggaggaccaggtgctgcccggcctgcacccccccagcctggccgacaacctgagccaccggcccctggccaactgccgctctggagagcagatcttcacccaggatgtgcggcctgagcagctgctggagggcaaggatgcccaggccatccacaactggctgtctgagttccagctggagggctacacagcccacttcctgcaggccggctatgatgtgcccaccatcagcaggatgaccccagaggacctgacagccatcggcgtgaccaagccaggccacaggaagaagatcgccagcgagatcgcccagctgagcattgctgagtggctgcccagctacatccccacagacctgctggagtggctgtgtgccctgggcctgccccagtaccacaagcagctggtgagcagcggctatgacagcatgggcctggtggccgacctgacctgggaggagctgcaggagattggagtgaacaagctgggccaccagaagaagctgatgctgggcgtgaagaggctggccgagctgcggcggggcctgctgcagggcgaggccctgtctgagggcggccgccgcctggccaagggccctgagctgatggccatcgagggcctggagaatggagagggccctgccacagctggcccccggctgctgaccttccagggcagcgagctgagccctgagctgcaggccgccatggccggcggcggccctgagcccctgcccctgcccccagcccggagccccagccaggagagcattggagcccggagccggggcagcggccacagccaggagcagcctgccccccagcccagcggcggggaccccagccccccccaggagaggaacctgcctgagggcacagagaggcctcccaagctgtgcagcagcctgcccggccagggccccccaccctacgtgttcatgtacccccagggcagccccagcagccctgcccctggccccccacctggggccccctgggccttctcctacctggccggccccccagccaccccaccagaccccccccggcccaagaggaggagccacagcctgagccggcccggccccacagaaggagatgctgagggggaggccgagggccctgtgggcagcaccctgggcagctatgccaccctgaccaggaggcctggccgcagcgccctggtgaggaccagccccagcgtgacccccaccccagcccggggcacccccaggagccagagctttgccctgcgggcccggaggaagggccccccacctcctccacccaagaggctgagctctgtgtctggccccagccctgagcccccacccctggatgagagccctggccccaaggagggcgccaccggccccaggaggaggaccctgtctgagcctgctggccccagcgagcccccaggccccccagccccagctggccctgccagtgacacagaggaggaggagcccggccctgagggcaccccacccagccggggcagcagcggggagggcctgccctttgctgaggagggcaacctgaccatcaagcagaggcccaagccagctggccccccaccccgggagacccctgtgcccccaggcctggacttcaacctgacagaaagtgacacagtgaagaggcggcccaagtgccgggagcgggagcccctgcagacagccctgctggcctttggagtggccagcgccaccccaggccctgctgcccccctgcccagccccaccccaggagagagccccccagccagcagcctgccccagcctgagcccagcagcctgcctgcccagggcgtgcccacccccctggcccccagccctgccatgcagccccctgtgcccccctgccccggccctggcctggagagcagcgctgccagccgctggaatggagaaacagagcccccagctgccccagctgccctgctgaaggtgcctggggccggcacagcccccaagcctgtgtctgtggcctgcacccagctggccttcagcggccccaagctggccccccggctgggccccaggcctgtgcccccacccaggcctgagagcacaggcaccgtgggccctggccaggcccagcagaggctggagcagaccagcagcagcctggccgccgccctgcgggctgctgagaagagcatcggcaccaaggagcaggagggcacccccagcgccagcaccaagcacatcctggatgacatcagcaccatgtttgatgccctggccgaccagctggatgccatgctggactag

SEQ ID NO: 146407 - DNA, 3363 bp, Artificial Sequence
  Description of Artificial Sequence: Synthetic coding sequence
atgaggcccctgcactatgctgcctggcagggccgcctggagcctgtgcggctgctgctgcgggccagcgctgctgtgaatgctgccagcctggatggccagatccccctgcacctggccgcccagtatggccactatgaggtgtctgagatgctgctgcagcaccagagcaacccctgcctggtgaacaaggccaagaagacccccctggacctggcctgtgaatttggccgcctgaaggtggcccagctgctgctgaacagccacctgtgtgtggccctgctggagggggaggccaaggacccctgtgaccccaactacaccacccccctgcacctggccgccaagaatggccaccgggaggtgatccggcagctgctgcgggccggcatcgagatcaaccggcagaccaagacaggaacagccctgcacgaggccgccctgtatggcaagacagaggtggtgcggctgctgctggagggcggcgtggatgtgaacatccggaacacctacaaccagacagccctggacatcgtgaaccagttcaccaccagccaggccagccgggagatcaagcagctgctgcgggaggccagcggcatcctgaaggtgcgggccctgaaggacttctggaacctgcatgaccccacagccctgaatgtgcgggctggagatgtgatcaccgtgctggagcagcacccagatggccgctggaagggccacatccacgagagccagaggggcacagaccgcatcggctacttccccccaggcatcgtggaggtggtgtccaagagggtgggcatcccagctgcccggctgcccagcgcccccacccccctgcggcccggcttcagcaggaccccccagcccccagctgaggagcccccccaccccctgacctacagccagctgccccgggtgggcctgagcccagacagccctgctggggacagaaattctgtgggcagcgagggctctgtgggcagcatccgctctgctggcagcggccagagcagcgagggcaccaacggccacggccctggcctgctgattgaaaatgcccagcccctgcccagcgctggggaggaccaggtgctgcccggcctgcacccccccagcctggccgacaacctgagccaccggcccctggccaactgccgctctggagagcagatcttcacccaggatgtgcggcctgagcagctgctggagggcaaggatgcccaggccatccacaactggctgtctgagttccagctggagggctacacagcccacttcctgcaggccggctatgatgtgcccaccatcagcaggatgaccccagaggacctgacagccatcggcgtgaccaagccaggccacaggaagaagatcgccagcgagatcgcccagctgagcattgctgagtggctgcccagctacatccccacagacctgctggagtggctgtgtgccctgggcctgccccagtaccacaagcagctggtgagcagcggctatgacagcatgggcctggtggccgacctgacctgggaggagctgcaggagattggagtgaacaagctgggccaccagaagaagctgatgctgggcgtgaagaggctggccgagctgcggcggggcctgctgcagggcgaggccctgtctgagggcggccgccgcctggccaagggccctgagctgatggccatcgagggcctggagaatggagagggccctgccacagctggcccccggctgctgaccttccagggcagcgagctgagccctgagctgcaggccgccatggccggcggcggccctgagcccctgcccctgcccccagcccggagccccagccaggagagcattggagcccggagccggggcagcggccacagccaggagcagcctgccccccagcccagcggcggggaccccagccccccccaggagaggaacctgcctgagggcacagagaggcctcccaagctgtgcagcagcctgcccggccagggccccccaccctacgtgttcatgtacccccagggcagccccagcagccctgcccctggccccccacctggggccccctgggccttctcctacctggccggccccccagccaccccaccagaccccccccggcccaagaggaggagccacagcctgagccggcccggccccacagaaggagatgctgagggggaggccgagggccctgtgggcagcaccctgggcagctatgccaccctgaccaggaggcctggccgcagcgccctggtgaggaccagccccagcgtgacccccaccccagcccggggcacccccaggagccagagctttgccctgcgggcccggaggaagggccccccacctcctccacccaagaggctgagctctgtgtctggccccagccctgagcccccacccctggatgagagccctggccccaaggagggcgccaccggccccaggaggaggaccctgtctgagcctgctggccccagcgagcccccaggccccccagccccagctggccctgccagtgacacagaggaggaggagcccggccctgagggcaccccacccagccggggcagcagcggggagggcctgccctttgctgaggagggcaacctgaccatcaagcagaggcccaagccagctggccccccaccccgggagacccctgtgcccccaggcctggacttcaacctgacagaaagtgacacagtgaagaggcggcccaagtgccgggagcgggagcccctgcagacagccctgctggcctttggagtggccagcgccaccccaggccctgctgcccccctgcccagccccaccccaggagagagccccccagccagcagcctgccccagcctgagcccagcagcctgcctgcccagggcgtgcccacccccctggcccccagccctgccatgcagccccctgtgcccccctgccccggccctggcctggagagcagcgctgccagccgctggaatggagaaacagagcccccagctgccccagctgccctgctgaaggtgcctggggccggcacagcccccaagcctgtgtctgtggcctgcacccagctggccttcagcggccccaagctggccccccggctgggccccaggcctgtgcccccacccaggcctgagagcacaggcaccgtgggccctggccaggcccagcagaggctggagcagaccagcagcagcctggccgccgccctgcgggctgctgagaagagcatcggcaccaaggagcaggagggcacccccagcgccagcaccaagcacatcctggatgacatcagcaccatgtttgatgccctggccgaccagctggatgccatgctggactag

SEQ ID NO: 146408 - DNA, 1026 bp, Artificial Sequence
  Description of Artificial Sequence: Synthetic coding sequence
atggctgatgagaagcccagcaatggagtgctggtgcacatggtgaagctgctgatcaagaccttcctggatggcatctttgatgacctgatggagaacaacgtgctgaacacagatgagatccacctgattggcaagtgcctgaagtttgtggtgtccaatgctgagaacctggtggatgacatcacagaaacagcccagacagctgggaagatcttccgggagcacctgtggaacagcaagaagcagctgagcagtgacatcagcagtgatggagagcgggaggccaacatgcctggcctgaacatccggaacaaggagttcaactacctgcacaacagaaatggaagtgagctggacctgctgggcatgagggacctgctggagaacctgggctacagcgtggtgatcaaggagaacctgacagcccaggagatggagacagccctgcggcagtttgctgcccaccctgagcaccagagcagtgacagcaccttcctggtgttcatgagccacagcatcctgaatggcatctgtggcaccaagcactgggaccaggagccagatgtgctgcatgatgacaccatctttgagatcttcaacaacagaaactgccagagcctgaaggacaagcccaaggtgatcatcatgcaggcctgcagaggaaatggagctggcatcgtgtggttcaccacagacagcggcaaggccggggctgacacccacggccgcctgctgcagggcaacatctgcaatgatgctgtgaccaaggcccacgtggagaaggacttcatcgccttcaagagcagcaccccccacaacgtgtcctggaggcatgagaccaacggcagcgtcttcatcagccagatcatctactacttccgggagtacagctggagccaccacctggaggagatcttccagaaggtgcagcacagctttgagacccccaacatcctgacccagctgcccaccatcgagcggctgtccatgacccgctacttctacctgtttcctggcaactag

SEQ ID NO: 146409 - DNA, 1026 bp, Artificial Sequence; identical to SEQ ID NO: 146408
  Description of Artificial Sequence: Synthetic coding sequence

SEQ ID NO: 146410 - DNA, 834 bp, Artificial Sequence
  Description of Artificial Sequence: Synthetic coding sequence
atggagaacacagaaaattctgtggacagcaagagcatcaagaacctggagcccaagatcatccacggcagcgagagcatggattctggcatcagcctggacaacagctacaagatggactacccagagatgggcctgtgcatcatcatcaacaacaagaacttccacaagagcacaggcatgaccagccgctctggaacagatgtggatgctgccaacctgcgggagaccttcaggaacctgaagtatgaggtgaggaacaagaatgacctgacccgggaggagatcgtggagctgatgagagatgtgtccaaggaggaccacagcaagaggagcagctttgtgtgtgtgctgctgagccatggagaggagggcatcatcttcggcaccaatggacctgtggacctgaagaagatcaccaacttcttccggggggaccgctgccgcagcctgaccgggaagcccaagctgttcatcatccaggcctgccggggcacagagctggactgtggcatcgagacagacagcggcgtggatgatgacatggcctgccacaagatccctgtggaggccgacttcctgtatgcctacagcacagcccctggctactacagctggaggaacagcaaggatggctcctggttcatccagagcctgtgtgccatgctgaagcagtatgctgacaagctggagttcatgcacatcctgaccagggtgaacaggaaggtggccacagaatttgagagcttctcctttgatgccaccttccacgccaagaagcagatcccctgcatcgtgtccatgctgaccaaggagctgtacttctaccactag

SEQ ID NO: 146411 - DNA, 471 bp, Artificial Sequence
  Description of Artificial Sequence: Synthetic coding sequence
atgtctgatgccctgatcaaggtgtccatggagaacacagagaacagcgtggacagcaagagcatcaagaacctggagcccaagatcatccacggcagcgagagcatggacagcggcatcagcctggacaacagctacaagatggactacccagagatgggcctgtgcatcatcatcaacaacaagaacttccacaagagcacaggcatgaccagccgcagcggcacagatgtggatgctgccaacctgcgggagaccttcaggaacctgaagtatgaggtgaggaacaagaatgacctgacccgggaggagatcgtggagctgatgagagatgtgtccaaagaagaccacagcaagaggagcagctttgtgtgtgtgctgctgagccacggggaggagggcatcatcttcggcaccaacggccctgtggacctgaagaacaacaagctgttccagaggggcagcctgtag

SEQ ID NO: 146412 - DNA, 354 bp, Artificial Sequence
  Description of Artificial Sequence: Synthetic coding sequence
atggagaacacagaaaattctgtggacagcaagagcatcaagaacctggagcccaagatcatccacggcagcgagagcatggattctggcatcagcctggacaacagctacaagatggactacccagagatgggcctgtgcatcatcatcaacaacaagaacttccacaagagcacaggcatgaccagccgctctggaacagatgtggatgctgccaacctgcgggagaccttcaggaacctgaagtatgaggtgaggaacaagaatgacctgacccgggaggagatcgtggagctgatgagagatgtgtccaaggaggaccacagcaagaggagcagctttgtgtgtgtgtag

SEQ ID NO: 146413 - DNA, 834 bp, Artificial Sequence; identical to SEQ ID NO: 146410
  Description of Artificial Sequence: Synthetic coding sequence

SEQ ID NO: 146414 - DNA, 966 bp, Artificial Sequence
  Description of Artificial Sequence: Synthetic coding sequence
atggctgacagcatgcaggagaagcagaggatggccggccagatgctgctgcagaccttcttcaacatcgaccagatcagccccaacaagaaggcccaccccaacatggaggccggccccccagagagcggggagagcacagatgccctgaagctgtgcccccatgaggagttcctgcggctgtgcaaggagcgggcagaggagatctaccccatcaaggagaggaacaacagaacccggctggccctgatcatctgcaacacagaatttgaccacctgcccccaagaaatggagctgactttgacatcaccggcatgaaggagctgctggagggcctggactacagcgtggatgtggaggagaacctgacagcccgggacatggagagcgccctgcgggcctttgccaccaggcctgagcacaagagcagtgacagcaccttcctggtgctgatgagccacggcatcctggagggcatctgtggcaccgtgcatgatgagaagaagccagatgtgctgctgtatgacaccatcttccagatcttcaacaacagaaactgcctgagcctgaaggacaagcccaaggtgatcatcgtgcaggcctgccgcggggccaacagaggagagctgtgggtgcgggacagccctgccagcctggaggtggccagcagccagagcagcgagaacctggaggaggatgctgtgtacaagacccacgtggagaaggacttcatcgccttctgcagcagcaccccccacaacgtgtcctggagggacagcaccatgggcagcatcttcatcacccagctgatcacctgcttccagaagtacagctggtgctgccacctggaggaggtgttcaggaaggtgcagcagagctttgagaccccccgggccaaggcccagatgcccaccatcgagcggctgtccatgacccgctacttctacctgtttcctggcaactag

SEQ ID NO: 146415 - DNA, 213 bp, Artificial Sequence
  Description of Artificial Sequence: Synthetic coding sequence
atggagaagaaggaatgtcctgagaagagcagcagcagcgaggaggagctgccccggcgggacagcggcagcagcaggaacattgatgccagcaagctgatccggctgcagggcagcaggaagctgctggtggacaacagcatccgggagctgcagtacaccaagacaggcatcttcttccaggccgaggcctgtgtgaccaatgacacctag

SEQ ID NO: 146416 - DNA, 3099 bp, Artificial Sequence
  Description of Artificial Sequence: Synthetic coding sequence
atgcctggccgggcagaggccggggaggccgaggaggaggccggggccggcagcggcagcgaggccgaggaggatgccctgtgggagagaattgaaggagtgcgccaccggctggcccgggccctgaacccagccaagctgaccccctacctgcggcagtgccgggtgattgatgagcaggatgaggaggaggtgctgagcacctaccgcttcccctgccgggtgaacagaacaggccgcctgatggacatcctgcgctgccggggcaagaggggctatgaggccttcctggaggccctggagttctactacccagagcacttcaccctgctgaccggccaggagcccgcccagcgctgcagcatgatcctggatgaggagggccctgagggcctgacccagttcctgatgacagaggtgcggcggctgcgggaggccaggaagagccagctgcagcgggagcagcagctgcaggcccggggccgggtgctggaggaggagagagctggcctggagcagaggctgcgggaccagcagcaggcccaggagcgctgccagaggctgcgggaggactgggaggccggcagcctggagctgctgcggctgaaggatgagaactacatgattgccatgaggctggcccagctgtctgaggagaagaacagcgctgtgctgcggagccgggacctgcagctggccgtggaccagctgaagctgaaggtgtcccggctggaggaggagtgtgccctgctgcggcgggcccggggccccccacctggagctgaggagaaggagaaggagaaggagaaggagaaggagccagacaacgtggacctggtgtctgagctgcgggcagagaaccagaggctgacagccagcctgcgggagctgcaggagggcctgcagcaggaggccagcaggcctggggcccctggcagcgagcgcatcctgctggacatcctggagcatgactggagggaggcccaggacagccggcaggagctgtgccagaagctgcatgctgtgcagggcgagctgcagtgggccgaggagctgcgggaccagtacctgcaggagatggaggacctgcggctgaagcacaggaccctgcagaaggactgtgacctgtacaagcacaggatggccaccgtgctggcccagctggaggagattgagaaggagcgggaccaggccatccagagccgggaccgcatccagctgcagtacagccagagcctcatcgagaaggaccagtacaggaagcaggtgcggggcctggaggccgagagagatgagctgctgaccaccctgaccagcctggagggcaccaaggccctgctggaggtgcagctgcagagggcccagggcggcacctgcctgaaggcctgtgccagcagccacagcctgtgcagcaacctgagcagcacctggagcctgtctgagttccccagccccctgggcggccctgaggccaccggggaggccgctgtgatgggcggccctgagccccacaacagcgaggaggccacagacagcgagaaggagatcaaccggctgagcatcctgcccttccccccatctgctggcagcatcctgcggcggcagcgggaggaggaccctgccccacccaagaggagcttcagctccatgtctgacatcaccggctctgtgaccctgaagccctggagccctggcctgagcagcagcagcagcagtgacagcgtgtggcccctgggcaagccagagggcctgctggcccggggctgcggcctggacttcctgaacagaagcctggccatccgggtgtctggccgcagccccccaggcggccctgagccccaggacaagggcccagatggcctgtccttctacggggaccgctggagcggggctgtggtgcggcgggtgctgagcggccctggcagcgccaggatggagccccgggagcagagggtggaggccgccggcctggagggcgcctgcctggaggccgaggcccagcagaggaccctgctgtggaaccagggcagcaccctgcccagcctgatggacagcaaggcctgccagagcttccacgaggccctggaggcctgggccaagggccctggagctgagcccttctacatccgggccaacctgaccctgcctgagagagctgacccccacgccctgtgtgtgaaggcccaggagatcctgcggctggtggacagcgcctacaagaggcggcaggagtggttctgcaccagggtggaccccctgaccctgcgggacctggaccggggcaccgtgcccaactaccagagggcccagcagctgctggaggtgcaggagaagtgcctgcccagcagccgccaccggggccccaggagcaacctgaagaagagggccctggaccagctgcggctggtgcggcccaagcctgtgggcgccccagctggggacagcccagaccagctgctgctggagccctgtgccgagcctgagaggagcctgcggccctacagcctggtgcggcccctgctggtgtctgccctgcggcctgtggtgctgctgcctgaatgtctggcccccaggctcatccggaacctgctggacctgcccagcagccggctggacttccaggtgtgcccagctgagagcctgagcggggaggagctgtgccccagcagcgcccctggggcccccaaggcccagcctgccaccccaggcctgggcagccgcatccgggccatccaggagagcgtgggcaagaagcactgcctgctggagctgggcgcccggggcgtgcgggagctggtgcagaatgagatctaccccatcgtcatccacgtggaggtgacagagaagaatgtgcgggaggtgcggggcctgctgggccggcccggctggagggacagcgagctgctgcggcagtgccggggcagcgagcaggtgctgtggggcctgccctgctcctgggtgcaggtgcctgcccacgagtggggccatgctgaggagctggccaaggtggtgcggggccgcatcctgcaggagcaggcccggctggtgtgggtggagtgtggcagcagccggggctgccccagcagcagcgaggcctag

SEQ ID NO: 146417 - DNA, 3099 bp, Artificial Sequence; identical to SEQ ID NO: 146416
  Description of Artificial Sequence: Synthetic coding sequence

SEQ ID NO: 146418 - DNA, 2241 bp, Artificial Sequence
  Description of Artificial Sequence: Synthetic coding sequence
atgggcgtgggcgtgggcctgggcaatggcctgcggctgctgccctggatggaggccagcaggcctggggcccctggcagcgagcgcatcctgctggacatcctggagcatgactggagggaggcccaggacagccggcaggagctgtgccagaagctgcatgctgtgcagggcgagctgcagtgggccgaggagctgcgggaccagtacctgcaggagatggaggacctgcggctgaagcacaggaccctgcagaaggactgtgacctgtacaagcacaggatggccaccgtgctggcccagctggaggagattgagaaggagcgggaccaggccatccagagccgggaccgcatccagctgcagtacagccagagcctcatcgagaaggaccagtacaggaagcaggtgcggggcctggaggccgagagagatgagctgctgaccaccctgaccagcctggagggcaccaaggccctgctggaggtgcagctgcagagggcccagggcggcacctgcctgaaggcctgtgccagcagccacagcctgtgcagcaacctgagcagcacctggagcctgtctgagttccccagccccctgggcggccctgaggccaccggggaggccgctgtgatgggcggccctgagccccacaacagcgaggaggccacagacagcgagaaggagatcaaccggctgagcatcctgcccttccccccatctgctggcagcatcctgcggcggcagcgggaggaggaccctgccccacccaagaggagcttcagctccatgtctgacatcaccggctctgtgaccctgaagccctggagccctggcctgagcagcagcagcagcagtgacagcgtgtggcccctgggcaagccagagggcctgctggcccggggctgcggcctggacttcctgaacagaagcctggccatccgggtgtctggccgcagccccccaggcggccctgagccccaggacaagggcccagatggcctgtccttctacggggaccgctggagcggggctgtggtgcggcgggtgctgagcggccctggcagcgccaggatggagccccgggagcagagggtggaggccgccggcctggagggcgcctgcctggaggccgaggcccagcagaggaccctgctgtggaaccagggcagcaccctgcccagcctgatggacagcaaggcctgccagagcttccacgaggccctggaggcctgggccaagggccctggagctgagcccttctacatccgggccaacctgaccctgcctgagagagctgacccccacgccctgtgtgtgaaggcccaggagatcctgcggctggtggacagcgcctacaagaggcggcaggagtggttctgcaccagggtggaccccctgaccctgcgggacctggaccggggcaccgtgcccaactaccagagggcccagcagctgctggaggtgcaggagaagtgcctgcccagcagccgccaccggggccccaggagcaacctgaagaagagggccctggaccagctgcggctggtgcggcccaagcctgtgggcgccccagctggggacagcccagaccagctgctgctggagccctgtgccgagcctgagaggagcctgcggccctacagcctggtgcggcccctgctggtgtctgccctgcggcctgtggtgctgctgcctgaatgtctggcccccaggctcatccggaacctgctggacctgcccagcagccggctggacttccaggtgtgcccagctgagagcctgagcggggaggagctgtgccccagcagcgcccctggggcccccaaggcccagcctgccaccccaggcctgggcagccgcatccgggccatccaggagagcgtgggcaagaagcactgcctgctggagctgggcgcccggggcgtgcgggagctggtgcagaatgagatctaccccatcgtcatccacgtggaggtgacagagaagaatgtgcgggaggtgcggggcctgctgggccggcccggctggagggacagcgagctgctgcggcagtgccggggcagcgagcaggtgctgtggggcctgccctgctcctgggtgcaggtgcctgcccacgagtggggccatgctgaggagctggccaaggtggtgcggggccgcatcctgcaggagcaggcccggctggtgtgggtggagtgtggcagcagccggggctgccccagcagcagcgaggcctag

SEQ ID NO: 146419 - DNA, 1443 bp, Artificial Sequence
  Description of Artificial Sequence: Synthetic coding sequence
atggaggacctgcggctgaagcacaggaccctgcagaaggactgtgacctgtacaagcacaggatggccaccgtgctggcccagctggaggagattgagaaggagcgggaccaggccatccagagccgggaccgcatccagctgcagtacagccagagcctgattgagaaggaccagtacaggaagcaggtgcggggcctggaggccgagagagatgagctgctgaccaccctgaccagcctggagggcaccaaggccctgctggaggtgcagctgcagagggcccagggcggcacctgcctgaaggcctgtgccagcagccacagcctgtgcagcaacctgagcagcacctggagcctgtctgagttccccagccccctgggcggccctgaggccactggagaggccgctgtgatgggcggccctgagccccacaacagcgaggaggccacagattctgagaaggagatcaaccggctgagcatcctgcccttcccccccagcgctggcagcatcctgcggcggcagcgggaggaggaccctgccccacccaagaggagcttcagctccatgtctgacatcactggatctgtgaccctgaagccctggagccctggcctgagcagcagcagcagcagtgacagcgtgtggcccctgggcaagccagagggcctgctggcccggggctgcggcctggacttcctgaacagaagcctggccatccgggtgtctggccgcagccccccaggcggccctgagccccaggacaagggcccagatggcctgtccttctatggagaccgctggagcggggctgtggtgagaagagtgctgagcggccctggcagcgccaggatggagccccgggagcagagggtggaggccgccggcctggagggcgcctgcctggaggccgaggcccagcagaggaccctgctgtggaaccagggcagcaccctgcccagcctgatggacagcaaggcctgccagagcttccacgaggccctggaggcctgggccaagggccctggagctgagcccttctacatccgggccaacctgaccctgcctgagagagctgacccccacgccctgtgtgtgaaggcccaggagatcctgcggctggtggacagcgcctacaagaggcggcaggagtggttctgcaccagggtggaccccctgaccctgcgggacctggaccggggcaccgtgcccaactaccagagggcccagcagctgctggaggtgcaggagaagtgcctgcccagcagccgccaccggggccccaggagcaacctgaagaagagggccctggaccagctgcggctggtgcggcccaagcctgtgggcgccccagctggggacagcccagaccagctgctgctggagccctgtgccgagcctgagaggagcctgcggccctacagcctggtgcggccctag

SEQ ID NO: 146420 - DNA, 222 bp, Artificial Sequence
  Description of Artificial Sequence: Synthetic coding sequence
atgcctgggggcggccctgagatggatgactacatggagaccctgaaggatgaagaagatgccctgtgggagaatgtggagtgcaacagacacatgctgagccgctacatcaacccagccaagctgaccccctacctgcggcagtgcaaggtgattgatgagcaggatgaagatgaggtgctgaatgcccccatgctgcccagcaagatcaacagagcctag

SEQ ID NO: 146421 - DNA, 3465 bp, Artificial Sequence
  Description of Artificial Sequence: Synthetic coding sequence
atgcctgggggcggccctgagatggatgactacatggagaccctgaaggatgaagaagatgccctgtgggagaatgtggagtgcaacagacacatgctgagccgctacatcaacccagccaagctgaccccctacctgcggcagtgcaaggtgattgatgagcaggatgaagatgaggtgctgaatgcccccatgctgcccagcaagatcaacagagctggccgcctgctggacatcctgcacaccaagggccagaggggctacgtggtgttcctggagagcctggagttctactacccagagctgtacaagctggtgacaggcaaggagcccacccggcgcttcagcaccatcgtggtggaggagggccacgagggcctgacccacttcctgatgaatgaagtcatcaagctgcagcagcagatgaaggccaaggacctgcagagatgtgagctgctggcccggctgcggcagctggaggatgagaagaagcagatgaccctgaccagggtggagctgctgaccttccaggagcgctactacaagatgaaggaggagcgggacagctacaatgatgagctggtgaaggtgaaggatgacaactacaacctggccatgagatatgcccagctgtctgaggagaagaacatggctgtgatgaggagccgggacctgcagctggagattgaccagctgaagcaccggctgaacaagatggaggaggagtgcaagctggagaggaaccagagcctgaagctgaagaatgacatcgagaaccggcccaagaaggagcaggtgctggagctggagcgggagaatgagatgctgaagaccaagaaccaggagctgcagagcatcatccaggccggcaagaggagcctgcctgacagcgacaaggccatcctggacatcctggagcatgacaggaaggaggccctggaggaccggcaggagctggtgaaccgcatctacaacctgcaggaggaggcccggcaggccgaggagctgcgggacaagtacctggaggagaaggaggacctggagctgaagtgcagcaccctgggcaaggactgtgagatgtacaagcacaggatgaacacagtgatgctgcagctggaggaggtggagcgggagcgggaccaggccttccacagcagagatgaggcccagacccagtacagccagtgcctgattgagaaggacaagtacaggaagcagatccgggagctggaggagaagaatgatgagatgagaattgagatggtgagaagagaggcctgcatcgtgaacctggagagcaagctgcggcggctgagcaaggacagcaacaacctggaccagagcctgcccaggaacctgcctgtgaccatcatcagccaggactttggagatgccagccccaggaccaacggccaggaggctgatgacagcagcaccagcgaggagagccctgaggacagcaagtacttcctgccctaccaccccccccagaggaggatgaacctgaagggcatccagctgcagagggccaagagccccatcagcctgaagaggaccagtgacttccaggccaagggccacgaggaggagggcacagatgccagccccagcagctgtggcagcctgcccatcaccaacagcttcaccaagatgcagcccccaagaagccgcagcagcatcatgagcatcacagctgagcccccaggaaatgacagcatcgtgcggcgctacaaggaggatgccccccacaggagcacagtggaggaggacaatgattctgggggctttgatgccctggacctggatgatgacagccatgagcgctacagctttggccccagcagcatccacagcagcagcagcagccaccagagcgagggcctggatgcctatgacctggagcaggtgaacctgatgttcaggaagttcagcctggagcggcccttccggcccagcgtgacctctgtgggccacgtgcggggccctggccccagcgtgcagcacaccaccctgaatggagacagcctgaccagccagctgaccctgctgggcggcaatgcccggggcagctttgtgcacagcgtgaagccaggcagcctggccgagaaggccggcctgcgggagggccaccagctgctgctgctggagggctgcatccggggggagcggcagagcgtgcccctggacacctgcaccaaggaggaggcccactggaccatccagcgctgcagcggccctgtgaccctgcactacaaggtgaaccacgagggctacaggaagctggtgaaggacatggaggatggcctcatcaccagcggggacagcttctacatccggctgaacctgaacatcagcagccagctggatgcctgcaccatgagcctgaagtgtgatgatgtggtgcacgtgcgggacaccatgtaccaggacagacatgagtggctgtgtgcccgggtggaccccttcacagaccatgacctggacatgggcaccatccccagctacagccgggcccagcagctgctgctggtgaagctgcagaggctgatgcaccggggcagccgggaggaggtggatggcacccaccacaccctgcgggccctgaggaacaccctgcagcctgaggaggccctgagcaccagtgacccccgggtgagcccccggctgagccgggccagcttcctgtttggccagctgctgcagtttgtgagccgctctgagaacaagtacaagaggatgaacagcaatgaaagagtgcgcatcatcagcggcagccccctgggcagcctggcccggagcagcctggatgccaccaagctgctgacagagaagcaggaggagctggaccctgagagcgagctgggcaagaacctgagcctcatcccctacagcctggtgcgggccttctactgtgaaagaagaagacctgtgctcttcacccccaccgtgctggccaagaccctggtgcagaggctgctgaacagcggcggggccatggagttcaccatctgcaagagtgacatcgtgaccagagatgagttcctgcggcggcagaagacagagaccatcatctacagccgggagaagaaccccaatgcctttgaatgtattgccccagccaacatcgaggccgtggccgccaagaacaagcactgcctgctggaggccggcatcggctgcacccgggacctgatcaagagcaacatctaccccatcgtgctcttcatccgggtgtgtgagaagaacatcaagcgcttcaggaagctgctgcccaggcctgagacagaggaggagttcctgcgggtgtgccgcctgaaggagaaggagctggaggccctgccctgcctgtatgccaccgtggagccagacatgtggggctctgtggaggagctgctgcgggtggtgaaggacaagattggagaggagcagaggaagaccatctgggtggatgaggaccagctgtag

SEQ ID NO: 146422 - DNA, 3114 bp, Artificial Sequence
  Description of Artificial Sequence: Synthetic coding sequence
atggccacagagagcacccccagcgagatcatcgagcgggagaggaagaagctgctggagatcctgcagcacgaccctgacagcatcctggacaccctgaccagccggcggctcatcagcgaggaggagtatgagaccctggagaatgtgacagacctgctgaagaagagcaggaagctgctgatcctggtgcagaagaagggggaggccacctgccagcacttcctgaagtgcctcttcagcaccttcccccagagcgctgccatctgtggcctgcggcatgaggtgctgaagcatgagaacacagtgcccccccagagcatgggcgccagcagcaacagtgaagatgccttcagccctggcatcaagcagcctgaggcccctgagatcaccgtcttcttcagcgagaaggagcacctggacctggagaccagcgagttcttccgggacaagaagaccagctaccgggagacagccctgagcgccaggaagaatgagaaggagtatgacaccccagaggtgaccctgagctacagcgtggagaaggtgggctgtgaggtgcctgccaccatcacctacatcaaggatggccagagatatgaggagctggatgacagcctgtacctgggcaaggaggagtacctgggctctgtggacaccccagaagatgctgaggccaccgtggaggaggaggtgtatgatgatcctgagcacgtgggctatgatggagaagaagattttgagaacagcgagaccacagagttcagcggggaggagcccagctatgagggcagcgagaccagcctgagcctggaggaggagcaggagaagagcattgaggagaggaagaaggtgttcaaggatgtgctgctgtgcctgaacatggacaggagcaggaaggtgctgcctgactttgtgaagcagttcagcctggaccggggctgcaagtggaccccagagagccctggggacctggcctggaacttcctgatgaaggtgcaggccagagatgtgacagcccgggacagcatcctgagccacaaggtgctggatgaggacagcaaggaggacctgctggccggcgtggagaacctggagatccgggacatccagaccatcaaccccctggatgtgctgtgtgccaccatgctgtgcagcgacagcagcctgcagaggcaggtgatgagcaacatgtaccagtgccagtttgccctgcccctgctgctgcctgatgctgagaacaacaagagcatcctgatgctgggcgccatgaaggacatcgtgaagaagcagagcacccagttcagcggcggccccacagaggacacagagaagttcctgaccctgatgaagatgcctgtgatcagctttgtgcggctgggctactgcagcttcagcaagagccgcatcctgaacaccctgctgagccctgcccagctgaagctgcacaagatcttcctgcaccaggacctgcccctgctggtgctgccccggcagatcagtgatggcctggtggagatcacctggtgcttcccagacagtgatgacagaaaagaaaaccccttcttccagaagcctgtggccctggccaacctgcggggcaacctggagagcttctggacccagtttggcttcctgatggaggtgtcctctgctgtgttcttcttcacagactgcctgggggagaaggagtgggacctgctgatgttcctgggggaggccgccatcgagcgctgctactttgtgctgagcagccaggcccgggagagcgaggaggcccagatcttccagaggatcctgaacctgaagccagcccagctgctcttctgggagagaggagatgctggggacaggaggaagaacatggagggcctgcaggccgccctgcaggaggtgatgttcagcagctgcctgcgctgtgtgtctgtggaggacatggccgccctggcccgggagctgggcatccaggtggatgaagattttgagaacacccagaggatccaggtgtcctctggagagaacatggccggcacagctgagggggagggccagcagaggcacagccagctgaagagcagcagcaagagccaggccctgatgcccatccaggagcccggcacccagtgtgagctgagccagaacctgcagaacctgtatggcacccctgtgttccggcctgtgctggagaacagctggctgttccccacccgcatcggcggcaacttcaaccacgtgtccctgaaggcctcctgggtgatgggccggccctttggaagtgagcagaggcccaagtggttccaccccctgcccttccagaatgctggggcccagggccggggcaagagctttggcatccagagcttccacccccagatcttctacagcggggagcgcttcatgaagttcagccgggtggcccggggctgccacagcaatggcaccttcggccgcctgccccggcccatctgccagcacgtgcaggcctgcccagagcggccccagatgatgggcaccctggagaggagcagagctgtggccagcaagattggccacagctacagcctggacagccagcctgcccgggctgtgggcaagccctggccccagcaggcctgcaccagggtgacagagctgacagaggccaccgggaagctgatccgcaccagccacatcggcaagccccacccccagagcttccagcctgctgctgccacccagaagctgcggcctgccagccagcagggcgtgcagatgaagacccagggcggggccagcaacccagccctgcagatcggcagccaccccatgtgcaagagcagccagttcaagagtgaccagagcaaccccagcacagtgaagcacagccagcccaagcccttccacagcgtgcccagccagcccaagagcagccagaccaagagctgccagagccagcccagccagaccaagcccagcccctgcaagagcacccagcccaagcccagccagccctggccaccccagagcaagcccagccagcccaggcctccccagcccaagagcagcagcaccaaccccagccaggccaaggcccaccacagcaaggccggccagaagaggggcggcaagcactag

SEQ ID NO: 146423 - DNA, 933 bp, Artificial Sequence
  Description of Artificial Sequence: Synthetic coding sequence
atggccacagagagcacccccagcgagatcatcgagcgggagaggaagaagctgctggagatcctgcagcacgaccctgacagcatcctggacaccctgaccagccggcggctcatcagcgaggaggagtatgagaccctggagaatgtgacagacctgctgaagaagagcaggaagctgctgatcctggtgcagaagaagggggaggccacctgccagcacttcctgaagtgcctcttcagcaccttcccccagagcgctgccatctgtggcctgcggcctgaggtgctgaagcatgagaacacagtgcccccccagagcatgggcgccagcagcaacagtgaagatgccttcagccctggcatcaagcagcctgaggcccctgagatcaccgtcttcttcagcgagaaggagcacctggacctggagaccagcgagttcttccgggacaagaagaccagctaccgggagacagccctgagcgccaggaagaatgagaaggagtatgacaccccagaggtgaccctgagctacagcgtggagaaggtgggctgtgaggtgcctgccaccatcacctacatcaaggatggccagagatatgaggagctggatgacagcctgtacctgggcaaggaggagtacctgggctctgtggacaccccagaagatgctgaggccaccgtggaggaggaggtgtatgatgatcctgagcacgtgggctatgatggagaagaagattttgagaacagcgagaccacagagttcagcggggaggagcccagctatgagggcagcgagaccagcctgagcctggaggaggagcaggagaagagcattgagggctggagcaggacccacggcctgaagaggagcagccacgtgggcctgcccaagtgctgggactacagaagagagcccccctgcctggcctag

SEQ ID NO: 146424 - DNA, 1446 bp, Artificial Sequence
  Description of Artificial Sequence: Synthetic coding sequence
atggccacagagagcacccccagcgagatcatcgagcgggagaggaagaagctgctggagatcctgcagcacgaccctgacagcatcctggacaccctgaccagccggcggctcatcagcgaggaggagtatgagaccctggagaatgtgacagacctgctgaagaagagcaggaagctgctgatcctggtgcagaagaagggggaggccacctgccagcacttcctgaagtgcctcttcagcaccttcccccagagcgctgccatctgtggcctgcggcatgaggtgctgaagcatgagaacacagtgcccccccagagcatgggcgccagcagcaacagtgaagatgccttcagccctggcatcaagcagcctgaggcccctgagatcaccgtcttcttcagcgagaaggagcacctggacctggagaccagcgagttcttccgggacaagaagaccagctaccgggagacagccctgagcgccaggaagaatgagaaggagtatgacaccccagaggtgaccctgagctacagcgtggagaaggtgggctgtgaggtgcctgccaccatcacctacatcaaggatggccagagatatgaggagctggatgacagcctgtacctgggcaaggaggagtacctgggctctgtggacaccccagaagatgctgaggccaccgtggaggaggaggtgtatgatgatcctgagcacgtgggctatgatggagaagaagattttgagaacagcgagaccacagagttcagcggggaggagcccagctatgagggcagcgagaccagcctgagcctggaggaggagcaggagaagagcattgaggagaggaagaaggtgttcaaggatgtgctgctgtgcctgaacatggacaggagcaggaaggtgctgcctgactttgtgaagcagttcagcctggaccggggctgcaagtggaccccagagagccctggggacctggcctggaacttcctgatgaaggtgcaggccagagatgtgacagcccgggacagcatcctgagccacaaggtgctggatgaggacagcaaggaggacctgctggccggcgtggagaacctggagatccgggacatccagaccatcaaccccctggatgtgctgtgtgccaccatgctgtgcagcgacagcagcctgcagaggcaggtgatgagcaacatgtaccagtgccagtttgccctgcccctgctgctgcctgatgctgagaacaacaagagcatcctgatgctgggcgccatgaaggacatcgtgaagaagcagagcacccagttcagcggcggccccacagaggacacagagaagttcctgaccctgatgaagaccctgaagaccctgcgggagttcaagttccccctggagaagacctggctgggccagctgaaggtgcgggtgtccaaggacacagtgtcctag

SEQ ID NO: 146425 - DNA, 570 bp, Artificial Sequence
  Description of Artificial Sequence: Synthetic coding sequence
atggtgctggagcacccagcccgggtggagcccttctatgctgtgctggagagccccagcttcagcctgatgggcatcctgctgcgcatcgccagcggcacccggctgagcatccccatcaccagcaacaccctcatctactaccacccccaccctgaggacatcaagttccacctgtacctggtgcccagtgatgccctgctgaccaaggccattgatgatgaggaggaccgcttccacggcgtgcggctgcagaccagcccccccatggagcccctgaactttggcagcagctacatcgtgagcaacagcgccaacctgaaggtgatgcccaaggagctgaagctgagctaccgcagccctggagagatccagcacttcagcaagttctacgccggccagatgaaggagcccatccagctggagatcacagagaagagacatggcaccctggtgtgggacacagaggtgaagcctgtggacctgcagctggtggccgccagcgcccccccacccttcagcggcctgctgtggcagaggcagcccctgaaccccccaccagccaggtag

SEQ ID NO: 146426 - DNA, 1296 bp, Artificial Sequence
  Description of Artificial Sequence: Synthetic coding sequence
atgatgaggcagaggcagagccactactgcagcgtgctcttcctgtctgtgaactacctgggcggcaccttccctggggacatctgcagcgaggagaaccagatcgtgagcagctatgccagcaaggtgtgctttgaaattgaggaggactacaagaaccggcagttcctgggccctgagggcaatgtggatgtggagctgattgacaagagcaccaaccgctacagcgtgtggttccccacagctggctggtacctgtggagcgccaccggcctgggcttcctggtgagagatgaggtgacagtgaccatcgccttcggctcctggagccagcacctggccctggacctgcagcaccacgagcagtggctggtgggcggccccctgtttgatgtgacagctgagcctgaggaggccgtggccgagatccacctgccccacttcatcagcctgcagggcgaggtggatgtgtcctggttcctggtggcccacttcaagaatgaaggcatggtgctggagcacccagcccgggtggagcccttctatgctgtgctggagagccccagcttcagcctgatgggcatcctgctgagaattgccagcggcacccggctgagcatccccatcaccagcaacaccctcatctactaccacccccaccctgaggacatcaagttccacctgtacctggtgcccagtgatgccctgctgaccaaggccattgatgatgaagaagatcgcttccatggagtgcggctgcagaccagcccccccatggagcccctgaactttggcagcagctacatcgtgagcaacagcgccaacctgaaggtgatgcccaaggagctgaagctgagctaccgcagccctggagagatccagcacttcagcaagttctacgccggccagatgaaggagcccatccagctggagatcacagagaagagacatggcaccctggtgtgggacacagaggtgaagcctgtggacctgcagctggtggccgccagcgcccccccacccttctctggagctgcctttgtgaaggagaaccaccggcagctgcaggccaggatgggagacctgaagggcgtgctggatgacctgcaggacaatgaggtgctgacagaaaatgagaaggagctggtggagcaggagaagacccggcagagcaagaatgaggccctgctgtccatggtggagaagaagggggacctggccctggatgtgctcttccgcagcatcagcgagcgggacccctacctggtgtcctacctgcggcagcagaacctgtag

SEQ ID NO: 146427 - DNA, 1614 bp, Artificial Sequence
  Description of Artificial Sequence: Synthetic coding sequence
atggagaagaaggaatgtcctgagaagagcagcagcagcgaggaggagctgccccggcgggacagcggcagcagcaggaacattgatgccagcaagctgatccggctgcagggcagcaggaagctgctggtggacaacagcatccgggagctgcagtacaccaagacaggcatcttcttccaggccgaggcctgtgtgaccaatgacacagtgtaccgggagctgccctgtgtgtctgagaccctgtgtgacatcagccacttcttccaggaggatgatgaaacagaagctgagcccctgctcttccgggctgtgcctgagtgccagctgtctggaggagacatccccagcgtgtctgaggagcaggagagcagcgagggccaggacagcggggacatctgcagcgaggagaaccagatcgtgtcctcctatgccagcaaggtgtgctttgaaattgaggaggactacaagaaccggcagttcctgggccctgagggcaatgtggatgtggagctgattgacaagagcaccaaccgctacagcgtgtggttccccacagctggctggtacctgtggagcgccaccggcctgggcttcctggtgagagatgaggtgacagtgaccatcgccttcggctcctggagccagcacctggccctggacctgcagcaccacgagcagtggctggtgggcggccccctgtttgatgtgacagctgagcctgaggaggccgtggccgagatccacctgccccacttcatcagcctgcaggccggggaggtggatgtgtcctggttcctggtggcccacttcaagaatgaaggcatggtgctggagcacccagcccgggtggagcccttctatgctgtgctggagagccccagcttcagcctgatgggcatcctgctgagaattgccagcggcacccggctgagcatccccatcaccagcaacaccctcatctactaccacccccaccctgaggacatcaagttccacctgtacctggtgcccagtgatgccctgctgaccaaggccattgatgatgaagaagatcgcttccatggagtgcggctgcagaccagcccccccatggagcccctgaactttggcagcagctacatcgtgagcaacagcgccaacctgaaggtgatgcccaaggagctgaagctgagctaccgcagccctggagagatccagcacttcagcaagttctacgccggccagatgaaggagcccatccagctggagatcacagagaagagacatggcaccctggtgtgggacacagaggtgaagcctgtggacctgcagctggtggccgccagcgcccccccacccttctctggagctgcctttgtgaaggagaaccaccggcagctgcaggccaggatgggagacctgaagggcgtgctggatgacctgcaggacaatgaggtgctgacagaaaatgagaaggagctggtggagcaggagaagacccggcagagcaagaatgaggccctgctgtccatggtggagaagaagggggacctggccctggatgtgctcttccgcagcatcagcgagcgggacccctacctggtgtcctacctgcggcagcagaacctgtag

SEQ ID NO: 146428 - DNA, 1464 bp, Artificial Sequence
  Description of Artificial Sequence: Synthetic coding sequence
atggagaagaaggaatgtcctgagaagagcagcagcagcgaggaggagctgcccaggagagtgtaccgggagctgccctgtgtgtctgagaccctgtgtgacatcagccacttcttccaggaggatgatgaaacagaagctgagcccctgctcttccgggctgtgcctgagtgccagctgtctggaggagacatccccagcgtgtctgaggagcaggagagcagcgagggccaggacagcggggacatctgcagcgaggagaaccagatcgtgtcctcctatgccagcaaggtgtgctttgaaattgaggaggactacaagaaccggcagttcctgggccctgagggcaatgtggatgtggagctgattgacaagagcaccaaccgctacagcgtgtggttccccacagctggctggtacctgtggagcgccaccggcctgggcttcctggtgagagatgaggtgacagtgaccatcgccttcggctcctggagccagcacctggccctggacctgcagcaccacgagcagtggctggtgggcggccccctgtttgatgtgacagctgagcctgaggaggccgtggccgagatccacctgccccacttcatcagcctgcaggccggggaggtggatgtgtcctggttcctggtggcccacttcaagaatgaaggcatggtgctggagcacccagcccgggtggagcccttctatgctgtgctggagagccccagcttcagcctgatgggcatcctgctgagaattgccagcggcacccggctgagcatccccatcaccagcaacaccctcatctactaccacccccaccctgaggacatcaagttccacctgtacctggtgcccagtgatgccctgctgaccaaggccattgatgatgaagaagatcgcttccatggagtgcggctgcagaccagcccccccatggagcccctgaactttggcagcagctacatcgtgagcaacagcgccaacctgaaggtgatgcccaaggagctgaagctgagctaccgcagccctggagagatccagcacttcagcaagttctacgccggccagatgaaggagcccatccagctggagatcacagagaagagacatggcaccctggtgtgggacacagaggtgaagcctgtggacctgcagctggtggccgccagcgcccccccacccttctctggagctgcctttgtgaaggagaaccaccggcagctgcaggccaggatgggagacctgaagggcgtgctggatgacctgcaggacaatgaggtgctgacagaaaatgagaaggagctggtggagcaggagaagacccggcagagcaagaatgaggccctgctgtccatggtggagaagaagggggacctggccctggatgtgctcttccgcagcatcagcgagcgggacccctacctggtgtcctacctgcggcagcagaacctgtag

SEQ ID NO: 146429 - DNA, 1101 bp, Artificial Sequence
  Description of Artificial Sequence: Synthetic coding sequence
atgtctgactatgaaaatgatgatgagtgctggagcgtgctggagggcttccgggtgaccctgacctctgtgattgaccccagccgcatcaccccctacctgcggcagtgcaaggtgctgaacccagatgatgaggagcaggtgctgagtgaccccaacctggtgatcaggaagaggaaggtgggcgtgctgctggacatcctgcagaggacaggccacaagggctacgtggccttcctggagagcctggagctgtactacccccagctgtacaagaaggtgacaggcaaggagcccgcccgggtcttctccatgatcattgatgccagcggggagagcggcctgacccagctgctgatgacagaggtgatgaagctgcagaagaaggtgcaggacctgacagccctgctgagcagcaaggatgacttcatcaaggagctgcgggtgaaggacagcctgctgaggaagcaccaggagcgggtgcagaggctgaaggaggagtgtgaggccggcagccgggagctgaagcgctgcaaggaggagaactatgacctggccatgaggctggcccaccagagcgaggagaagggggccgccctgatgaggaacagagacctgcagctggagattgaccagctgaagcacagcctgatgaaggcagaagatgactgcaaggtggagaggaagcacaccctgaagctgcggcatgccatggagcagaggcccagccaggagctgctgtgggagctgcagcaggagaaggccctgctgcaggcccgggtgcaggagctggaggcctctgtgcaggagggcaagctggacaggagcagcccctacatccaggtgctggaggaggactggaggcaggccctgcgggaccaccaggagcaggccaacaccatcttcagcctgaggaaggacctgcggcagggcgaggcccggcggctgcgctgcatggaggagaaggagatgtttgagctgcagtgcctggccctgaggaaggacagcaagatgtacaaggacagaattgaggccatcctgctgcagatggaggaggtggccatcgagcgggaccagagcacccagatggagggcctgtag

SEQ ID NO: 146430 - DNA, 1611 bp, Artificial Sequence
  Description of Artificial Sequence: Synthetic coding sequence
atgtctgactatgaaaatgatgatgagtgctggagcgtgctggagggcttccgggtgaccctgacctctgtgattgaccccagccgcatcaccccctacctgcggcagtgcaaggtgctgaacccagatgatgaggagcaggtgctgagtgaccccaacctggtgatcaggaagaggaaggtgggcgtgctgctggacatcctgcagaggacaggccacaagggctacgtggccttcctggagagcctggagctgtactacccccagctgtacaagaaggtgacaggcaaggagcccgcccgggtcttctccatgatcattgatgccagcggggagagcggcctgacccagctgctgatgacagaggtgatgaagctgcagaagaaggtgcaggacctgacagccctgctgagcagcaaggatgacttcatcaaggagctgcgggtgaaggacagcctgctgaggaagcaccaggagcgggtgcagaggctgaaggaggagtgtgaggccggcagccgggagctgaagcgctgcaaggaggagaactatgacctggccatgaggctggcccaccagagcgaggagaagggggccgccctgatgaggaacagagacctgcagctggagattgaccagctgaagcacagcctgatgaaggcagaagatgactgcaaggtggagaggaagcacaccctgaagctgcggcatgccatggagcagaggcccagccaggagctgctgtgggagctgcagcaggagaaggccctgctgcaggcccgggtgcaggagctggaggcctctgtgcaggagggcaagctggacaggagcagcccctacatccaggtgctggaggaggactggaggcaggccctgcgggaccaccaggagcaggccaacaccatcttcagcctgaggaaggacctgcggcagggcgaggcccggcggctgcgctgcatggaggagaaggagatgtttgagctgcagtgcctggccctgaggaaggacagcaagatgtacaaggacagaattgaggccatcctgctgcagatggaggaggtggccatcgagcgggaccaggccatcgccacccgggaggagctgcacgcccagcacgcccggggcctgcaggagaaggatgccctgaggaagcaggtgcgggagctgggggagaaggcagatgagctgcagctgcaggtgttccagtgtgaggcccagctgctggccgtggagggccgcctgcggcggcagcagctggagaccctggtgctgagcagtgacctggaggatggcagccccaggaggagccaggagctgagcctgccccaggacctggaggacacccagctgagtgacaagggctgcctggccggcggcggcagccccaagcagccctttgctgccctgcaccaggagcaggtgctgaggaacccccatgatgctggcctgagcagcggggagcccccagagaaggagcggcggcggctgaaggagagctttgagaactacagaaggaagagggccctgaggaagatgcagaagggctggaggcagggcgaggaggaccgggagaacaccaccggcagtgacaacacagacacagagggcagctag

SEQ ID NO: 146431 - DNA, 1479 bp, Artificial Sequence
  Description of Artificial Sequence: Synthetic coding sequence
atgtctgactatgaaaatgatgatgagtgctggagcgtgctggagggcttccgggtgaccctgacctctgtgattgaccccagccgcatcaccccctacctgcggcagtgcaaggtgctgaacccagatgatgaggagcaggtgctgagtgaccccaacctggtgatcaggaagaggaaggtgggcgtgctgctggacatcctgcagaggacaggccacaagggctacgtggccttcctggagagcctggagctgtactacccccagctgtacaagaaggtgacaggcaaggagcccgcccgggtcttctccatgatcattgatgccagcggggagagcggcctgacccagctgctgatgacagaggtgatgaagctgcagaagaaggtgcaggacctgacagccctgctgagcagcaaggatgacttcatcaaggagctgcgggtgaaggacagcctgctgaggaagcaccaggagcgggtgcagaggctgaaggaggagtgtgaggccggcagccgggagctgaagcgctgcaaggaggagaactatgacctggccatgaggctggcccaccagagcgaggagaagggggccgccctgatgaggaacagagacctgcagctggagattgaccagctgaagcacagcctgatgaaggcagaagatgactgcaaggtggagaggaagcacaccctgaagctgcggcatgccatggagcagaggcccagccaggagctgctgtgggagctgcagcaggagaaggccctgctgcaggcccgggtgcaggagctggaggcctctgtgcaggagggcaagctggacaggagcagcccctacatccaggtgctggaggaggactggaggcaggccctgcgggaccaccaggagcaggccaacaccatcttcagcctgaggaaggacctgcggcagggcgaggcccggcggctgcgctgcatggaggagaaggagatgtttgagctgcagtgcctggccctgaggaaggacagcaagatgtacaaggacagaattgaggccatcctgctgcagatggaggaggtggccatcgagcgggaccaggccatcgccacccgggaggagctgcacgcccagcacgcccggggcctgcaggagaaggatgccctgaggaagcaggtgcgggagctgggggagaaggcagatgagctgcagctgcaggtgttccagtgtgaggcccagctgctggccgtggagggccgcctgcggcggcagcagctggagaccctggtgctgagcagtgacctggaggatggcagccccaggaggagccaggagctgagcctgccccaggacctggaggacacccagctgagtgacaagggctgcctggccggcggcggcagccccaagcagccctttgctgccctgcaccaggagcaggtgctgaggaacccccatgatgctggccctgctggcctgcccggcatcggggctgtgtgctag

SEQ ID NO: 146432 - DNA, 3501 bp, Artificial Sequence
  Description of Artificial Sequence: Synthetic coding sequence
atggacctgggcacagctgagggcacccgctgcacagaccccccagctgggaagccagccatggcccccaagaggaagggcggcctgaagctgaatgccatctgtgccaagctgagccggcaggtggtggtggagaagagagcagatgctggcagccacacagagggcagccccagccagccccgggaccaggagaggagcggccctgagagcggggccgcccgggcccccaggtctgaggaggacaagaggcgggccgtcatcgagaagtgggtgaatggagagtacagcgaggagcccgcccccacccctgtgctgggcagaattgcccgggagggcctggagctgcccccagagggcgtgtacatggtgcagccccagggctgcagtgatgaagaagatcatgctgaggagcccagcaaggatggaggagccctggaggagaaggacagtgatggagctgccagcaaggaggacagcggccccagcacccggcaggccagcggggaggccagcagcctgcgggactatgctgccagcaccatgacagagttcctgggcatgtttggctatgatgaccagaacaccagagatgagctggccaggaagatcagctttgagaagctgcatgctggcagcaccccagaggccgccaccagctccatgctgcccaccagcgaggacaccctgagcaagagggcccgcttcagcaaatatgaggagtacatcaggaagctgaaggccggggagcagctgtcctggccagcccccagcaccaagacagaggagcgggtgggcaaggaggtggtgggcaccctgcccggcctgcggctgcccagcagcacagcccacctggagaccaaggccaccatcctgcccctgcccagccacagctctgtgcagatgcagaacctggtggcccgggccagcaaatatgacttcttcatccagaagctgaagacaggagagaacctgcggccccagaatggcagcacctacaagaagcccagcaaatatgacctggagaatgtgaagtacctgcacctgttcaagccaggagagggcagcccagacatgggcggggccatcgccttcaagacaggcaaggtgggccggcccagcaaatatgatgtgcggggcatccagaagccaggccctgccaaggtgccccccacccccagcctggccccagcccccctggcctctgtgcccagcgcccccagcgcccctggccctggccctgagcccccagccagcctgtccttcaacaccccagagtacctgaagagcaccttcagcaagacagacagcatcaccaccggcaccgtgtccacagtgaagaatggcctgcccacagacaagccagctgtgacagaagatgtgaacatctaccagaagtacatcgcccgcttcagcggcagccagcactgcggccacatccactgtgcctaccagtaccgggagcactaccactgcctggaccctgagtgcaactaccagcgcttcaccagcaagcaggatgtgatccgccactacaacatgcacaagaagagggacaacagcctgcagcacggcttcatgaggttcagccccctggatgactgcagcgtgtactaccacggctgccacctgaatggcaagagcacccactaccactgcatgcaggtgggctgcaacaaggtgtacaccagcaccagtgatgtgatgacccatgagaacttccacaagaagaacacccagctgatcaatgatggcttccagcgcttccgggccacagaggactgtggcacagctgactgccagttctacggccagaagaccacccacttccactgcagaagacctggctgcaccttcaccttcaagaacaagtgtgacatcgagaagcacaagagctaccacatcaaggatgatgcctatgccaaggatggcttcaagaagttctacaagtatgaggagtgcaagtatgagggctgtgtgtacagcaaggccaccaaccacttccactgcatccgggccggctgcggcttcaccttcaccagcaccagccagatgaccagccacaagaggaagcatgagcggcggcacatccgcagcagcggggccctgggcctgccccccagcctgctgggcgccaaggacacagaacatgaggagagcagcaatgatgacctggtggacttcagcgccctgagcagcaagaacagcagcctgagcgccagccccaccagccagcagagcagcgccagcctggccgccgccacagctgccacagaggccggccccagcgccaccaagccacccaacagcaagatcagcggcctgctgccccagggcctgcccggcagcatccccctggccctggccctgagcaacagcggcctgcccacccccaccccctacttccccatcctggccggccggggcagcaccagcctgcctgtgggcacccccagcctgctgggcgctgtgagcagcggcagcgctgccagcgccaccccagacacccccaccctggtggccagcggggccggggacagcgcccctgtggccgccgcctctgtgcctgcccccccagccagcatcatggagcgcatcagcgccagcaagggcctcatcagccccatgatggcccggctggccgctgctgccctgaagcccagcgccacctttgatcctggcagcggccagcaggtgaccccagcccgcttccccccagcccaggtgaagccagagcctggagagagcactggagcccctggcccccatgaggccagccaggacaggagcctggacctgactgtgaaggagcccagcaatgaaagcaatggacatgctgtgcctgccaacagcagcctgctgagcagcctgatgaacaagatgagccagggcaaccctggcctgggcagcctgctgaacatcaaggccgaggccgagggcagccctgctgctgagcccagccccttcctgggcaaggctgtgaaggccctggtgcaggagaagctggccgagccctggaaggtgtacctgcggagatttggcaccaaggacttctgtgatggccagtgtgacttcctgcacaaggcccacttccactgtgtggtggaggagtgtggggccctcttcagcaccctggatggagccatcaagcacgccaacttccacttcagaacagagggcggggccgccaagggcaacacagaagctgccttccctgccagcgctgctgagaccaagccacccatggcccccagcagcccccctgtgccccctgtgaccacagccaccgtgagcagcctggagggccctgcccccagccctgcctctgtgcccagcacccccaccctgctggcctggaagcagctggccagcaccatcccccagatgccccagatcccagcctctgtgccccacctgcctgccagccccctggccaccaccagcctggagaatgccaagccccaggtgaagccaggcttcctgcagttccaggagaagtag

SEQ ID NO: 146433 - DNA, 5280 bp, Artificial Sequence
  Description of Artificial Sequence: Synthetic coding sequence
atggacctgggcacagctgagggcacccgctgcacagaccccccagctgggaagccagccatggcccccaagaggaagggcggcctgaagctgaatgccatctgtgccaagctgagccggcaggtggtggtggagaagagagcagatgctggcagccacacagagggcagccccagccagccccgggaccaggagaggagcggccctgagagcggggccgcccgggcccccaggtctgaggaggacaagaggcgggccgtcatcgagaagtgggtgaatggagagtacagcgaggagcccgcccccacccctgtgctgggcagaattgcccgggagggcctggagctgcccccagagggcgtgtacatggtgcagccccagggctgcagtgatgaagaagatcatgctgaggagcccagcaaggatggaggagccctggaggagaaggacagtgatggagctgccagcaaggaggacagcggccccagcacccggcaggccagcggggaggccagcagcctgcgggactatgctgccagcaccatgacagagttcctgggcatgtttggctatgatgaccagaacaccagagatgagctggccaggaagatcagctttgagaagctgcatgctggcagcaccccagaggccgccaccagctccatgctgcccaccagcgaggacaccctgagcaagagggcccgcttcagcaaatatgaggagtacatcaggaagctgaaggccggggagcagctgtcctggccagcccccagcaccaagacagaggagcgggtgggcaaggaggtggtgggcaccctgcccggcctgcggctgcccagcagcacagcccacctggagaccaaggccaccatcctgcccctgcccagccacagctctgtgcagatgcagaacctggtggcccgggccagcaaatatgacttcttcatccagaagctgaagacaggagagaacctgcggccccagaatggcagcacctacaagaagcccagcaaatatgacctggagaatgtgaagtacctgcacctgttcaagccaggagagggcagcccagacatgggcggggccatcgccttcaagacaggcaaggtgggccggcccagcaaatatgatgtgcggggcatccagaagccaggccctgccaaggtgccccccacccccagcctggccccagcccccctggcctctgtgcccagcgcccccagcgcccctggccctggccctgagcccccagccagcctgtccttcaacaccccagagtacctgaagagcaccttcagcaagacagacagcatcaccaccggcaccgtgtccacagtgaagaatggcctgcccacagacaagccagctgtgacagaagatgtgaacatctaccagaagtacatcgcccgcttcagcggcagccagcactgcggccacatccactgtgcctaccagtaccgggagcactaccactgcctggaccctgagtgcaactaccagcgcttcaccagcaagcaggatgtgatccgccactacaacatgcacaagaagagggacaacagcctgcagcacggcttcatgaggttcagccccctggatgactgcagcgtgtactaccacggctgccacctgaatggcaagagcacccactaccactgcatgcaggtgggctgcaacaaggtgtacaccagcaccagtgatgtgatgacccatgagaacttccacaagaagaacacccagctgatcaatgatggcttccagcgcttccgggccacagaggactgtggcacagctgactgccagttctacggccagaagaccacccacttccactgcagaagacctggctgcaccttcaccttcaagaacaagtgtgacatcgagaagcacaagagctaccacatcaaggatgatgcctatgccaaggatggcttcaagaagttctacaagtatgaggagtgcaagtatgagggctgtgtgtacagcaaggccaccaaccacttccactgcatccgggccggctgcggcttcaccttcaccagcaccagccagatgaccagccacaagaggaagcatgagcggcggcacatccgcagcagcggggccctgggcctgccccccagcctgctgggcgccaaggacacagaacatgaggagagcagcaatgatgacctggtggacttcagcgccctgagcagcaagaacagcagcctgagcgccagccccaccagccagcagagcagcgccagcctggccgccgccacagctgccacagaggccggccccagcgccaccaagccacccaacagcaagatcagcggcctgctgccccagggcctgcccggcagcatccccctggccctggccctgagcaacagcggcctgcccacccccaccccctacttccccatcctggccggccggggcagcaccagcctgcctgtgggcacccccagcctgctgggcgctgtgagcagcggcagcgctgccagcgccaccccagacacccccaccctggtggccagcggggccggggacagcgcccctgtggccgccgcctctgtgcctgcccccccagccagcatcatggagcgcatcagcgccagcaagggcctcatcagccccatgatggcccggctggccgctgctgccctgaagcccagcgccacctttgatcctggcagcggccagcaggtgaccccagcccgcttccccccagcccaggtgaagccagagcctggagagagcactggagcccctggcccccatgaggccagccaggacaggagcctggacctgactgtgaaggagcccagcaatgaaagcaatggacatgctgtgcctgccaacagcagcctgctgagcagcctgatgaacaagatgagccagggcaaccctggcctgggcagcctgctgaacatcaaggccgaggccgagggcagccctgctgctgagcccagccccttcctgggcaaggctgtgaaggccctggtgcaggagaagctggccgagccctggaaggtgtacctgcggagatttggcaccaaggacttctgtgatggccagtgtgacttcctgcacaaggcccacttccactgtgtggtggaggagtgtggggccctcttcagcaccctggatggagccatcaagcacgccaacttccacttcagaacagagggcggggccgccaagggcaacacagaagctgccttccctgccagcgctgctgagaccaagccacccatggcccccagcagcccccctgtgccccctgtgaccacagccaccgtgagcagcctggagggccctgcccccagccctgcctctgtgcccagcacccccaccctgctggcctggaagcagctggccagcaccatcccccagatgccccagatcccagcctctgtgccccacctgcctgccagccccctggccaccaccagcctggagaatgccaagccccaggtgaagccaggcttcctgcagttccaggagaatgacccctgcctggccacagactgcaagtatgccaacaagttccacttccactgcctgtttggaaactgcaagtatgtgtgcaagaccagcggcaaggccgagagccactgcctggaccacatcaaccccaacaacaacctggtgaatgtgcgggaccagtttgcctactacagcctgcagtgcctgtgccccaaccagcactgtgagttcaggatgaggggccactaccactgcctgaggacaggctgctactttgtgaccaacatcaccaccaagctgccctggcacatcaagaagcatgagaaggccgagaggagagctgccaacggcttcaagtacttcaccaagcgggaggagtgtggccgcctgggctgcaagtacaaccaggtgaacagccacttccactgcatccgggagggctgccagttctccttcctgctgaagcaccagatgaccagccacgccaggaagcacatgaggaggatgctgggcaagaactttgacagagtgccccccagccagggccccccaggcctgatggatgctgagacagatgagtgcatggactacacaggctgcagccctggggccatgagcagcgagagcagcaccatggacaggagctgcagcagcacccctgtgggcaatgaaagcacagctgctggcaacaccatctccatgcccacagccagcggggccaagaagcgcttctggatcatcgaggacatgagcccctttgggaagaggaggaagacagccagcagcaggaagatgctggatgagggcatgatgctggagggcttcagaagatttgacctgtatgaggactgcaaggatgctgcctgccagttcagcctgaaggtgacccactaccactgcacccgggagaactgtggctacaagttctgtggccgcacccacatgtacaagcacgcccagcaccacgacagagtggacaacctggtgctggatgacttcaagcgcttcaaggccagcctgagctgccactttgctgactgccccttcagcggcaccagcacccacttccactgcctgcgctgccgcttccgctgcacagacagcaccaaggtgacagcccacaggaagcaccacggcaagcaggatgtgatctctgctgctggcttctgccagttcagcagcagcgctgactgtgctgtgcctgactgcaagtacaagctgaagtgcagccacttccactgcaccttccctggctgccgccacacagtggtgggcatgagccagatggacagccacaagaggaagcatgagaagcaggagcggggggagcctgctgctgagggccctgcccctggcccccccatcagcctggatggcagcctgagcctgggcgctgagcccggcagcctgctcttcctgcagagcgctgctgctggcctgggcctggccctgggagatgctggggaccccggccccccagatgctgctgcccctggcccccgggagggcgctgctgctgctgctgctgctgctggggagagcagccaggaggatgaggaggaggagctggagctgcctgaggaggaggccgaggatgatgaagatgaagatgatgatgaagatgatgatgatgaagatgatgatgaagatgatgatgatgaggacctgaggacagattctgaggagagcctgcctgaggccgctgctgaggccgccggggccggggcccggaccccagccctggccgccctggccgccctgggcgcccctggccctgcccccacagctgccagcagcccctag

SEQ ID NO: 146434 - DNA, 4332 bp, Artificial Sequence
  Description of Artificial Sequence: Synthetic coding sequence
caggagctggaggccgccctgcacagagatgatgtggagttcatcagtgacctgattgcctgcctgctgcagggctgctaccagaggcgggacatcaccccccagaccttccacagctacctggaggacatcatcaactaccgctgggagctggaggagggcaagcccaaccccctgcgggaggccagcttccaggacctgcccctgcggaccagggtggagatcctgcaccggctgtgtgactaccgcctggatgctgatgatgtgtttgacctgctgaagggcctggatgctgacagcctgcgggtggagcccctgggggaggacaacagcggggccctgtactggtacttctacggcaccaggatgtacaaggaggaccctgtgcagggcaagagcaatggagagctgagcctgagccgggagagcgagggccagaagaatgtgagcagcatccctgggaagacaggcaagagaagaggccggccccccaagaggaagaagctgcaggaggagatcctgctgtctgagaagcaggaggagaacagcctggccagcgagccccagaccaggcatggcagccagggccctggccagggcacctggtggctgctgtgccagacagaggaggagtggaggcaggtgacagagagcttccgggagaggaccagcctgcgggagcggcagctgtacaagctgctgtctgaggacttcctgcctgagatctgcaacatgattgcccagaagggcaagaggccccagaggaccaaggccgagctgcacccccgctggatgtctgaccacctgagcatcaagcctgtgaagcaggaggagacccctgtgctgaccagaattgagaagcagaagaggaaggaggaggaggaggagcggcagatcctgctggccgtgcagaagaaggagcaggagcagatgctgaaggaggagaggaagcgggagctggaggagaaggtgaaggctgtggagggcatgtgcagcgtgcgggtggtgtggaggggggcctgcctgagcaccagcaggcctgtggaccgggccaagaggaggaagctgcgggaggagcgggcctggctgctggcccagggcaaggagctgcccccagagctgagccacctggaccccaacagccccatgagggaggagaagaagaccaaggacctgtttgagctggatgatgacttcaccgccatgtacaaggtgctggatgtggtgaaggcccacaaggacagctggcccttcctggagcctgtggatgagagctatgcccccaactactaccagatcatcaaggcccccatggacatcagctccatggagaagaagctgaatggaggcctgtactgcaccaaggaggagtttgtgaatgacatgaagaccatgttcaggaactgcaggaagtacaatggagagagcagcgagtacaccaagatgtctgacaacctggagcgctgcttccaccgggccatgatgaagcacttccctggagaagatggagacacagatgaggagttctggatcagagaagatgagaagcgggagaagaggaggagccgggccggccgcagcggcggcagccacgtgtggaccaggagccgggaccctgagggcagcagcaggaagcagcagcccatggagaatggaggcaagagcctgccccccacccggcgggcccccagcagtggagatgaccagagcagcagcagcacccagcccccccgggaggtgggcaccagcaatggccggggcttcagccaccccctgcactgcggcggcacccccagccaggcccccttcctgaaccagatgaggcctgctgtgcccggcaccttcggccccctgcggggcagtgaccctgccaccctgtatggcagcagcggcgtgcctgagccccaccctggagagcctgtgcagcagaggcagcccttcaccatgcagccccctgtgggcatcaacagcctgcggggcccccggctgggcaccccagaggagaagcagatgtgtggcggcctgacccacctgagcaacatgggcccccaccctggcagcctgcagctgggccagatcagcggccccagccaggacggctccatgtatgccccagcccagttccagcccggcttcatcccccccaggcatggaggagccccagcccggcccccagacttccctgagagcagcgagatcccccccagccacatgtaccgcagctacaagtacctgaacagagtgcacagcgctgtgtggaatggaaatcatggagccaccaaccagggccccctgggcccagatgagaagccccacctgggccctggccccagccaccagcccaggaccctgggccacgtgatggacagccgggtgatgaggcctcctgtgccccccaaccagtggacagagcagagcggcttcctgccccatggagtgcccagcagcggctacatgaggcctccctgcaagtctgctggccaccggctgcagcccccacctgtgcctgcccccagcagcctgtttggagccccagcccaggccctgcggggcgtgcagggcggggacagcatgatggacagccctgagatgattgccatgcagcagctgagcagccgggtgtgccccccaggagtgccctaccacccccaccagcctgcccacccccggctgcccggccccttcccccaggtggcccaccccatgtctgtgacagtgtctgcccccaagccagccctgggcaaccctggccgggccccagaaaattctgaggcccaggagccagaaaatgaccaggccgagcccctgcccggcctggaggagaagcccccaggagtgggcaccagcgagggcgtgtacctgacccagctgccccaccccaccccacccctgcagacagactgcacccggcagagcagcccccaggagcgggagaccgtgggccctgagctgaagagcagcagcagcgagagcgctgacaactgcaaggccatgaagggcaagaacccctggcccagcgacagcagctacccaggccctgctgcccagggctgtgtgcgggacctgagcacagtggccgacagaggagccctgtctgaaaatggagtgattggagaggccagcccctgtggcagcgagggcaagggcctgggcagcagcggcagcgagaagctgctgtgcccccggggccgcaccctgcaggagaccatgccctgcaccggccagaatgctgccaccccacccagcacagatcctggcctgaccggcggcaccgtgtcccagttcccccccctgtacatgcctggcctggagtaccccaacagcgctgcccactaccacatcagccctggcctgcagggcgtgggccctgtgatgggcggcaagagccctgccagccacccccagcacttccccccccggggcttccagagcaaccacccccacagcggcggcttcccccgctacagaccaccccagggcatgagatacagctaccaccccccaccccagcccagctaccaccactaccagaggaccccctactatgcctgcccccagagcttcagtgactggcagaggcccctgcacccccagggcagccccagcggccccccagccagccagcccccaccacccaggagcctcttcagtgacaagaatgccatggccagcctgcagggctgtgagaccctgaatgctgccctgaccagccccaccaggatggatgctgtggccgccaaggtgcccaatgatggccagaaccctggccctgaggaggagaagctggatgagagcatggagaggcctgagagccccaaggagttcctggacctggacaaccacaatgctgccaccaagaggcagagcagcctgagcgccagcgagtacctgtatggcaccccaccacccctgagcagcggcatgggcttcggcagcagcgccttccccccccacagcgtgatgctgcagacaggccccccctacaccccccagaggcctgccagccacttccagccccgggcctacagcagccctgtggccgccctgcccccccaccaccctggggccacccagcccaacggcctgagccaggagggccccatctaccgctgccaggaggagggcctgggccacttccaggccgtgatgatggagcagatcggcaccaggagcggcatccggggccccttccaggagatgtaccggcccagcggcatgcagatgcaccctgtgcagagccaggccagcttccccaagacccccacagctgccaccagccaggaggaggtgcccccccacaagccacccaccctgcccctggaccagagctag

SEQ ID NO: 146435 - DNA, 1371 bp, Artificial Sequence
  Description of Artificial Sequence: Synthetic coding sequence
gagctggaggccgccctgcacagagatgatgtggagttcatcagtgacctgattgcctgcctgctgcagggctgctaccagaggcgggacatcaccccccagaccttccacagctacctggaggacatcatcaactaccgctgggagctggaggagggcaagcccaaccccctgcgggaggccagcttccaggacctgcccctgcggaccagggtggagatcctgcaccggctgtgtgactaccgcctggatgctgatgatgtgtttgacctgctgaagggcctggatgctgacagcctgcgggtggagcccctgggggaggacaacagcggggccctgtactggtacttctacggcaccaggatgtacaaggaggaccctgtgcagggcaagagcaatggagagctgagcctgagccgggagagcgagggccagaagaatgtgagcagcatccctgggaagacaggcaagaggcggggccggccccccaagaggaagaagctgcaggaggagatcctgctgtctgagaagcaggaggagaacagcctggccagcgagccccagaccaggcatggcagccagggccctggccagggcacctggtggctgctgtgccagacagaggaggagtggaggcaggtgacagagagcttccgggagaggaccagcctgcgggagcggcagctgtacaagctgctgtctgaggacttcctgcctgagatctgcaacatgattgcccagaaggagacccctgtgctgacccgcatcgagaagcagaagaggaaggaggaggaggaggagcggcagatcctgctggccgtgcagaagaaggagcaggagcagatgctgaaggaggagaggaagcgggagctggaggagaaggtgaaggctgtggagggcatgtgcagcgtgcgggtggtgtggaggggggcctgcctgagcaccagcaggcctgtggaccgggccaagaggaggaagctgcgggaggagcgggcctggctgctggcccagggcaaggagctgcccccagagctgagccacctggaccccaacagccccatgagggaggagaagaagaccaaggacctgtttgagctggatgatgacttcaccgccatgtacaaggtgctggatgtggtgaaggcccacaaggacagctggcccttcctggagcctgtggatgagagctatgcccccaactactaccagatcatcaaggcccccatggacatcagctccatggagaagaagctgaatggaggcctgtactgcaccaaggaggagtttgtgaatgacatgaagaccatgttcaggaactgcaggaagtacaacggggagagcagcggcaagcagggccgcagcctgtgctag

SEQ ID NO: 146436 - DNA, 1584 bp, Artificial Sequence
  Description of Artificial Sequence: Synthetic coding sequence
atggctgacagccgggaccctgccagtgaccagatgcagcactggaaggagcagagagctgcccagaaggcagatgtgctgaccactggagctggcaaccctgtgggggacaagctgaatgtcatcaccgtgggcccccggggccccctgctggtgcaggatgtggtgttcacagatgagatggcccactttgaccgggagcgcatccctgagcgggtggtgcacgccaagggagctggggccttcggctactttgaggtgacccatgacatcaccaagtacagcaaggccaaggtgtttgagcacatcggcaagaagacccccatcgctgtgcgcttcagcacagtggccggggagagcggcagcgctgacacagtgcgggacccccggggctttgctgtgaagttctacacagaagatggcaactgggacctggtgggcaacaacacccccatcttcttcatccgggaccccatcctcttccccagcttcatccacagccagaagaggaacccccagacccacctgaaggaccctgacatggtgtgggacttctggagcctgcggcctgagagcctgcaccaggtgtccttcctgttcagtgaccggggcatcccagatggccaccgccacatgaatggctacggcagccacaccttcaagctggtgaatgccaacggggaggccgtgtactgcaagttccactacaagacagaccagggcatcaagaacctgtctgtggaggatgctgcccggctgagccaggaggaccctgactatggcatccgggacctcttcaatgccatcgccaccgggaagtaccccagctggaccttctacatccaggtgatgaccttcaaccaggccgagaccttccccttcaacccctttgacctgaccaaggtgtggccccacaaggactaccccctcatccctgtgggcaagctggtgctgaacagaaatcctgtgaactactttgctgaggtggagcagatcgcctttgaccccagcaacatgcctcctggcatcgaggccagcccagacaagatgctgcagggccgcctgtttgcctacccagacacccaccgccaccggctgggccccaactacctgcacatccctgtgaactgcccctaccgggcccgggtggccaactaccagagagatggccccatgtgcatgcaggacaaccagggcggggcccccaactactaccccaacagctttggagcccctgagcagcagcccagcgccctggagcacagcatccagtacagcggggaggtgcggcgcttcaacacagccaatgatgacaacgtgacccaggtgcgggccttctacgtgaatgtgctgaatgaggagcagaggaagaggctgtgtgaaaatattgctggccacctgaaggatgcccagatcttcatccagaagaaggctgtgaagaacttcacagaggtgcacccagactatggcagccacatccaggccctgctggacaagtacaatgctgagaagcccaagaatgccatccacacctttgtgcagagcggcagccacctggccgcccgggagaaggccaacctgtag

SEQ ID NO: 146437 - DNA, 816 bp, Artificial Sequence
  Description of Artificial Sequence: Synthetic coding sequence
atgcctgaggccccacccctgctgctggccgctgtgctgctgggcctggtgctgctggtggtgctgctgctgctgctgcggcactggggctggggcctgtgcctgattggctggaatgagttcatcctgcagcccatccacaacctgctgatgggagacaccaaggagcagaggatcctgaaccacgtgctgcagcacgccgagcctggaaatgcccagagcgtgctggaggccatcgacacctactgtgagcagaaggagtgggccatgaatgtgggggacaagaagggcaagatcgtggatgctgtgatccaggagcaccagcccagcgtgctgctggagctgggcgcctactgcggctacagcgctgtgaggatggcccggctgctgagccctggggcccggctcatcaccatcgagatcaacccagactgtgccgccatcacccagaggatggtggactttgctggggtgaaggacaaggtgaccctggtggtgggcgccagccaggacatcatcccccagctgaagaagaagtatgatgtggacaccctggacatggtgttcctggaccactggaaggaccgctacctgcctgacaccctgctgctggaggagtgtggcctgctgaggaagggcaccgtgctgctggccgacaacgtcatctgccctggggccccagacttcctggcccacgtgcggggcagcagctgctttgagtgcacccactaccagagcttcctggagtaccgggaggtggtggatggcctggagaaggccatctacaagggccctggcagcgaggccggcccctag

SEQ ID NO: 146438 - DNA, 816 bp, Artificial Sequence; identical to SEQ ID NO: 146437
  Description of Artificial Sequence: Synthetic coding sequence

SEQ ID NO: 146439 - DNA, 816 bp, Artificial Sequence; identical to SEQ ID NO: 146437
  Description of Artificial Sequence: Synthetic coding sequence

SEQ ID NO: 146440 - DNA, 666 bp, Artificial Sequence
  Description of Artificial Sequence: Synthetic coding sequence
atgggagacaccaaggagcagaggatcctgaaccacgtgctgcagcacgccgagcctggaaatgcccagagcgtgctggaggccatcgacacctactgtgagcagaaggagtgggccatgaatgtgggggacaagaagggcaagatcgtggatgctgtgatccaggagcaccagcccagcgtgctgctggagctgggcgcctactgcggctacagcgctgtgaggatggcccggctgctgagccctggggcccggctcatcaccatcgagatcaacccagactgtgccgccatcacccagaggatggtggactttgctggggtgaaggacaaggtgaccctggtggtgggcgccagccaggacatcatcccccagctgaagaagaagtatgatgtggacaccctggacatggtgttcctggaccactggaaggaccgctacctgcctgacaccctgctgctggaggagtgtggcctgctgaggaagggcaccgtgctgctggccgacaacgtcatctgccctggggccccagacttcctggcccacgtgcggggcagcagctgctttgagtgcacccactaccagagcttcctggagtaccgggaggtggtggatggcctggagaaggccatctacaagggccctggcagcgaggccggcccctag

SEQ ID NO: 146441 - DNA, 672 bp, Artificial Sequence
  Description of Artificial Sequence: Synthetic coding sequence
atgcctgaggccccacccctgctgctggccgctgtgctgctgggcctggtgctgctggtggtgctgctgctgctgctgcggcactggggctggggcctgtgcctgattggctggaatgagttcatcctgcagcccatccacaacctgctgatgggagacaccaaggagcagaggatcctgaaccacgtgctgcagcacgccgagcctggaaatgcccagagcgtgctggaggccatcgacacctactgtgagcagaaggagtgggccatgaatgtgggggacaagaagggcaagatcgtggatgctgtgatccaggagcaccagcccagcgtgctgctggagctgggcgcctactgcggctacagcgctgtgaggatggcccggctgctgagccctggggcccggctcatcaccatcgagatcaacccagactgtgccgccatcacccagaggatggtggactttgctggggtgaaggacaaggtgaccctggtggtgggcgccagccaggacatcatcccccagctgaagaagaagtatgatgtggacaccctggacatggtgttcctggaccactggaaggaccgctacctgcctgacaccctgctgctggaggagtgtggcctgctgaggaagggcaccgtgctgctggccgacaacgtcatctgctag

SEQ ID NO: 146442 - DNA, 666 bp, Artificial Sequence; identical to SEQ ID NO: 146440
  Description of Artificial Sequence: Synthetic coding sequence

SEQ ID NO: 146443 - DNA, 2664 bp, Artificial Sequence
  Description of Artificial Sequence: Synthetic coding sequence
atggccaacggcaccctgacccggcggcaccagaatggccgctttgtgggagatgctgacctggagcggcagaagttcagtgacctgaagctgaatggcccccaggaccacagccacctgctgtacagcaccatccccaggatgcaggagcccggccagatcgtggagacctacacagaagaagatcctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgaccagaattgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagcccggaggacaggcacccccagcgacccccggcggcggctgcggagctatgaggacatgattggagaggaggtgcccagcgaccagtactactgggcccccctggcccagcacgagcggggcagcctggccagcctggacagcctgaggaaaggaggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaagtcatcatcccccacagcggctgggagcgggagcccaatgaagactgcaagcccaggcacatcgagtgggagagcgtgctgaccaacacagctggctgcctgagaaatgtgtcctctgagaggtctgaggcccggaggaagctgcgggagtgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgcccccaacgtggccaacaacacaggcccccatgctgccagctgctttggagccaagaagggcaagggcaagaagcccattgaagatcctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgaacatgagcgggtggtgaaggccgccagcggggccctgaggaacctggccgtggatgccaggaacaaggagctgattggcaagcacgccatccccaacctggtgaagaacctgcccggcggccagcagaacagctcctggaacttcagcgaggacaccgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggccgccgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaacaactacagcaccccaaatgaaagaggagaccacaacagaaccctggacagaagtggggacctgggggacatggagcccctgaagggcaccacccccctgatgcaggatgagggccaggagagcctggaggaggagctggatgtgctggtgctggatgatgagggcggccaggtgtcctaccccagcatgcagaagatctag

SEQ ID NO: 146444 - DNA, 1755 bp, Artificial Sequence
  Description of Artificial Sequence: Synthetic coding sequence
atggatggctggaggcggcccctgcagagcgtgggcaaggtgtgtgagaagaacatgaagaccagcgagatgcacaccatgtctggggcccagacaggcaggaaggagaagggggaccccctgaacatcgccatcgacaagatgaccaagaagacccgggacctgcggcggcagctgaggaaggctgtgatggaccacatcagtgacagcttcctggagaccaacgtgcccctgctggtgctgattgaggccgccaagtctggaaatgagaaggaggtgaaggagtatgcccaggtgttccgggagcacgccaacaagctggtggaggtggccaacctggcctgcagcatcagcaacaatgaggagggcgtgaagctggtgaggatggccgccacccagattgacagcctgtgcccccaggtgatcaatgctgccctgaccctggccgcccggccccagagcaaggtggcccaggacaacatggatgtgttcaaggaccagtgggagaagcaggtgcgggtgctgacagaggccgtggatgacatcacctctgtggatgacttcctgtctgtgtctgagaaccacatcctggaggatgtgaacaagtgtgtgattgccctgcaggagggagatgtggacaccctggacagaacagctggggccatccggggccgggccgcccgggtcatccacatcatcaatgctgagatggagaactatgaggccggcgtgtacacagagaaggtgctggaggccaccaagctgctgtctgaaacagtgatgcccaggtttgctgagcaggtggaggtggccatcgaggccctgagcgccaacgtgccccagccctttgaagaaaatgagttcattgatgccagccggctggtgtatgatggagtgcgggacatcaggaaggctgtgctgatgatccgcaccccagaggagctggaggatgacagcgactttgagcaggaggactatgatgtgcgcagcaggacctctgtgcagacagaagatgaccagctgattgctggccagagcgcccgggccatcatggcccagctgccccaggaggagaaggccaagattgctgagcaggtggagatcttccaccaggagaagagcaagctggatgctgaggtggccaagtgggatgacagcggaaatgacatcatcgtgctggccaagcagatgtgcatgatcatgatggagatgacagacttcacccggggcaagggccccctgaagaacaccagtgatgtgatcaatgctgccaagaagattgctgaggccggcagcaggatggacaagctggcccgggctgtggccgaccagtgcccagacagcgcctgcaagcaggacctgctggcctacctgcagagaattgccctgtactgccaccagctgaacatctgcagcaaggtgaaggccgaggtgcagaacctgggcggggagctgattgtgtctggcctggacagcgccaccagcctcatccaggccgccaagaacctgatgaatgctgtggtgctgactgtgaaggccagctatgtggccagcaccaagtaccagaaggtgtatggaacagctgctgtgaacagccctgtggtgtcctggaagatgaaggcccctgagaagaagcccctggtgaagcgggagaagccagaggagttccagaccagggtgagaagaggcagccagaagaagcacatcagccctgtgcaggccctgtctgagttcaaggccatggacagcttctag

SEQ ID NO: 146445 - DNA, 2820 bp, Artificial Sequence
  Description of Artificial Sequence: Synthetic coding sequence
atgagcggcctcatctgcctgcagtatggcctgtggcacggccagaagattgactttggaggcccccggcggctgctgcagaggaacagaggagagggctccatgaccagcgccaccagccccatcatcctgaagtgggaccccaagagcctggagatccgcaccctgactgtggagcggctgctggagcccctggtgacccaggtgaccaccctggtgaacaccagcaacaagggccccagcggcaagaagaagggccgcagcaagaaggcccacgtgctggccgcctctgtggagcaggccacccagaacttcctggagaagggggagcagatcgccaaggagagccaggacctgaaggaggagctggtggccgctgtggaggatgtgaggaagcagggcgagaccatgagaattgccagcagcgagtttgctgatgacccctgcagctctgtgaagaggggcaccatggtgcgggccgcccgggccctgctgtctgctgtgacccggctgctgatcctggccgacatggctgatgtgatgaggctgctgagccacctgaagatcgtggaggaggccctggaggccgtgaagaatgccaccaatgagcaggacctggccaaccgcttcaaggagtttgggaaggagatggtgaagctgaactacgtggccgcccggcggcagcaggagctgaaggacccccactgcagagatgagatggccgccgcccggggggccctgaagaagaatgccaccatgctgtacacagccagccaggccttcctgcggcacccagatgtggccgccacccgggccaacagagattatgtgttcaagcaggtgcaggaggccatcgccggcatcagcaatgctgcccaggccaccagccccacagatgaggccaagggccacactggaattggagagctggccgccgccctgaatgaatttgacaacaagatcatcctggaccccatgaccttcagcgaggcccgcttccggcccagcctggaggagcggctggagagcatcatcagcggggccgccctgatggctgacagcagctgcaccagagatgacagaagagaaagaattgtggccgagtgcaatgctgtgcggcaggccctgcaggacctgctgtctgagtacatgaacaacacaggcaggaaggagaagggggaccccctgaacatcgccatcgacaagatgaccaagaagacccgggacctgcggcggcagctgaggaaggctgtgatggaccacatcagtgacagcttcctggagaccaacgtgcccctgctggtgctgattgaagctgccaagtctggaaatgagaaggaggtgaaggagtatgcccaggtgttccgggagcacgccaacaagctggtggaggtggccaacctggcctgcagcatcagcaacaatgaggagggcgtgaagctggtgaggatggccgccacccagattgacagcctgtgcccccaggtgatcaatgctgccctgaccctggccgcccggccccagagcaaggtggcccaggacaacatggatgtgttcaaggaccagtgggagaagcaggtgcgggtgctgacagaagctgtggatgacatcacctctgtggatgacttcctgtctgtgtctgagaaccacatcctggaggatgtgaacaagtgtgtgattgccctgcaggagggagatgtggacaccctggacagaacagctggggccatccggggccgggccgcccgggtcatccacatcatcaatgctgagatggagaactatgaagctggggtgtacacagagaaggtgctggaggccaccaagctgctgtctgagaccgtgatgcccaggtttgctgagcaggtggaggtggccatcgaggccctgagcgccaacgtgccccagccctttgaggagaatgagttcattgatgccagccggctggtgtatgatggagtgcgggacatcaggaaggctgtgctgatgatccgcaccccagaggagctggaggatgacagcgactttgagcaggaggactatgatgtgcgcagcaggacctctgtgcagacagaagatgaccagctgattgctggccagagcgcccgggccatcatggcccagctgccccaggaggagaaggccaagattgctgagcaggtggagatcttccaccaggagaagagcaagctggatgctgaggtggccaagtgggatgattctggaaatgacatcatcgtgctggccaagcagatgtgcatgatcatgatggagatgacagacttcacccggggcaagggccccctgaagaacaccagtgatgtgatcaatgctgccaagaagattgctgaggccggcagcaggatggacaagctggcccgggctgtggccgaccagtgcccagattctgcctgcaagcaggacctgctggcctacctgcagagaattgccctgtactgccaccagctgaacatctgcagcaaggtgaaggccgaggtgcagaacctgggcggggagctgattgtgtctggcctggacagcgccaccagcctcatccaggccgccaagaacctgatgaatgctgtggtgctgactgtgaaggccagctatgtggccagcaccaagtaccagaaggtgtatggaacagctgctgtgaacagccctgtggtgtcctggaagatgaaggcccctgagaagaagcccctggtgaagcgggagaagccagaggagttccagaccagggtgcggcggggcagccagaagaagcacatcagccctgtgcaggccctgtctgagttcaaggccatggacagcttctag

SEQ ID NO: 146446 - DNA, 2862 bp, Artificial Sequence
  Description of Artificial Sequence: Synthetic coding sequence
atgaccagcgccaccagccccatcatcctgaagtgggaccccaagagcctggagatccgcaccctgactgtggagcggctgctggagcccctggtgacccaggtgaccaccctggtgaacaccagcaacaagggccccagcggcaagaagaagggccgcagcaagaaggcccacgtgctggccgcctctgtggagcaggccacccagaacttcctggagaagggggagcagatcgccaaggagagccaggacctgaaggaggagctggtggccgctgtggaggatgtgaggaagcagggcgagaccatgagaattgccagcagcgagtttgctgatgacccctgcagctctgtgaagaggggcaccatggtgcgggccgcccgggccctgctgtctgctgtgacccggctgctgatcctggccgacatggctgatgtgatgaggctgctgagccacctgaagatcgtggaggaggccctggaggccgtgaagaatgccaccaatgagcaggacctggccaaccgcttcaaggagtttgggaaggagatggtgaagctgaactacgtggccgcccggcggcagcaggagctgaaggacccccactgcagagatgagatggccgccgcccggggggccctgaagaagaatgccaccatgctgtacacagccagccaggccttcctgcggcacccagatgtggccgccacccgggccaacagagattatgtgttcaagcaggtgcaggaggccatcgccggcatcagcaatgctgcccaggccaccagccccacagatgaggccaagggccacactggaattggagagctggccgccgccctgaatgaatttgacaacaagatcatcctggaccccatgaccttcagcgaggcccgcttccggcccagcctggaggagcggctggagagcatcatcagcggggccgccctgatggctgacagcagctgcaccagagatgacagaagagaaagaattgtggccgagtgcaatgctgtgcggcaggccctgcaggacctgctgtctgagtacatgaacaacacaggcaggaaggagaagggggaccccctgaacatcgccatcgacaagatgaccaagaagacccgggacctgcggcggcagctgaggaaggctgtgatggaccacatcagtgacagcttcctggagaccaacgtgcccctgctggtgctgattgaagctgccaagtctggaaatgagaaggaggtgaaggagtatgcccaggtgttccgggagcacgccaacaagctggtggaggtggccaacctggcctgcagcatcagcaacaatgaggagggcgtgaagctggtgaggatggccgccacccagattgacagcctgtgcccccaggtgatcaatgctgccctgaccctggccgcccggccccagagcaaggtggcccaggacaacatggatgtgttcaaggaccagtgggagaagcaggtgcgggtgctgacagaagctgtggatgacatcacctctgtggatgacttcctgtctgtgtctgagaaccacatcctggaggatgtgaacaagtgtgtgattgccctgcaggagggagatgtggacaccctggacagaacagctggggccatccggggccgggccgcccgggtcatccacatcatcaatgctgagatggagaactatgaagctggggtgtacacagagaaggtgctggaggccaccaagctgctgtctgagaccgtgatgcccaggtttgctgagcaggtggaggtggccatcgaggccctgagcgccaacgtgccccagccctttgaggagaatgagttcattgatgccagccggctggtgtatgatggagtgcgggacatcaggaaggctgtgctgatgatccgcaccccagaggagctggaggatgacagcgactttgagcaggaggactatgatgtgcgcagcaggacctctgtgcagacagaagatgaccagctgattgctggccagagcgcccgggccatcatggcccagctgccccaggaggagaaggccaagattgctgagcaggtggagatcttccaccaggagaagagcaagctggatgctgaggtggccaagtgggatgattctggaaatgacatcatcgtgctggccaagcagatgtgcatgatcatgatggagatgacagacttcacccggggcaagggccccctgaagaacaccagtgatgtgatcaatgctgccaagaagattgctgaggccggcagcaggatggacaagctggcccgggctgtggccgaccagtgcccagattctgcctgcaagcaggacctgctggcctacctgcagagaattgccctgtactgccaccagctgaacatctgcagcaaggtgaaggccgaggtgcagaacctgggcggggagctgattgtgtctggaactggagtgcagagcaccttcaccaccttctatgaggtggactgtgatgtgattgatggcggccgggccagccagctgagcacccacctgcccacctgtgccgagggcgcccccatcggcagcggcagcagtgacagctccatgctggacagcgccaccagcctcatccaggccgccaagaacctgatgaatgctgtggtgctgactgtgaaggccagctatgtggccagcaccaagtaccagaaggtgtatggaacagctgctgtgaacagccctgtggtgtcctggaagatgaaggcccctgagaagaagcccctggtgaagcgggagaagccagaggagttccagaccagggtgcggcggggcagccagaagaagcacatcagccctgtgcaggccctgtctgagttcaaggccatggacagcttctag

SEQ ID NO: 146447 - DNA, 354 bp, Artificial Sequence
  Description of Artificial Sequence: Synthetic coding sequence
atgaccagcgccaccagccccatcatcctgaagtgggaccccaagagcctggagatccgcaccctgactgtggagcggctgctggagcccctggtgacccaggtgaccaccctggtgaacaccagcaacaagggccccagcggcaagaagaagggccgcagcaagaaggcccacgtgctggccgcctctgtggagcaggccacccagaacttcctggagaagggggagcagatcgccaaggagagccaggacctgaaggaggagctggtggccgctgtggaggatgtgaggaagcagggcgagaccatgagaattgccagcagcgagtttgctgatgacccctgcagcagctag

SEQ ID NO: 146448 - DNA, 201 bp, Artificial Sequence
  Description of Artificial Sequence: Synthetic coding sequence
atgaccagcgccaccagccccatcatcctgaagtgggaccccaagagcctggagatccgcaccctgactgtggagcggctgctggagcccctggtgacccaggtgaccaccctggtgaacaccagcaacaagggccccagcggcaagaagaagggccgcagcaagaaggcccacgtgctggccgcctctgtggagcagtag

SEQ ID NO: 146449 - DNA, 2718 bp, Artificial Sequence
  Description of Artificial Sequence: Synthetic coding sequence
atgaccagcgccaccagccccatcatcctgaagtgggaccccaagagcctggagatccgcaccctgactgtggagcggctgctggagcccctggtgacccaggtgaccaccctggtgaacaccagcaacaagggccccagcggcaagaagaagggccgcagcaagaaggcccacgtgctggccgcctctgtggagcaggccacccagaacttcctggagaagggggagcagatcgccaaggagagccaggacctgaaggaggagctggtggccgctgtggaggatgtgaggaagcagggcgagaccatgagaattgccagcagcgagtttgctgatgacccctgcagctctgtgaagaggggcaccatggtgcgggccgcccgggccctgctgtctgctgtgacccggctgctgatcctggccgacatggctgatgtgatgaggctgctgagccacctgaagatcgtggaggaggccctggaggccgtgaagaatgccaccaatgagcaggacctggccaaccgcttcaaggagtttgggaaggagatggtgaagctgaactacgtggccgcccggcggcagcaggagctgaaggacccccactgcagagatgagatggccgccgcccggggggccctgaagaagaatgccaccatgctgtacacagccagccaggccttcctgcggcacccagatgtggccgccacccgggccaacagagattatgtgttcaagcaggtgcaggaggccatcgccggcatcagcaatgctgcccaggccaccagccccacagatgaggccaagggccacactggaattggagagctggccgccgccctgaatgaatttgacaacaagatcatcctggaccccatgaccttcagcgaggcccgcttccggcccagcctggaggagcggctggagagcatcatcagcggggccgccctgatggctgacagcagctgcaccagagatgacagaagagaaagaattgtggccgagtgcaatgctgtgcggcaggccctgcaggacctgctgtctgagtacatgaacaacacaggcaggaaggagaagggggaccccctgaacatcgccatcgacaagatgaccaagaagacccgggacctgcggcggcagctgaggaaggctgtgatggaccacatcagtgacagcttcctggagaccaacgtgcccctgctggtgctgattgaagctgccaagtctggaaatgagaaggaggtgaaggagtatgcccaggtgttccgggagcacgccaacaagctggtggaggtggccaacctggcctgcagcatcagcaacaatgaggagggcgtgaagctggtgaggatggccgccacccagattgacagcctgtgcccccaggtgatcaatgctgccctgaccctggccgcccggccccagagcaaggtggcccaggacaacatggatgtgttcaaggaccagtgggagaagcaggtgcgggtgctgacagaagctgtggatgacatcacctctgtggatgacttcctgtctgtgtctgagaaccacatcctggaggatgtgaacaagtgtgtgattgccctgcaggagggagatgtggacaccctggacagaacagctggggccatccggggccgggccgcccgggtcatccacatcatcaatgctgagatggagaactatgaagctggggtgtacacagagaaggtgctggaggccaccaagctgctgtctgagaccgtgatgcccaggtttgctgagcaggtggaggtggccatcgaggccctgagcgccaacgtgccccagccctttgaggagaatgagttcattgatgccagccggctggtgtatgatggagtgcgggacatcaggaaggctgtgctgatgatccgcaccccagaggagctggaggatgacagcgactttgagcaggaggactatgatgtgcgcagcaggacctctgtgcagacagaagatgaccagctgattgctggccagagcgcccgggccatcatggcccagctgccccaggaggagaaggccaagattgctgagcaggtggagatcttccaccaggagaagagcaagctggatgctgaggtggccaagtgggatgattctggaaatgacatcatcgtgctggccaagcagatgtgcatgatcatgatggagatgacagacttcacccggggcaagggccccctgaagaacaccagtgatgtgatcaatgctgccaagaagattgctgaggccggcagcaggatggacaagctggcccgggctgtggccgaccagtgcccagattctgcctgcaagcaggacctgctggcctacctgcagagaattgccctgtactgccaccagctgaacatctgcagcaaggtgaaggccgaggtgcagaacctgggcggggagctgattgtgtctggcctggacagcgccaccagcctcatccaggccgccaagaacctgatgaatgctgtggtgctgactgtgaaggccagctatgtggccagcaccaagtaccagaaggtgtatggaacagctgctgtgaacagccctgtggtgtcctggaagatgaaggcccctgagaagaagcccctggtgaagcgggagaagccagaggagttccagaccagggtgcggcggggcagccagaagaagcacatcagccctgtgcaggccctgtctgagttcaaggccatggacagcttctag

SEQ ID NO: 146450 - DNA, 2718 bp, Artificial Sequence; identical to SEQ ID NO: 146449
  Description of Artificial Sequence: Synthetic coding sequence

SEQ ID NO: 146451 - DNA, 2583 bp, Artificial Sequence
  Description of Artificial Sequence: Synthetic coding sequence
atgaccagcgccaccagccccatcatcctgaagtgggaccccaagagcctggagatccgcaccctgactgtggagcggctgctggagcccctggtgacccaggtgaccaccctggtgaacaccagcaacaagggccccagcggcaagaagaagggccgcagcaagaaggcccacgtgctggccgcctctgtggagcaggccacccagaacttcctggagaagggggagcagatcgccaaggagagccaggacctgaaggaggagctggtggccgctgtggaggatgtgaggaagcagggcgagaccatgagaattgccagcagcgagtttgctgatgacccctgcagctctgtgaagaggggcaccatggtgcgggccgcccgggccctgctgtctgctgtgacccggctgctgatcctggccgacatggctgatgtgatgaggctgctgagccacctgaagatcgtggaggaggccctggaggccgtgaagaatgccaccaatgagcaggacctggccaaccgcttcaaggagtttgggaaggagatggtgaagctgaactacgtggccgcccggcggcagcaggagctgaaggacccccactgcagagatgagatggccgccgcccggggggccctgaagaagaatgccaccatgctgtacacagccagccaggccttcctgcggcacccagatgtggccgccacccgggccaacagagattatgtgttcaagcaggtgcaggaggccatcgccggcatcagcaatgctgcccaggccaccagccccacagatgaggccaagggccacactggaattggagagctggccgccgccctgaatgaatttgacaacaagatcatcctggaccccatgaccttcagcgaggcccgcttccggcccagcctggaggagcggctggagagcatcatcagcggggccgccctgatggctgacagcagctgcaccagagatgacagaagagaaagaattgtggccgagtgcaatgctgtgcggcaggccctgcaggacctgctgtctgagtacatgaacaacacaggcaggaaggagaagggggaccccctgaacatcgccatcgacaagatgaccaagaagacccgggacctgcggcggcagctgaggaaggctgtgatggaccacatcagtgacagcttcctggagaccaacgtgcccctgctggtgctgattgaagctgccaagtctggaaatgagaaggaggtgaaggagtatgcccaggtgttccgggagcacgccaacaagctggtggaggtggccaacctggcctgcagcatcagcaacaatgaggagggcgtgaagctggtgaggatggccgccacccagattgacagcctgtgcccccaggtgatcaatgctgccctgaccctggccgcccggccccagagcaaggtggcccaggacaacatggatgtgttcaaggaccagtgggagaagcaggtgcgggtgctgacagaagctgtggatgacatcacctctgtggatgacttcctgtctgtgtctgagaaccacatcctggaggatgtgaacaagtgtgtgattgccctgcaggagggagatgtggacaccctggacagaacagctggggccatccggggccgggccgcccgggtcatccacatcatcaatgctgagatggagaactatgaagctggggtgtacacagagaaggtgctggaggccaccaagctgctgtctgagaccgtgatgcccaggtttgctgagcaggtggaggtggccatcgaggccctgagcgccaacgtgccccagccctttgaggagaatgagttcattgatgccagccggctggtgtatgatggagtgcgggacatcaggaaggctgtgctgatgatccgcaccccagaggagctggaggatgacagcgactttgagcaggaggactatgatgtgcgcagcaggacctctgtgcagacagaagatgaccagctgattgctggccagagcgcccgggccatcatggcccagctgccccaggaggagaaggccaagattgctgagcaggtggagatcttccaccaggagaagagcaagctggatgctgaggtggccaagtgggatgattctggaaatgacatcatcgtgctggccaagcagatgtgcatgatcatgatggagatgacagacttcacccggggcaagggccccctgaagaacaccagtgatgtgatcaatgctgccaagaagattgctgaggccggcagcaggatggacaagctggcccgggctgtggccgaccagctggacagcgccaccagcctcatccaggccgccaagaacctgatgaatgctgtggtgctgactgtgaaggccagctatgtggccagcaccaagtaccagaaggtgtatggaacagctgctgtgaacagccctgtggtgtcctggaagatgaaggcccctgagaagaagcccctggtgaagcgggagaagccagaggagttccagaccagggtgagaagaggcagccagaagaagcacatcagccctgtgcaggccctgtctgagttcaaggccatggacagcttctag

SEQ ID NO: 146452 - DNA, 2718 bp, Artificial Sequence; identical to SEQ ID NO: 146449
  Description of Artificial Sequence: Synthetic coding sequence

SEQ ID NO: 146453 - DNA, 582 bp, Artificial Sequence
  Description of Artificial Sequence: Synthetic coding sequence
atgtctgctgagacccccatcaccctgaacatcgacccccaggacctgcaggtgcagaccttcaccgtggagaagctgctggagcccctcatcatccaggtgaccaccctggtgaactgcccccagaaccccagcagcaggaagaagggccgcagcaagagggcctctgtgctgctggcctctgtggaggaggccacctggaacctgctggacaagggggagaagatcgcccaggaggccaccgtgctgaaggatgagctgacagccagcctggaggaggtgaggaaggagagcgaggccctgaaggtgtctgctgagcgcttcacagatgacccctgcttcctgcccaagcgggaggccgtggtgcaggccgcccgggccctgctggccgctgtgacccggctgctgatcctggccgacatgattgatgtgatgtgcctgctgcagcacgtgtctgccttccagaggacctttgagagcctgaagaatgtggccaacaagagtgacctgcagaagacctaccagaagctgggcaaggagctggagaacctggactacctggccttcaagaggcagcagtag

SEQ ID NO: 146454 - DNA, 705 bp, Artificial Sequence
  Description of Artificial Sequence: Synthetic coding sequence
atgacccagctgcctgaggccgagaaggagaagattgctgagcaggtggccgacttcaagaaggtgaagagcaagctggatgctgagattgagatctgggatgacaccagcaatgacatcatcgtgctggccaagaacatgtgcatgatcatgatggagatgacagacttcacccggggcaagggccccctgaagcacaccacagatgtgatctatgctgccaagatgatcagcgagagcggcagcaggatggatgtgctggcccggcagatcgccaaccagtgcccagaccccagctgcaagcaggacctgctggcctacctggagcagatcaagttctacagccaccagctgaagatctgcagccaggtgaaggccgagatccagaacctgggcggggagctgatcatgtctgccctggacagcgtgaccagcctcatccaggccgccaagaacctgatgaatgctgtggtgcagacagtgaagatgagctacatcgccagcaccaagatcatccgcatccagagccctgctggccccaggcaccctgtggtgatgtggaggatgaaggccccagccaagaagcccctcatcaagcgggagaagccagaggagacctgtgccgctgtgagaagaggcagcgccaagaagaagatccaccccctgcaggtgatgtctgagttccggggccggcagatctactag

SEQ ID NO: 146455 - DNA, 2688 bp, Artificial Sequence
  Description of Artificial Sequence: Synthetic coding sequence
atgtctgctgagacccccatcaccctgaacatcgacccccaggacctgcaggtgcagaccttcaccgtggagaagctgctggagcccctcatcatccaggtgaccaccctggtgaactgcccccagaaccccagcagcaggaagaagggccgcagcaagagggcctctgtgctgctggcctctgtggaggaggccacctggaacctgctggacaagggggagaagatcgcccaggaggccaccgtgctgaaggatgagctgacagccagcctggaggaggtgaggaaggagagcgaggccctgaaggtgtctgctgagcgcttcacagatgacccctgcttcctgcccaagcgggaggccgtggtgcaggccgcccgggccctgctggccgctgtgacccggctgctgatcctggccgacatgattgatgtgatgtgcctgctgcagcacgtgtctgccttccagaggacctttgagagcctgaagaatgtggccaacaagagtgacctgcagaagacctaccagaagctgggcaaggagctggagaacctggactacctggccttcaagaggcagcaggacctgaagagccccaaccagagagatgaaattgctggggcccgggccagcctgaaggagaacagccccctgctgcacagcatctgcagcgcctgcctggagcacagtgatgtggccagcctgaaggccagcaaggacacagtgtgtgaggagatccagaatgccctgaatgtcatcagcaatgccagccagggcatccagaacatgaccaccccacctgagccccaggccgccaccctgggcagcgccctggatgagctggagaacctgattgtgctgaaccccctgactgtgacagaggaggagatccggcccagcctggagaagaggctggaggccatcatctctggagctgccctgctggccgacagcagctgcacccgggacctgcaccgggagcgcatcatcgcagaatgtaatgccatccggcaggccctgcaggacctgctgtctgagtacatgaacaatgctgggaagaaggagaggagcaacaccctgaacatcgccctggacaacatgtgcaagaagacccgggacctgcggcggcagctgaggaaggccatcatcgaccacgtgtctgacagcttcctggacaccaccgtgcccctgctggtgctgattgaggccgccaagaatggccgggagaaggagatcaaggagtatgctgccatcttccacgagcacaccagccggctggtggaggtggccaacctggcctgcagcatgagcaccaatgaagatggcatcaagatcgtgaagattgctgccaaccacctggagaccctgtgcccccagatcatcaatgctgccctggccctggccgcccggcccaagagccaggccgtgaagaacaccatggagatgtacaagaggacctgggagaaccacatccacgtgctgacagaggccgtggatgacatcaccagcattgatgacttcctggccgtgtctgagagccacatcctggaggatgtgaacaagtgcatcatcgccctgcgggaccaggatgctgacaacctggacagagctgctggggccatccggggccgggccgcccgggtggcccacatcgtgactggagagatggacagctatgagcccggggcctacacagagggcgtgatgagaaatgtgaacttcctgaccagcaccgtcatccctgagtttgtgacccaggtgaatgtggccctggaggccctgagcaagagcagcctgaatgtgctggatgacaaccagtttgtggacatcagcaagaagatctatgacaccatccatgacatccgctgcagcgtgatgatgatccgcaccccagaggagctggaggatgtgtctgacctggaggaggagcacgaggtgcgcagccacaccagcatccagacagagggcaagacagaccgggccaagatgacccagctgcctgaggccgagaaggagaagattgctgagcaggtggccgacttcaagaaggtgaagagcaagctggatgctgagattgagatctgggatgacaccagcaatgacatcatcgtgctggccaagaacatgtgcatgatcatgatggagatgacagacttcacccggggcaagggccccctgaagcacaccacagatgtgatctatgctgccaagatgatcagcgagagcggcagcaggatggatgtgctggcccggcagatcgccaaccagtgcccagaccccagctgcaagcaggacctgctggcctacctggagcagatcaagttctacagccaccagctgaagatctgcagccaggtgaaggccgagatccagaacctgggcggggagctgatcatgtctgccctggacagcgtgaccagcctcatccaggccgccaagaacctgatgaatgctgtggtgcagacagtgaagatgagctacatcgccagcaccaagatcatccgcatccagagccctgctggccccaggcaccctgtggtgatgtggaggatgaaggccccagccaagaagcccctcatcaagcgggagaagccagaggagacctgtgccgctgtgcggcggggcagcgccaagaagaagatccaccccctgcaggtgatgtctgagttccggggccggcagatctactag

SEQ ID NO: 146456 - DNA, 2688 bp, Artificial Sequence; identical to SEQ ID NO: 146455
  Description of Artificial Sequence: Synthetic coding sequence

SEQ ID NO: 146457 - DNA, 1131 bp, Artificial Sequence
  Description of Artificial Sequence: Synthetic coding sequence
atgtctgctgagacccccatcaccctgaacatcgacccccaggacctgcaggtgcagaccttcaccgtggagaagctgctggagcccctcatcatccaggtgaccaccctggtgaactgcccccagaaccccagcagcaggaagaagggccgcagcaagagggcctctgtgctgctggcctctgtggaggaggccacctggaacctgctggacaagggggagaagatcgcccaggaggccaccgtgctgaaggatgagctgacagccagcctggaggaggtgaggaaggagagcgaggccctgaaggtgtctgctgagcgcttcacagatgacccctgcttcctgcccaagcgggaggccgtggtgcaggccgcccgggccctgctggccgctgtgacccggctgctgatcctggccgacatgattgatgtgatgtgcctgctgcagcacgtgtctgccttccagaggacctttgagagcctgaagaatgtggccaacaagagtgacctgcagaagacctaccagaagctgggcaaggagctggagaacctggactacctggccttcaagaggcagcaggacctgaagagccccaaccagagagatgaaattgctggggcccgggccagcctgaaggagaacagccccctgctgcacagcatctgcagcgcctgcctggagcacagtgatgtggccagcctgaaggccagcaaggacacagtgtgtgaggagatccagaatgccctgaatgtcatcagcaatgccagccagggcatccagaacatgaccaccccacctgagccccaggccgccaccctgggcagcgccctggatgagctggagaacctgattgtgctgaaccccctgactgtgacagaggaggagatccggcccagcctggagaagaggctggaggccatcatctctggagctgccctgctggccgacagcagctgcacccgggacctgcaccgggagcgcatcatcgcagaatgtaatgccatccggcaggccctgcaggacctgctgtctgagtacatgaacaacctgtgcaaccagaagagtgacctgggcctgactggagtgaagatcaagctgctggaggagtgcatcatcttctggagcctgtag

SEQ ID NO: 146458 - DNA, 582 bp, Artificial Sequence; identical to SEQ ID NO: 146453
  Description of Artificial Sequence: Synthetic coding sequence

SEQ ID NO: 146459 - DNA, 1131 bp, Artificial Sequence; identical to SEQ ID NO: 146457
  Description of Artificial Sequence: Synthetic coding sequence

SEQ ID NO: 146460 - DNA, 2205 bp, Artificial Sequence
  Description of Artificial Sequence: Synthetic coding sequence
atggccgccagccctggccctgctggggtgggcggggccggggctgtgtatggcagcggcagcagcggctttgccctggacagcggcctggagatcaagaccaggtctgtggagcagaccctgctgcccctggtgtcccagatcaccaccctcatcaaccacaaggacaacaccaagaagagtgacaagaccctgcaggccatccagagggtgggccaggccgtgaacctggccgtgggccgctttgtgaaggtgggggaggccatcgccaatgaaaactgggacctgaaggaggagatcaacatcgcctgcatcgaggccaagcaggccggggagaccatcgccgccctgacagacatcaccaacctgaaccacctggagagtgatggccagatcaccatcttcacagacaagacaggagtcatcaaggccgcccggctgctgctgagctctgtgaccaaggtgctgctgctggccgacagagtggtgatcaagcagatcatcaccagcaggaacaaggtgctggccaccatggagcggctggagaaggtgaacagcttccaggagtttgtgcagatcttcagccagtttggaaatgagatggtggagtttgcccacctgagcggggaccggcagaatgacctgaaggatgagaagaagaaggccaagatggccgccgcccgggctgtgctggagaagtgcaccatgatgctgctgacagccagcaagacctgcctgcggcaccccaactgtgagagcgcccacaagaacaaggagggcgtgtttgacaggatgaaggtggccctggacaaggtgattgaaattgtgacagactgcaagcccaacggggagacagacatcagcagcatcagcatcttcaccggcatcaaggagttcaagatgaacatcgaggccctgcgggagaacctgtacttccagagcaaggagaacctgtctgtgaccctggaggtgatcctggagaggatggaggacttcacagattctgcctacaccagccatgagcaccgggagcgcatcctggagctgagcacccaggccaggatggagctgcagcagctgatctctgtgtggatccaggcccagagcaagaagaccaagagcattgctgaggagctggagctgagcatcctgaagatcagccacagcctgaatgagctgaagaaggagctgcacagcacagccacccagctggccgctgacctgctgaagtaccacgccgaccacgtggtgctgaaggccctgaagctgactggagtggagggcaacctggaggccctggccgagtatgcctgcaagctgtctgagcagaaggagcagctggtggagacctgccgcctgctgcggcacatcagcggcacagagcccctggagatcacctgcatccacgccgaggagaccttccaggtgacaggccagcagatcatctctgctgctgagaccctgaccctgcaccccagcagcaagatcgccaaggagaacctggatgtgttctgtgaggcctgggagagccagatcagtgacatgagcaccctgctgcgggagatcaatgatgtgtttgagggcagaagaggagagaagtatggctacctgagcctgcccaagcccatgaagaacaatgccaacctgaagagcctgaagccagacaagccagattctgaggagcaggccaagatcgccaagctgggcctgaagctgggcctgctgaccagtgatgctgactgtgaaattgagaagtgggaggaccaggagaatgaaattgtgcagtatggcaggaacatgagctccatggcctacagcctgtacctgttcaccagaggagagggccccctgaagaccagccaggacctgatccaccagctggaggtgtttgctgctgagggcctgaagctgaccagctctgtgcaggccttcagcaagcagctgaaggatgatgacaagctgatgctgctgctggagatcaacaagctgatccccctgtgccaccagctgcagacagtgaccaagaccagcctgcagaacaaggtgttcctgaaggtggacaagtgcatcaccaagaccaggtccatgatggccctgctggtgcagctgctgagcctgtgctacaagctgctgaagaagctgcagatggagaacaacggctgggtgtctgtgaccaacaaggacaccatggacagcaagacctag

SEQ ID NO: 146461 - DNA, 1953 bp, Artificial Sequence
  Description of Artificial Sequence: Synthetic coding sequence
atggccgccagccctggccctgctggggtgggcggggccggggctgtgtatggcagcggcagcagcggctttgccctggacagcggcctggagatcaagaccaggtctgtggagcagaccctgctgcccctggtgtcccagatcaccaccctcatcaaccacaaggacaacaccaagaagagtgacaagaccctgcaggccatccagagggtgggccaggccgtgaacctggccgtgggccgctttgtgaaggtgggggaggccatcgccaatgaaaactgggacctgaaggaggagatcaacatcgcctgcatcgaggccaagcaggccggggagaccatcgccgccctgacagacatcaccaacctgaaccacctggagagtgatggccagatcaccatcttcacagacaagacaggagtcatcaaggccgcccggctgctgctgagctctgtgaccaaggtgctgctgctggccgacagagtggtgatcaagcagatcatcaccagcaggaacaaggtgctggccaccatggagcggctggagaaggtgaacagcttccaggagtttgtgcagatcttcagccagtttggaaatgagatggtggagtttgcccacctgagcggggaccggcagaatgacctgaaggatgagaagaagaaggccaagatggccgccgcccgggctgtgctggagaagtgcaccatgatgctgctgacagccagcaagacctgcctgcggcaccccaactgtgagagcgcccacaagaacaaggagggcgtgtttgacaggatgaaggtggccctggacaaggtgattgaaattgtgacagactgcaagcccaacggggagacagacatcagcagcatcagcatcttcaccggcatcaaggagttcaagatgaacatcgaggccctgcgggagaacctgtacttccagagcaaggagaacctgtctgtgaccctggaggtgatcctggagaggatggaggacttcacagattctgcctacaccagccatgagcaccgggagcgcatcctggagctgagcacccaggccaggatggagctgcagcagctgatctctgtgtggatccaggcccagagcaagaagaccaagagcattgctgaggagctggagctgagcatcctgaagatcagccacagcctgaatgagctgaagaaggagatcatctctgctgctgagaccctgaccctgcaccccagcagcaagatcgccaaggagaacctggatgtgttctgtgaggcctgggagagccagatcagtgacatgagcaccctgctgcgggagatcaatgatgtgtttgagggcagaagaggagagaagtatggctacctgagcctgcccaagcccatgaagaacaatgccaacctgaagagcctgaagccagacaagccagattctgaggagcaggccaagatcgccaagctgggcctgaagctgggcctgctgaccagtgatgctgactgtgaaattgagaagtgggaggaccaggagaatgaaattgtgcagtatggcaggaacatgagctccatggcctacagcctgtacctgttcaccagaggagagggccccctgaagaccagccaggacctgatccaccagctggaggtgtttgctgctgagggcctgaagctgaccagctctgtgcaggccttcagcaagcagctgaaggatgatgacaagctgatgctgctgctggagatcaacaagctgatccccctgtgccaccagctgcagacagtgaccaagaccagcctgcagaacaaggtgttcctgaaggtggacaagtgcatcaccaagaccaggtccatgatggccctgctggtgcagctgctgagcctgtgctacaagctgctgaagaagctgcagatggagaacaacggctgggtgtctgtgaccaacaaggacaccatggacagcaagacctag

SEQ ID NO: 146462 - DNA, 552 bp, Artificial Sequence
  Description of Artificial Sequence: Synthetic coding sequence
atggccgccagccctggccctgctggggtgggcggggccggggctgtgtatggcagcggcagcagcggctttgccctggacagcggcctggagatcaagaccaggtctgtggagcagaccctgctgcccctggtgtcccagatcaccaccctcatcaaccacaaggacaacaccaagaagagtgacaagaccctgcaggccatccagagggtgggccaggccgtgaacctggccgtgggccgctttgtgaaggtgggggaggccatcgccaatgaaaactgggacctgaaggaggagatcaacatcgcctgcatcgaggccaagcaggccggggagaccatcgccgccctgacagacatcaccaacctgaaccacctggagagtgatggccagatcaccatcttcacagacaagacaggagtcatcaaggccgcccggctgctgctgagctctgtgaccaaggtgctgctgctggccgacagagtggtgatcaagcagatcatcaccagcaggaacaagaggctgaccatctacaacctgcggcacagctag

SEQ ID NO: 146463 - DNA, 408 bp, Artificial Sequence
  Description of Artificial Sequence: Synthetic coding sequence
atgagctccatggcctacagcctgtacctgttcaccagaggagagggccccctgaagaccagccaggacctgatccaccagctggaggtgtttgctgctgagggcctgaagctgaccagctctgtgcaggccttcagcaagcagctgaaggatgatgacaagctgatgctgctgctggagatcaacaagctgatccccctgtgccaccagctgcagacagtgaccaagaccagcctgcagaacaaggtgttcctgaaggtggacaagtgcatcaccaagaccaggtccatgatggccctgctggtgcagctgctgagcctgtgctacaagctgctgaagaagctgcagatggagaacaacggctgggtgtctgtgaccaacaaggacaccatggacagcaagacctag

SEQ ID NO: 146464 - DNA, 2157 bp, Artificial Sequence
  Description of Artificial Sequence: Synthetic coding sequence
atggccgccagccctggccctgctggggtgggcggggccggggctgtgtatggcagcggcagcagcggctttgccctggacagcggcctggagatcaagaccaggtctgtggagcagaccctgctgcccctggtgtcccagatcaccaccctcatcaaccacaaggacaacaccaagaagagtgacaagaccctgcaggccatccagagggtgggccaggccgtgaacctggccgtgggccgctttgtgaaggtgggggaggccatcgccaatgaaaactgggacctgaaggaggagatcaacatcgcctgcatcgaggccaagcaggccggggagaccatcgccgccctgacagacatcaccaacctgaaccacctggagagtgatggccagatcaccatcttcacagacaagacaggagtcatcaaggccgcccggctgctgctgagctctgtgaccaaggtgctgctgctggccgacagagtggtgatcaagcagatcatcaccagcaggaacaaggtgctggccaccatggagcggctggagaaggtgaacagcttccaggagtttgtgcagatcttcagccagtttggaaatgagatggtggagtttgcccacctgagcggggaccggcagaatgacctgaaggatgagaagaagaaggccaagatggccgccgcccgggctgtgctggagaagtgcaccatgatgctgctgacagccagcaagacctgcctgcggcaccccaactgtgagagcgcccacaagaacaaggagggcgtgtttgacaggatgaaggtggccctggacaaggtgattgaaattgtgacagactgcaagcccaacggggagacagacatcagcagcatcagcatcttcaccggcatcaaggagttcaagatgaacatcgaggccctgcgggagaacctgtacttccagagcaaggagaacctgtctgtgaccctggaggtgatcctggagaggatggaggacttcacagattctgcctacaccagccatgagcaccgggagcgcatcctggagctgagcacccaggccaggatggagctgcagcagctgatctctgtgtggatccaggcccagagcaagaagaccaagagcattgctgaggagctggagctgagcatcctgaagatcagccacagcctgaatgagctgaagaaggagctgcacagcacagccacccagctggccgctgacctgctgaagtaccacgccgaccacgtggtgctgaaggccctgaagctgactggagtggagggcaacctggaggccctggccgagtatgcctgcaagctgtctgagcagaaggagcagctggtggagacctgccgcctgctgcggcacatcagcggcacagagcccctggagatcacctgcatccacgccgaggagaccttccaggtgacaggccagcagatcatctctgctgctgagaccctgaccctgcaccccagcagcaagatcgccaaggagaacctggatgtgttctgtgaggcctgggagagccagatcagtgacatgagcaccctgctgcgggagatcaatgatgtgtttgagggcagaagaggagagaagtatggctacctgagcctgcccaagcccatgaagaacaatgccaacctgaagagcctgaagccagacaagccagattctgaggagcaggccaagatcgccaagctgggcctgaagctgggcctgctgaccagtgatgctgactgtgaaattgagaagtgggaggaccaggagaatgaaattgtgcagtatggcaggaacatgagctccatggcctacagcctgtacctgttcaccagaggagagggccccctgaagaccagccaggacctgatccaccagctggaggtgtttgctgctgagggcctgaagctgaccagctctgtgcaggccttcagcaagcagctgaaggatgatgacaagctgatgctgctgctggagatcaacaagctgatccccctgtgccaccagctgcagacagtgaccaagaccagcctgcagaacaaggtgttcctgaaggtggacaagtgcatcaccaagaccaggtccatgatggccctgctggtgcagctgctgagcctgtgctacaagctgctgaagaagtctgagacccgctactag

SEQ ID NO: 146465 - DNA, 2802 bp, Artificial Sequence
  Description of Artificial Sequence: Synthetic coding sequence
atggatgacagcgaggtggagagcacagccagcatcctggcctctgtgaaggagcaggaggcccagtttgagaagctgacccgggccctggaggaggagcggcggcacgtgtctgcccagctggagcgggtgcgggtgagcccccaggatgccaaccccctgatggccaacggcaccctgacccggcggcaccagaatggccgctttgtgggagatgctgacctggagcggcagaagttcagtgacctgaagctgaatggcccccaggaccacagccacctgctgtacagcaccatccccaggatgcaggagcccggccagatcgtggagacctacacagaagaagatcctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgaccagaattgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagcccggaggacaggcacccccagcgacccccggcggcggctgcggagctatgaggacatgattggagaggaggtgcccagcgaccagtactactgggcccccctggcccagcacgagcggggcagcctggccagcctggacagcctgaggaaaggaggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaagtcatcatcccccacagcggctgggagcgggagcccaatgaagactgcaagcccaggcacatcgagtgggagagcgtgctgaccaacacagctggctgcctgagaaatgtgtcctctgagaggtctgaggcccggaggaagctgcgggagtgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgcccccaacgtggccaacaacacaggcccccatgctgccagctgctttggagccaagaagggcaagggcaagaagcccattgaagatcctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgaacatgagcgggtggtgaaggccgccagcggggccctgaggaacctggccgtggatgccaggaacaaggagctgattggcaagcacgccatccccaacctggtgaagaacctgcccggcggccagcagaacagctcctggaacttcagcgaggacaccgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggccgccgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcagaagatctag

SEQ ID NO: 146466 - DNA, 2844 bp, Artificial Sequence
  Description of Artificial Sequence: Synthetic coding sequence
atggatgacagcgaggtggagagcacagccagcatcctggcctctgtgaaggagcaggaggcccagtttgagaagctgacccgggccctggaggaggagcggcggcacgtgtctgcccagctggagcgggtgcgggtgagcccccaggatgccaaccccctgatggccaacggcaccctgacccggcggcaccagaatggccgctttgtgggagatgctgacctggagcggcagaagttcagtgacctgaagctgaatggcccccaggaccacagccacctgctgtacagcaccatccccaggatgcaggagcccggccagatcgtggagacctacacagaagaagatcctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgaccagaattgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagcccggaggacaggcacccccagcgacccccggcggcggctgcggagctatgaggacatgattggagaggaggtgcccagcgaccagtactactgggcccccctggcccagcacgagcggggcagcctggccagcctggacagcctgaggaaaggaggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaagtcatcatcccccacagcggctgggagcgggagcccaatgaagactgcaagcccaggcacatcgagtgggagagcgtgctgaccaacacagctggctgcctgagaaatgtgtcctctgagaggtctgaggcccggaggaagctgcgggagtgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgcccccaacgtggccaacaacacaggcccccatgctgccagctgctttggagccaagaagggcaaggatgagtggttcagccggggcaagaagcccattgaagatcctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgaacatgagcgggtggtgaaggccgccagcggggccctgaggaacctggccgtggatgccaggaacaaggagctgattggcaagcacgccatccccaacctggtgaagaacctgcccggcggccagcagaacagctcctggaacttcagcgaggacaccgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggccgccgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaacaactacagcaccccaaatgaaagaggagaccacaacagaaccctggacagaagtggggacctgggggacatggagcccctgaagggcaccacccccctgatgcaggatgagggccaggagagcctggaggaggagctggatgtgctggtgctggatgatgagggcggccaggtgtcctaccccagcatgcagaagatctag

SEQ ID NO: 146467 - DNA, 2889 bp, Artificial Sequence
  Description of Artificial Sequence: Synthetic coding sequence
atggatgacagcgaggtggagagcacagccagcatcctggcctctgtgaaggagcaggaggcccagtttgagaagctgacccgggccctggaggaggagcggcggcacgtgtctgcccagctggagcgggtgcgggtgagcccccaggatgccaaccccctgatggccaacggcaccctgacccggcggcaccagaatggccgctttgtgggagatgctgacctggagcggcagaagttcagtgacctgaagctgaatggcccccaggaccacagccacctgctgtacagcaccatccccaggatgcaggagcccggccagatcgtggagacctacacagaagaagatcctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgaccagaattgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagcccggaggacaggcacccccagcgacccccggcggcggctgcggagctatgaggacatgattggagaggaggtgcccagcgaccagtactactgggcccccctggcccagcacgagcggggcagcctggccagcctggacagcctgaggaaaggaggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaagtcatcatcccccacagcggctgggagcgggagcccaatgaagactgcaagcccaggcacatcgagtgggagagcgtgctgaccaacacagctggctgcctgagaaatgtgtcctctgagaggtctgaggcccggaggaagctgcgggagtgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgcccccaacgtggccaacaacacaggcccccatgctgccagctgctttggagccaagaagggcaagggcaagaagcccattgaagatcctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgaacatgagcgggtggtgaaggccgccagcggggccctgaggaacctggccgtggatgccaggaacaaggagctgattggcaagcacgccatccccaacctggtgaagaacctgcccggcggccagcagaacagctcctggaacttcagcgaggacaccgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggccgccgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcaggatgagggccaggagagcctggaggaggagctggatgtgctggtgctggatgatgaaggaggccaggtgtcctaccccagcatgcagaagatctag

SEQ ID NO: 146468 - DNA, 2826 bp, Artificial Sequence
  Description of Artificial Sequence: Synthetic coding sequence
atggatgacagcgaggtggagagcacagccagcatcctggcctctgtgaaggagcaggaggcccagtttgagaagctgacccgggccctggaggaggagcggcggcacgtgtctgcccagctggagcgggtgcgggtgagcccccaggatgccaaccccctgatggccaacggcaccctgacccggcggcaccagaatggccgctttgtgggagatgctgacctggagcggcagaagttcagtgacctgaagctgaatggcccccaggaccacagccacctgctgtacagcaccatccccaggatgcaggagcccggccagatcgtggagacctacacagaagaagatcctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgaccagaattgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagcccggaggacaggcacccccagcgacccccggcggcggctgcggagctatgaggacatgattggagaggaggtgcccagcgaccagtactactgggcccccctggcccagcacgagcggggcagcctggccagcctggacagcctgaggaaaggaggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaagtcatcatcccccacagcggctgggagcgggagcccaatgaagactgcaagcccaggcacatcgagtgggagagcgtgctgaccaacacagctggctgcctgagaaatgtgtcctctgagaggtctgaggcccggaggaagctgcgggagtgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgcccccaacgtggccaacaacacaggcccccatgctgccagctgctttggagccaagaagggcaagggcaagaagcccattgaagatcctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgaacatgagcgggtggtgaaggccgccagcggggccctgaggaacctggccgtggatgccaggaacaaggagctgattggcaagcacgccatccccaacctggtgaagaacctgcccggcggccagcagaacagctcctggaacttcagcgaggacaccgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggccgccgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaacaactacagcaccccaaatgaaagaggagaccacaacagaaccctggacagaagtggggacctgggggacatggagcccctgaagggcaccacccccctgatgcaggatgagggccaggagagcctggaggaggagctggatgtgctggtgctggatgatgagggcggccaggtgtcctaccccagcatgcagaagatctag

SEQ ID NO: 146469 - DNA, 2802 bp, Artificial Sequence; identical to SEQ ID NO: 146465
  Description of Artificial Sequence: Synthetic coding sequence

SEQ ID NO: 146470 - DNA, 2817 bp, Artificial Sequence
  Description of Artificial Sequence: Synthetic coding sequence
atggatgacagcgaggtggagagcacagccagcatcctggcctctgtgaaggagcaggaggcccagtttgagaagctgacccgggccctggaggaggagcggcggcacgtgtctgcccagctggagcgggtgcgggtgagcccccaggatgccaaccccctgatggccaacggcaccctgacccggcggcaccagaatggccgctttgtgggagatgctgacctggagcggcagaagttcagtgacctgaagctgaatggcccccaggaccacagccacctgctgtacagcaccatccccaggatgcaggagcccggccagatcgtggagacctacacagaagaagatcctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgaccagaattgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagcccggaggacaggcacccccagcgacccccggcggcggctgcggagctatgaggacatgattggagaggaggtgcccagcgaccagtactactgggcccccctggcccagcacgagcggggcagcctggccagcctggacagcctgaggaaaggaggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaagtcatcatcccccacagcggctgggagcgggagcccaatgaagactgcaagcccaggcacatcgagtgggagagcgtgctgaccaacacagctggctgcctgagaaatgtgtcctctgagaggtctgaggcccggaggaagctgcgggagtgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgcccccaacgtggccaacaacacaggcccccatgctgccagctgctttggagccaagaagggcaaggatgagtggttcagccggggcaagaagcccattgaagatcctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgaacatgagcgggtggtgaaggccgccagcggggccctgaggaacctggccgtggatgccaggaacaaggagctgattggcaagcacgccatccccaacctggtgaagaacctgcccggcggccagcagaacagctcctggaacttcagcgaggacaccgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggccgccgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgaagatctag

SEQ ID NO: 146471 - DNA, 2907 bp, Artificial Sequence
  Description of Artificial Sequence: Synthetic coding sequence
atggatgacagcgaggtggagagcacagccagcatcctggcctctgtgaaggagcaggaggcccagtttgagaagctgacccgggccctggaggaggagcggcggcacgtgtctgcccagctggagcgggtgcgggtgagcccccaggatgccaaccccctgatggccaacggcaccctgacccggcggcaccagaatggccgctttgtgggagatgctgacctggagcggcagaagttcagtgacctgaagctgaatggcccccaggaccacagccacctgctgtacagcaccatccccaggatgcaggagcccggccagatcgtggagacctacacagaagaagatcctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgaccagaattgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagcccggaggacaggcacccccagcgacccccggcggcggctgcggagctatgaggacatgattggagaggaggtgcccagcgaccagtactactgggcccccctggcccagcacgagcggggcagcctggccagcctggacagcctgaggaaaggaggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaagtcatcatcccccacagcggctgggagcgggagcccaatgaagactgcaagcccaggcacatcgagtgggagagcgtgctgaccaacacagctggctgcctgagaaatgtgtcctctgagaggtctgaggcccggaggaagctgcgggagtgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgcccccaacgtggccaacaacacaggcccccatgctgccagctgctttggagccaagaagggcaaggatgagtggttcagccggggcaagaagcccattgaagatcctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgaacatgagcgggtggtgaaggccgccagcggggccctgaggaacctggccgtggatgccaggaacaaggagctgattggcaagcacgccatccccaacctggtgaagaacctgcccggcggccagcagaacagctcctggaacttcagcgaggacaccgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggccgccgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcaggatgagggccaggagagcctggaggaggagctggatgtgctggtgctggatgatgaaggaggccaggtgtcctaccccagcatgcagaagatctag

SEQ ID NO: 146472 - DNA, 2604 bp, Artificial Sequence
  Description of Artificial Sequence: Synthetic coding sequence
atgcaggagcccggccagatcgtggagacctacacagaggaggaccctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgacccgcatcgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagccaggagaacaggcacccccagcgacccccggcggcggctgcggagctatgaggacatgattggagaggaggtgcccagcgaccagtactactgggcccccctggcccagcacgagcggggcagcctggccagcctggacagcctgaggaagggcggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaggtgatcatcccccacagcggctgggagcgggagcccaatgaagactgcaagcccaggcacatcgagtgggagagcgtgctgaccaacacagctggctgcctgagaaatgtgagcagcgagaggtctgaggcccggaggaagctgagagaatgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgccccaaatgtggccaacaacacaggcccccacgccgccagctgcttcggggccaagaagggcaaggatgagtggttcagccggggcaagaagcccatcgaggaccctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgagcacgagcgggtggtgaaggccgccagcggggccctgaggaacctggccgtggatgccaggaacaaggagctgattggcaagcacgccatccccaacctggtgaagaacctgcccggcggccagcagaacagctcctggaacttctctgaagatactgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggctgctgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcaggatgagggccaggagagcctggaggaggagctggatgtgctggtgctggatgatgagggcggccaggtgtcctaccccagcatgcagaagatctag

SEQ ID NO: 146473 - DNA, 2499 bp, Artificial Sequence
  Description of Artificial Sequence: Synthetic coding sequence
atgcaggagcccggccagatcgtggagacctacacagaggaggaccctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgacccgcatcgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagccaggagaacaggcacccccagcgacccccggcggcggctgcggagctatgaggacatgattggagaggaggtgcccagcgaccagtactactgggcccccctggcccagcacgagcggggcagcctggccagcctggacagcctgaggaagggcggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaggtgatcatcccccacagcggctgggagcgggagcccaatgaagactgcaagcccaggcacatcgagtgggagagcgtgctgaccaacacagctggctgcctgagaaatgtgagcagcgagaggtctgaggcccggaggaagctgagagaatgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgccccaaatgtggccaacaacacaggcccccacgccgccagctgcttcggggccaagaagggcaagggcaagaagcccatcgaggaccctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgagcacgagcgggtggtgaaggccgccagcggggccctgaggaacctggccgtggatgccaggaacaaggagctgattggcaagcacgccatccccaacctggtgaagaacctgcccggcggccagcagaacagctcctggaacttctctgaagatactgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggctgctgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcagaagatctag

SEQ ID NO: 146474 - DNA, 2802 bp, Artificial Sequence; identical to SEQ ID NO: 146465
  Description of Artificial Sequence: Synthetic coding sequence

SEQ ID NO: 146475 - DNA, 15 bp, Artificial Sequence
  Description of Artificial Sequence: Synthetic coding sequence
atggatgacagctag

SEQ ID NO: 146476 - DNA, 2802 bp, Artificial Sequence; identical to SEQ ID NO: 146465
  Description of Artificial Sequence: Synthetic coding sequence

SEQ ID NO: 146477 - DNA, 1851 bp, Artificial Sequence
  Description of Artificial Sequence: Synthetic coding sequence
atgattggagaggaggtgcccagcgaccagtactactgggcccccctggcccagcacgagcggggcagcctggccagcctggacagcctgaggaagggcggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaggtgatcatcccccacagcggctgggagcgggagcccaatgaagactgcaagcccaggcacatcgagtgggagagcgtgctgaccaacacagctggctgcctgagaaatgtgagcagcgagaggtctgaggcccggaggaagctgagagaatgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgccccaaatgtggccaacaacacaggcccccacgccgccagctgcttcggggccaagaagggcaaggatgagtggttcagccggggcaagaagcccatcgaggaccctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgagcacgagcgggtggtgaaggccgccagcggggccctgaggaacctggccgtggatgccaggaacaaggagctgattggcaagcacgccatccccaacctggtgaagaacctgcccggcggccagcagaacagctcctggaacttctctgaagatactgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggctgctgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcagaagatctag

SEQ ID NO: 146478 - DNA, 2727 bp, Artificial Sequence
  Description of Artificial Sequence: Synthetic coding sequence
atggccaacggcaccctgacccggcggcaccagaatggccgctttgtgggagatgctgacctggagcggcagaagttcagtgacctgaagctgaatggcccccaggaccacagccacctgctgtacagcaccatccccaggatgcaggagcccggccagatcgtggagacctacacagaagaagatcctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgaccagaattgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagcccggaggacaggcacccccagcgacccccggcggcggctgcggagctatgaggacatgattggagaggaggtgcccagcgaccagtactactgggcccccctggcccagcacgagcggggcagcctggccagcctggacagcctgaggaaaggaggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaagtcatcatcccccacagcggctgggagcgggagcccaatgaagactgcaagcccaggcacatcgagtgggagagcgtgctgaccaacacagctggctgcctgagaaatgtgtcctctgagaggtctgaggcccggaggaagctgcgggagtgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgcccccaacgtggccaacaacacaggcccccatgctgccagctgctttggagccaagaagggcaagggcaagaagcccattgaagatcctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgaacatgagcgggtggtgaaggccgccagcggggccctgaggaacctggccgtggatgccaggaacaaggagctgattggcaagcacgccatccccaacctggtgaagaacctgcccggcggccagcagaacagctcctggaacttcagcgaggacaccgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggccgccgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcaggatgagggccaggagagcctggaggaggagctggatgtgctggtgctggatgatgaaggaggccaggtgtcctaccccagcatgcagaagatctag

SEQ ID NO: 146479 - DNA, 1833 bp, Artificial Sequence
  Description of Artificial Sequence: Synthetic coding sequence
atgattggagaggaggtgcccagcgaccagtactactgggcccccctggcccagcacgagcggggcagcctggccagcctggacagcctgaggaagggcggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaggtgatcatcccccacagcggctgggagcgggagcccaatgaagactgcaagcccaggcacatcgagtgggagagcgtgctgaccaacacagctggctgcctgagaaatgtgagcagcgagaggtctgaggcccggaggaagctgagagaatgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgccccaaatgtggccaacaacacaggcccccacgccgccagctgcttcggggccaagaagggcaagggcaagaagcccatcgaggaccctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgagcacgagcgggtggtgaaggccgccagcggggccctgaggaacctggccgtggatgccaggaacaaggagctgattggcaagcacgccatccccaacctggtgaagaacctgcccggcggccagcagaacagctcctggaacttctctgaagatactgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggctgctgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcagaagatctag

SEQ ID NO: 146480 - DNA, 1938 bp, Artificial Sequence
  Description of Artificial Sequence: Synthetic coding sequence
atgattggagaggaggtgcccagcgaccagtactactgggcccccctggcccagcacgagcggggcagcctggccagcctggacagcctgaggaagggcggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaggtgatcatcccccacagcggctgggagcgggagcccaatgaagactgcaagcccaggcacatcgagtgggagagcgtgctgaccaacacagctggctgcctgagaaatgtgagcagcgagaggtctgaggcccggaggaagctgagagaatgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgccccaaatgtggccaacaacacaggcccccacgccgccagctgcttcggggccaagaagggcaaggatgagtggttcagccggggcaagaagcccatcgaggaccctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgagcacgagcgggtggtgaaggccgccagcggggccctgaggaacctggccgtggatgccaggaacaaggagctgattggcaagcacgccatccccaacctggtgaagaacctgcccggcggccagcagaacagctcctggaacttctctgaagatactgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggctgctgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcaggatgagggccaggagagcctggaggaggagctggatgtgctggtgctggatgatgagggcggccaggtgtcctaccccagcatgcagaagatctag

SEQ ID NO: 146481 - DNA, 2517 bp, Artificial Sequence
  Description of Artificial Sequence: Synthetic coding sequence
atgcaggagcccggccagatcgtggagacctacacagaggaggaccctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgacccgcatcgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagccaggagaacaggcacccccagcgacccccggcggcggctgcggagctatgaggacatgattggagaggaggtgcccagcgaccagtactactgggcccccctggcccagcacgagcggggcagcctggccagcctggacagcctgaggaagggcggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaggtgatcatcccccacagcggctgggagcgggagcccaatgaagactgcaagcccaggcacatcgagtgggagagcgtgctgaccaacacagctggctgcctgagaaatgtgagcagcgagaggtctgaggcccggaggaagctgagagaatgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgccccaaatgtggccaacaacacaggcccccacgccgccagctgcttcggggccaagaagggcaaggatgagtggttcagccggggcaagaagcccatcgaggaccctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgagcacgagcgggtggtgaaggccgccagcggggccctgaggaacctggccgtggatgccaggaacaaggagctgattggcaagcacgccatccccaacctggtgaagaacctgcccggcggccagcagaacagctcctggaacttctctgaagatactgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggctgctgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcagaagatctag

SEQ ID NO: 146482 - DNA, 2640 bp, Artificial Sequence
  Description of Artificial Sequence: Synthetic coding sequence
atggccaacggcaccctgacccggcggcaccagaatggccgctttgtgggagatgctgacctggagcggcagaagttcagtgacctgaagctgaatggcccccaggaccacagccacctgctgtacagcaccatccccaggatgcaggagcccggccagatcgtggagacctacacagaagaagatcctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgaccagaattgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagcccggaggacaggcacccccagcgacccccggcggcggctgcggagctatgaggacatgattggagaggaggtgcccagcgaccagtactactgggcccccctggcccagcacgagcggggcagcctggccagcctggacagcctgaggaaaggaggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaagtcatcatcccccacagcggctgggagcgggagcccaatgaagactgcaagcccaggcacatcgagtgggagagcgtgctgaccaacacagctggctgcctgagaaatgtgtcctctgagaggtctgaggcccggaggaagctgcgggagtgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgcccccaacgtggccaacaacacaggcccccatgctgccagctgctttggagccaagaagggcaagggcaagaagcccattgaagatcctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgaacatgagcgggtggtgaaggccgccagcggggccctgaggaacctggccgtggatgccaggaacaaggagctgattggcaagcacgccatccccaacctggtgaagaacctgcccggcggccagcagaacagctcctggaacttcagcgaggacaccgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggccgccgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcagaagatctag

SEQ ID NO: 146483 - DNA, 2640 bp, Artificial Sequence; identical to SEQ ID NO: 146482
  Description of Artificial Sequence: Synthetic coding sequence

SEQ ID NO: 146484 - DNA, 2499 bp, Artificial Sequence; identical to SEQ ID NO: 146473
  Description of Artificial Sequence: Synthetic coding sequence

SEQ ID NO: 146485 - DNA, 390 bp, Artificial Sequence
  Description of Artificial Sequence: Synthetic coding sequence
atggccaacggcaccctgacccggcggcaccagaatggccgctttgtgggagatgctgacctggagcggcagaagttcagtgacctgaagctgaatggcccccaggaccacagccacctgctgtacagcaccatccccaggatgcaggagcccggccagatcgtggagacctacacagaagaagatcctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcagatag

SEQ ID NO: 146486 - DNA, 2586 bp, Artificial Sequence
  Description of Artificial Sequence: Synthetic coding sequence
atgcaggagcccggccagatcgtggagacctacacagaggaggaccctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgacccgcatcgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagccaggagaacaggcacccccagcgacccccggcggcggctgcggagctatgaggacatgattggagaggaggtgcccagcgaccagtactactgggcccccctggcccagcacgagcggggcagcctggccagcctggacagcctgaggaagggcggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaggtgatcatcccccacagcggctgggagcgggagcccaatgaagactgcaagcccaggcacatcgagtgggagagcgtgctgaccaacacagctggctgcctgagaaatgtgagcagcgagaggtctgaggcccggaggaagctgagagaatgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgccccaaatgtggccaacaacacaggcccccacgccgccagctgcttcggggccaagaagggcaagggcaagaagcccatcgaggaccctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgagcacgagcgggtggtgaaggccgccagcggggccctgaggaacctggccgtggatgccaggaacaaggagctgattggcaagcacgccatccccaacctggtgaagaacctgcccggcggccagcagaacagctcctggaacttctctgaagatactgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggctgctgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcaggatgagggccaggagagcctggaggaggagctggatgtgctggtgctggatgatgagggcggccaggtgtcctaccccagcatgcagaagatctag

SEQ ID NO: 146487 - DNA, 2658 bp, Artificial Sequence
  Description of Artificial Sequence: Synthetic coding sequence
atggccaacggcaccctgacccggcggcaccagaatggccgctttgtgggagatgctgacctggagcggcagaagttcagtgacctgaagctgaatggcccccaggaccacagccacctgctgtacagcaccatccccaggatgcaggagcccggccagatcgtggagacctacacagaagaagatcctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgaccagaattgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagcccggaggacaggcacccccagcgacccccggcggcggctgcggagctatgaggacatgattggagaggaggtgcccagcgaccagtactactgggcccccctggcccagcacgagcggggcagcctggccagcctggacagcctgaggaaaggaggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaagtcatcatcccccacagcggctgggagcgggagcccaatgaagactgcaagcccaggcacatcgagtgggagagcgtgctgaccaacacagctggctgcctgagaaatgtgtcctctgagaggtctgaggcccggaggaagctgcgggagtgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgcccccaacgtggccaacaacacaggcccccatgctgccagctgctttggagccaagaagggcaaggatgagtggttcagccggggcaagaagcccattgaagatcctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgaacatgagcgggtggtgaaggccgccagcggggccctgaggaacctggccgtggatgccaggaacaaggagctgattggcaagcacgccatccccaacctggtgaagaacctgcccggcggccagcagaacagctcctggaacttcagcgaggacaccgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggccgccgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcagaagatctag

SEQ ID NO: 146488 - DNA, 1920 bp, Artificial Sequence
  Description of Artificial Sequence: Synthetic coding sequence
atgattggagaggaggtgcccagcgaccagtactactgggcccccctggcccagcacgagcggggcagcctggccagcctggacagcctgaggaagggcggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaggtgatcatcccccacagcggctgggagcgggagcccaatgaagactgcaagcccaggcacatcgagtgggagagcgtgctgaccaacacagctggctgcctgagaaatgtgagcagcgagaggtctgaggcccggaggaagctgagagaatgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgccccaaatgtggccaacaacacaggcccccacgccgccagctgcttcggggccaagaagggcaagggcaagaagcccatcgaggaccctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgagcacgagcgggtggtgaaggccgccagcggggccctgaggaacctggccgtggatgccaggaacaaggagctgattggcaagcacgccatccccaacctggtgaagaacctgcccggcggccagcagaacagctcctggaacttctctgaagatactgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggctgctgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcaggatgagggccaggagagcctggaggaggagctggatgtgctggtgctggatgatgagggcggccaggtgtcctaccccagcatgcagaagatctag

SEQ ID NO: 146489 - DNA, 2499 bp, Artificial Sequence; identical to SEQ ID NO: 146473
  Description of Artificial Sequence: Synthetic coding sequence

SEQ ID NO: 146490 - DNA, 2499 bp, Artificial Sequence; identical to SEQ ID NO: 146473
  Description of Artificial Sequence: Synthetic coding sequence

SEQ ID NO: 146491 - DNA, 2640 bp, Artificial Sequence; identical to SEQ ID NO: 146482
  Description of Artificial Sequence: Synthetic coding sequence

SEQ ID NO: 146492 - DNA, 2523 bp, Artificial Sequence
  Description of Artificial Sequence: Synthetic coding sequence
atgcaggagcccggccagatcgtggagacctacacagaggaggaccctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgacccgcatcgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagccaggagaacaggcacccccagcgacccccggcggcggctgcggagctatgaggacatgattggagaggaggtgcccagcgaccagtactactgggcccccctggcccagcacgagcggggcagcctggccagcctggacagcctgaggaagggcggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaggtgatcatcccccacagcggctgggagcgggagcccaatgaagactgcaagcccaggcacatcgagtgggagagcgtgctgaccaacacagctggctgcctgagaaatgtgagcagcgagaggtctgaggcccggaggaagctgagagaatgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgccccaaatgtggccaacaacacaggcccccacgccgccagctgcttcggggccaagaagggcaagggcaagaagcccatcgaggaccctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgagcacgagcgggtggtgaaggccgccagcggggccctgaggaacctggccgtggatgccaggaacaaggagctgattggcaagcacgccatccccaacctggtgaagaacctgcccggcggccagcagaacagctcctggaacttctctgaagatactgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggctgctgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaacaactacagcaccccaaatgaaagaggagaccacaacagaaccctggacagaagtggggacctgggggacatggagcccctgaagggcaccacccccctgatgcaggatgagggccaggagagcctggaggaggagctggatgtgctggtgctggatgatgaaggaggccaggtgtcctaccccagcatgcagaagatctag

SEQ ID NO: 146493 - DNA, 2745 bp, Artificial Sequence
  Description of Artificial Sequence: Synthetic coding sequence
atggccaacggcaccctgacccggcggcaccagaatggccgctttgtgggagatgctgacctggagcggcagaagttcagtgacctgaagctgaatggcccccaggaccacagccacctgctgtacagcaccatccccaggatgcaggagcccggccagatcgtggagacctacacagaagaagatcctgagggcgccatgtctgtggtgtctgtggagaccagtgatgatggcaccaccaggagaacagagaccaccgtgaagaaggtggtgaagacagtgaccaccaggacagtgcagcctgtggccatgggcccagatggcctgcctgtggatgccagctctgtgagcaacaactacatccagaccctgggccgggacttcaggaagaatggaaatggaggccctggcccctacgtgggccaggccggcacagccaccctgcccaggaacttccactaccccccagatggctacagccgccactatgaagatggctacccaggcggcagtgacaactacggcagcctgagccgggtgaccagaattgaggagcgctaccggcccagcatggagggctaccgggcccccagccggcaggatgtgtatggcccccagccccaggtgcgggtgggcggcagctctgtggacctgcaccgcttccaccctgagccctacggcctggaggatgaccagaggtccatgggctatgatgacctggactatggcatgatgtctgactatggaacagcccggaggacaggcacccccagcgacccccggcggcggctgcggagctatgaggacatgattggagaggaggtgcccagcgaccagtactactgggcccccctggcccagcacgagcggggcagcctggccagcctggacagcctgaggaaaggaggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactgtgatggagtgcctgccctggtgcggctgctgaggaaggcccgggacatggacctgacagaggtgatcaccggcaccctgtggaacctgagcagccatgacagcatcaagatggagatcgtggaccacgccctgcacgccctgacagatgaagtcatcatcccccacagcggctgggagcgggagcccaatgaagactgcaagcccaggcacatcgagtgggagagcgtgctgaccaacacagctggctgcctgagaaatgtgtcctctgagaggtctgaggcccggaggaagctgcgggagtgtgatggcctggtggatgccctgatcttcatcgtgcaggccgagatcggccagaaggacagcgacagcaagctggtggagaactgtgtgtgcctgctgaggaacctgagctaccaggtgcaccgggagatcccccaggccgagcgctaccaggaggccgcccccaacgtggccaacaacacaggcccccatgctgccagctgctttggagccaagaagggcaaggatgagtggttcagccggggcaagaagcccattgaagatcctgccaatgacacagtggacttccccaagaggaccagccctgcccggggctatgagctgctcttccagcctgaggtggtgcgcatctacatcagcctgctgaaggagagcaagaccccagccatcctggaggccagcgctggggccatccagaacctgtgtgccggccgctggacctacggccgctacatccgcagcgccctgcggcaggagaaggccctgagcgccatcgctgacctgctgaccaatgaacatgagcgggtggtgaaggccgccagcggggccctgaggaacctggccgtggatgccaggaacaaggagctgattggcaagcacgccatccccaacctggtgaagaacctgcccggcggccagcagaacagctcctggaacttcagcgaggacaccgtcatcagcatcctgaacaccatcaatgaggtgattgctgagaacctggaggccgccaagaagctgcgggagacccagggcatcgagaagctggtgctgatcaacaagagcggcaacagaagtgagaaggaggtgcgggccgccgccctggtgctgcagaccatctggggctacaaggagctgaggaagcccctggagaaggagggctggaagaagagtgacttccaggtgaacctgaacaatgccagccgcagccagagcagccacagctatgatgacagcaccctgcccctgattgacaggaaccagaagagtgacaagaagccagaccgggaggagatccagatgagcaacatgggcagcaacaccaagagcctggacaacaactacagcaccccaaatgaaagaggagaccacaacagaaccctggacagaagtggggacctgggggacatggagcccctgaagggcaccacccccctgatgcaggatgagggccaggagagcctggaggaggagctggatgtgctggtgctggatgatgaaggaggccaggtgtcctaccccagcatgcagaagatctag

SEQ ID NO: 146494 - DNA, 381 bp, Artificial Sequence
  Description of Artificial Sequence: Synthetic coding sequence
atgattggagaggaggtgcccagcgaccagtactactgggcccccctggcccagcacgagcggggcagcctggccagcctggacagcctgaggaagggcggccccccaccacccaactggaggcagcctgagctgcctgaggtgattgccatgctgggcttccggctggatgctgtgaagagcaatgctgctgcctacctgcagcacctgtgctacagaaatgacaaggtgaagacagatgtgaggaagctgaagggcatccctgtgctggtgggcctgctggaccaccccaagaaggaggtgcacctgggcgcctgtggggccctgaagaacatcagctttggccgggaccaggacaacaagatcgccatcaagaactag

SEQ ID NO: 146495 - DNA, 2640 bp, Artificial Sequence; identical to SEQ ID NO: 146482
  Description of Artificial Sequence: Synthetic coding sequence

SEQ ID NO: 146496 - DNA, 3678 bp, Artificial Sequence
  Description of Artificial Sequence: Synthetic coding sequence
atgtttgccaggaagcccccaggagctgcccccctgggcgccatgcctgtgcctgaccagcccagcagcgccagcgagaagaccagcagcctgagccctggcctgaacaccagcaatggagatggcagcgagacagagaccaccagcgccatcctggcctctgtgaaggagcaggagctgcagtttgagcggctgacccgggagctggaggccgagcggcagatcgtggccagccagctggagcgctgcaagctgggcagcgagaccggctccatgagctccatgagcagcgctgaggagcagttccagtggcagagccaggacggccagaaggacattgaagatgagctgaccaccggcctggagctggtggacagctgcatccgcagcctgcaggagagcggcatcctggacccccaggactacagcactggagagcggcccagcctgctgagccagagcgccctgcagctgaacagcaagccagagggcagcttccagtacccagccagctaccacagcaaccagaccctggccctgggggagaccacccccagccagctgcctgcccggggcacccaggcccgggccaccggccagagcttcagccagggcaccaccagccgggccggccacctggccggccctgagcccgcccctcctcctcctcctccaccccgggagccctttgcccccagcctgggcagcgccttccacctgcctgatgcccccccagctgctgctgctgctgccctgtactacagcagcagcaccctgcctgccccaccccggggcggcagccccctggccgccccccagggcggcagccccaccaagctgcagagaggaggcagcgcccctgagggcgccacctatgctgccccccggggcagcagccccaagcagagccccagccggctggccaagagctacagcaccagcagccccatcaacatcgtggtgtcctctgctggcctgagccccatccgggtgaccagcccccccaccgtgcagagcaccatcagcagcagccccatccaccagctgagcagcaccatcggcacctacgccaccctgagccccaccaagaggctggtgcacgccagcgagcagtacagcaagcacagccaggagctgtatgccacagccaccctgcagaggcctggcagcctggccgccggcagccgggccagctacagcagccagcacggccacctgggccctgagctgcgggccctgcagagccctgagcaccacatcgaccccatctatgaagatagagtgtaccagaagccacccatgaggagcctgagccagagccagggcgaccccctgcccccagcccacacaggcacctaccgcaccagcacagcccccagcagccctggggtggacagcgtgcccctgcagaggacaggcagccagcacggcccccagaatgctgctgctgccaccttccagagggccagctatgctgctggccctgccagcaactatgctgacccctaccggcagctgcagtactgccccagcgtggagagcccctacagcaagagcggccctgccctgcccccagagggcaccctggcccggagccccagcattgacagcatccagaaggacccccgggagtttggctggagggaccctgagctgcctgaggtgatccagatgctgcagcaccagttccccagcgtgcagagcaatgctgctgcctacctgcagcacctgtgctttggagacaacaagatcaaggccgagatccggcggcagggcggcatccagctgctggtggacctgctggaccacaggatgacagaggtgcacaggtctgcctgtggggccctgaggaacctggtgtatggcaaggccaatgatgacaacaagatcgccctgaagaactgtggcggcatcccagccctggtgcggctgctgaggaagaccacagacctggagatccgggagctggtgactggagtgctgtggaacctgagcagctgtgatgccctgaagatgcccatcatccaggatgccctggccgtgctgaccaatgctgtgatcatcccccacagcggctgggagaacagccccctgcaggatgacaggaagatccagctgcacagcagccaggtgctgagaaatgccaccggctgcctgagaaatgtgagcagcgctggggaggaggcccggcggaggatgagagaatgtgatggcctgacagatgccctgctgtatgtgatccagagcgccctgggcagcagcgagattgacagcaagacagtggagaactgtgtgtgcatcctgaggaacctgagctaccgcctggccgctgagaccagccagggccagcacatgggcacagatgagctggatggcctgctgtgtggggaggccaacgggaaggatgctgagagcagcggctgctggggcaagaagaagaagaagaagaagagccaggaccagtgggatggagtgggccccctgcctgactgtgccgagccccccaagggcatccagatgctgtggcaccccagcatcgtgaagccctacctgaccctgctgtctgagtgcagcaacccagacaccctggagggcgctgctggggccctgcagaacctggccgccggctcctggaagtggagcgtgtacatccgggctgctgtgaggaaggagaagggcctgcccatcctggtggagctgctgagaattgacaatgacagagtggtgtgtgctgtggccacagccctgaggaacatggccctggatgtgaggaacaaggagctgattggcaagtatgccatgagggacctggtgcaccggctgcccggcggcaacaacagcaacaacacagccagcaaggccatgtctgatgacacagtgacagctgtgtgctgcaccctgcacgaggtgatcaccaagaacatggagaatgccaaggccctgagagatgctgggggcatcgagaagctggtgggcatcagcaagagcaaaggagacaagcacagccccaaggtggtgaaggccgccagccaggtgctgaacagcatgtggcagtacagagacctgcggagcctgtacaagaaggatggctggagccagtaccactttgtggccagcagcagcaccatcgagcgggaccggcagaggccctacagcagcagcaggacccccagcatcagccctgtgcgggtgagccccaacaacagaagtgccagcgccccagccagcccccgggagatgatcagcctgaaggagaggaagacagattatgaatgtacaggcagcaatgccacctaccacggggccaagggggagcacaccagcaggaaggatgccatgacagcccagaacacaggcatcagcaccctgtacagaaattcctatggagccccagctgaggacatcaagcacaaccaggtgtctgcccagcctgtgccccaggagcccagcaggaaggactatgagacctaccagcccttccagaacagcaccagaaattatgatgagagcttctttgaggaccaggtgcaccaccggcccccagccagcgagtacaccatgcacctgggcctgaagagcacaggcaactacgtggacttctacagcgctgcccggccctacagcgagctgaactatgagaccagccactacccagccagcccagacagctgggtgtag

SEQ ID NO: 146497 - DNA, 3504 bp, Artificial Sequence
  Description of Artificial Sequence: Synthetic coding sequence
atgtttgccaggaagcccccaggagctgcccccctgggcgccatgcctgtgcctgaccagcccagcagcgccagcgagaagaccagcagcctgagccctggcctgaacaccagcaatggagatggcagcgagacagagaccaccagcgccatcctggcctctgtgaaggagcaggagctgcagtttgagcggctgacccgggagctggaggccgagcggcagatcgtggccagccagctggagcgctgcaagctgggcagcgagaccggctccatgagctccatgagcagcgctgaggagcagttccagtggcagagccaggacggccagaaggacattgaagatgagctgaccaccggcctggagctggtggacagctgcatccgcagcctgcaggagagcggcatcctggacccccaggactacagcactggagagcggcccagcctgctgagccagagcgccctgcagctgaacagcaagccagagggcagcttccagtacccagccagctaccacagcaaccagaccctggccctgggggagaccacccccagccagctgcctgcccggggcacccaggcccgggccaccggccagagcttcagccagggcaccaccagccgggccggccacctggccggccctgagcccgcccctcctcctcctcctccaccccgggagccctttgcccccagcctgggcagcgccttccacctgcctgatgcccccccagctgctgctgctgctgccctgtactacagcagcagcaccctgcctgccccaccccggggcggcagccccctggccgccccccagggcggcagccccaccaagctgcagagaggaggcagcgcccctgagggcgccacctatgctgccccccggggcagcagccccaagcagagccccagccggctggccaagagctacagcaccagcagccccatcaacatcgtggtgtcctctgctggcctgagccccatccgggtgaccagcccccccaccgtgcagagcaccatcagcagcagccccatccaccagctgagcagcaccatcggcacctacgccaccctgagccccaccaagaggctggtgcacgccagcgagcagtacagcaagcacagccaggagctgtatgccacagccaccctgcagaggcctggcagcctggccgccggcagccgggccagctacagcagccagcacggccacctgggccctgagctgcgggccctgcagagccctgagcaccacatcgaccccatctatgaagatagagtgtaccagaagccacccatgaggagcctgagccagagccagggcgaccccctgcccccagcccacacaggcacctaccgcaccagcacagcccccagcagccctggggtggacagcgtgcccctgcagaggacaggcagccagcacggcccccagaatgctgctgctgccaccttccagagggccagctatgctgctggccctgccagcaactatgctgacccctaccggcagctgcagtactgccccagcgtggagagcccctacagcaagagcggccctgccctgcccccagagggcaccctggcccggagccccagcattgacagcatccagaaggacccccgggagtttggctggagggaccctgagctgcctgaggtgatccagatgctgcagcaccagttccccagcgtgcagagcaatgctgctgcctacctgcagcacctgtgctttggagacaacaagatcaaggccgagatccggcggcagggcggcatccagctgctggtggacctgctggaccacaggatgacagaggtgcacaggtctgcctgtggggccctgaggaacctggtgtatggcaaggccaatgatgacaacaagatcgccctgaagaactgtggcggcatcccagccctggtgcggctgctgaggaagaccacagacctggagatccgggagctggtgactggagtgctgtggaacctgagcagctgtgatgccctgaagatgcccatcatccaggatgccctggccgtgctgaccaatgctgtgatcatcccccacagcggctgggagaacagccccctgcaggatgacaggaagatccagctgcacagcagccaggtgctgagaaatgccaccggctgcctgagaaatgtgagcagcgctggggaggaggcccggcggaggatgagagaatgtgatggcctgacagatgccctgctgtatgtgatccagagcgccctgggcagcagcgagattgacagcaagacagtggagaactgtgtgtgcatcctgaggaacctgagctaccgcctggccgctgagaccagccagggccagcacatgggcacagatgagctggatggcctgctgtgtggggaggccaacgggaaggatgctgagagcagcggctgctggggcaagaagaagaagaagaagaagagccaggaccagtggagcgtgtacatccgggctgctgtgaggaaggagaagggcctgcccatcctggtggagctgctgagaattgacaatgacagagtggtgtgtgctgtggccacagccctgaggaacatggccctggatgtgaggaacaaggagctgattggcaagtatgccatgagggacctggtgcaccggctgcccggcggcaacaacagcaacaacacagccagcaaggccatgtctgatgacacagtgacagctgtgtgctgcaccctgcacgaggtgatcaccaagaacatggagaatgccaaggccctgagagatgctgggggcatcgagaagctggtgggcatcagcaagagcaaaggagacaagcacagccccaaggtggtgaaggccgccagccaggtgctgaacagcatgtggcagtacagagacctgcggagcctgtacaagaaggatggctggagccagtaccactttgtggccagcagcagcaccatcgagcgggaccggcagaggccctacagcagcagcaggacccccagcatcagccctgtgcgggtgagccccaacaacagaagtgccagcgccccagccagcccccgggagatgatcagcctgaaggagaggaagacagattatgaatgtacaggcagcaatgccacctaccacggggccaagggggagcacaccagcaggaaggatgccatgacagcccagaacacaggcatcagcaccctgtacagaaattcctatggagccccagctgaggacatcaagcacaaccaggtgtctgcccagcctgtgccccaggagcccagcaggaaggactatgagacctaccagcccttccagaacagcaccagaaattatgatgagagcttctttgaggaccaggtgcaccaccggcccccagccagcgagtacaccatgcacctgggcctgaagagcacaggcaactacgtggacttctacagcgctgcccggccctacagcgagctgaactatgagaccagccactacccagccagcccagacagctgggtgtag

SEQ ID NO: 146498 - DNA, 2379 bp, Artificial Sequence
  Description of Artificial Sequence: Synthetic coding sequence
atgaggagcctgagccagagccagggcgaccccctgcccccagcccacacaggcacctaccgcaccagcacagcccccagcagccctggggtggacagcgtgcccctgcagaggacaggcagccagcacggcccccagaatgctgctgctgccaccttccagagggccagctatgctgctggccctgccagcaactatgctgacccctaccggcagctgcagtactgccccagcgtggagagcccctacagcaagagcggccctgccctgcccccagagggcaccctggcccggagccccagcattgacagcatccagaaggacccccgggagtttggctggagggaccctgagctgcctgaggtgatccagatgctgcagcaccagttccccagcgtgcagagcaatgctgctgcctacctgcagcacctgtgcttcggggacaacaagatcaaggccgagatccggcggcagggcggcatccagctgctggtggacctgctggaccacaggatgacagaggtgcacaggtctgcctgtggggccctgaggaacctggtgtatggcaaggccaatgatgacaacaagatcgccctgaagaactgtggcggcatcccagccctggtgcggctgctgaggaagaccacagacctggagatccgggagctggtgactggagtgctgtggaacctgagcagctgtgatgccctgaagatgcccatcatccaggatgccctggccgtgctgaccaatgctgtgatcatcccccacagcggctgggagaacagccccctgcaggatgacaggaagatccagctgcacagcagccaggtgctgagaaatgccaccggctgcctgagaaatgtgtcctctgctggggaggaggcccggcggaggatgagagaatgtgatggcctgacagatgccctgctgtatgtgatccagagcgccctgggcagcagcgagattgacagcaagacagtggagaactgtgtgtgcatcctgaggaacctgagctaccgcctggccgctgagaccagccagggccagcacatgggcacagatgagctggatggcctgctgtgtggggaggccaacgggaaggatgctgagagcagcggctgctggggcaagaagaagaagaagaagaagagccaggaccagtgggatggagtgggccccctgcctgactgtgccgagccccccaagggcatccagatgctgtggcaccccagcatcgtgaagccctacctgaccctgctgtctgaatgtagcaacccagacaccctggagggcgccgccggggccctgcagaacctggccgccggctcctggaagtggagcgtgtacatccgggctgctgtgaggaaggagaagggcctgcccatcctggtggagctgctgagaattgacaatgacagagtggtgtgtgctgtggccacagccctgaggaacatggccctggatgtgaggaacaaggagctgattggcaagtatgccatgagggacctggtgcaccggctgcccggcggcaacaacagcaacaacacagccagcaaggccatgtctgatgacacagtgacagctgtgtgctgcaccctgcatgaagtcatcaccaagaacatggagaatgccaaggccctgagagatgctgggggcatcgagaagctggtgggcatcagcaagagcaagggggacaagcacagccccaaggtggtgaaggccgccagccaggtgctgaacagcatgtggcagtacagagacctgcggagcctgtacaagaaggatggctggagccagtaccactttgtggccagcagcagcaccatcgagcgggaccggcagaggccctacagcagcagcaggacccccagcatcagccctgtgcgggtgagccccaacaacagaagtgccagcgccccagccagcccccgggagatgatcagcctgaaggagaggaagacagattatgagtgcaccggcagcaatgccacctaccatggagccaagggggagcacaccagcaggaaggatgccatgacagcccagaacacaggcatcagcaccctgtacagaaacagctatggagccccagctgaggacatcaagcacaaccaggtgtctgcccagcctgtgccccaggagcccagcaggaaggactatgagacctaccagcccttccagaacagcaccaggaactatgatgagagcttctttgaggaccaggtgcaccaccggcccccagccagcgagtacaccatgcacctgggcctgaagagcactggaaactacgtggacttctacagcgctgcccggccctacagcgagctgaactatgagaccagccactacccagccagcccagacagctgggtgtag

SEQ ID NO: 146499 - DNA, 2667 bp, Artificial Sequence
  Description of Artificial Sequence: Synthetic coding sequence
atgagctccatgagcagcgctgaggagcagttccagtggcagagccaggacggccagaaggacattgaagatgagctgaccaccggcctggagctggtggacagctgcatccgcagcctgcaggagagcggcatcctggacccccaggactacagcactggagagaccggcagccgggccagctacagcagccagcacggccacctgggccctgagctgcgggccctgcagagccctgagcaccacatcgaccccatctatgaggacagagtgtaccagaagccacccatgaggagcctgagccagagccagggcgaccccctgcccccagcccacacaggcacctaccgcaccagcacagcccccagcagccctggggtggacagcgtgcccctgcagaggacaggcagccagcacggcccccagaatgctgctgctgccaccttccagagggccagctatgctgctggccctgccagcaactatgctgacccctaccggcagctgcagtactgccccagcgtggagagcccctacagcaagagcggccctgccctgcccccagagggcaccctggcccggagccccagcattgacagcatccagaaggacccccgggagtttggctggagggaccctgagctgcctgaggtgatccagatgctgcagcaccagttccccagcgtgcagagcaatgctgctgcctacctgcagcacctgtgcttcggggacaacaagatcaaggccgagatccggcggcagggcggcatccagctgctggtggacctgctggaccacaggatgacagaggtgcacaggtctgcctgtggggccctgaggaacctggtgtatggcaaggccaatgatgacaacaagatcgccctgaagaactgtggcggcatcccagccctggtgcggctgctgaggaagaccacagacctggagatccgggagctggtgactggagtgctgtggaacctgagcagctgtgatgccctgaagatgcccatcatccaggatgccctggccgtgctgaccaatgctgtgatcatcccccacagcggctgggagaacagccccctgcaggatgacaggaagatccagctgcacagcagccaggtgctgagaaatgccaccggctgcctgagaaatgtgtcctctgctggggaggaggcccggcggaggatgagagaatgtgatggcctgacagatgccctgctgtatgtgatccagagcgccctgggcagcagcgagattgacagcaagacagtggagaactgtgtgtgcatcctgaggaacctgagctaccgcctggccgctgagaccagccagggccagcacatgggcacagatgagctggatggcctgctgtgtggggaggccaacgggaaggatgctgagagcagcggctgctggggcaagaagaagaagaagaagaagagccaggaccagtgggatggagtgggccccctgcctgactgtgccgagccccccaagggcatccagatgctgtggcaccccagcatcgtgaagccctacctgaccctgctgtctgaatgtagcaacccagacaccctggagggcgccgccggggccctgcagaacctggccgccggctcctggaagtggagcgtgtacatccgggctgctgtgaggaaggagaagggcctgcccatcctggtggagctgctgagaattgacaatgacagagtggtgtgtgctgtggccacagccctgaggaacatggccctggatgtgaggaacaaggagctgattggcaagtatgccatgagggacctggtgcaccggctgcccggcggcaacaacagcaacaacacagccagcaaggccatgtctgatgacacagtgacagctgtgtgctgcaccctgcatgaagtcatcaccaagaacatggagaatgccaaggccctgagagatgctgggggcatcgagaagctggtgggcatcagcaagagcaagggggacaagcacagccccaaggtggtgaaggccgccagccaggtgctgaacagcatgtggcagtacagagacctgcggagcctgtacaagaaggatggctggagccagtaccactttgtggccagcagcagcaccatcgagcgggaccggcagaggccctacagcagcagcaggacccccagcatcagccctgtgcgggtgagccccaacaacagaagtgccagcgccccagccagcccccgggagatgatcagcctgaaggagaggaagacagattatgagtgcaccggcagcaatgccacctaccatggagccaagggggagcacaccagcaggaaggatgccatgacagcccagaacacaggcatcagcaccctgtacagaaacagctatggagccccagctgaggacatcaagcacaaccaggtgtctgcccagcctgtgccccaggagcccagcaggaaggactatgagacctaccagcccttccagaacagcaccaggaactatgatgagagcttctttgaggaccaggtgcaccaccggcccccagccagcgagtacaccatgcacctgggcctgaagagcactggaaactacgtggacttctacagcgctgcccggccctacagcgagctgaactatgagaccagccactacccagccagcccagacagctgggtgtag

SEQ ID NO: 146500 - DNA, 546 bp, Artificial Sequence
  Description of Artificial Sequence: Synthetic coding sequence
atgagctccatgagcagcgctgaggagcagttccagtggcagagccaggacggccagaaggacattgaagatgagctgaccaccggcctggagctggtggacagctgcatccgcagcctgcaggagagcggcatcctggacccccaggactacagcactggagagcggcccagcctgctgagccagagcgccctgcagctgaacagcaagccagagggcagcttccagtacccagccagctaccacagcaaccagaccctggccctgggggagaccacccccagccagctgcctgcccggggcacccaggcccgggccaccggccagagcttcagccagggcaccaccagcagagctggccacctggccggccctgagcccgcccctcctcctcctcctccaccccgggagccctttgcccccagcctgggcagcgccttccacctgcctgatgcccctcctgctgctgctgctgctgccctgtactacagcagcagcaccctgcctgccccaccccggggcggcagccccctggccgccccctag

SEQ ID NO: 146501 - DNA, 963 bp, Artificial Sequence
  Description of Artificial Sequence: Synthetic coding sequence
atgacagtgtggtgtgctgtggccacagccctgaggaacatggccctggatgtgaggaacaaggagctgattggcaagtatgccatgagggacctggtgcaccggctgcccggcggcaacaacagcaacaacacagccagcaaggccatgtctgatgacacagtgacagctgtgtgctgcaccctgcatgaagtcatcaccaagaacatggagaatgccaaggccctgagagatgctgggggcatcgagaagctggtgggcatcagcaagagcaagggggacaagcacagccccaaggtggtgaaggccgccagccaggtgctgaacagcatgtggcagtacagagacctgcggagcctgtacaagaaggatggctggagccagtaccactttgtggccagcagcagcaccatcgagcgggaccggcagaggccctacagcagcagcaggacccccagcatcagccctgtgcgggtgagccccaacaacagaagtgccagcgccccagccagcccccgggagatgatcagcctgaaggagaggaagacagattatgagtgcaccggcagcaatgccacctaccatggagccaagggggagcacaccagcaggaaggatgccatgacagcccagaacacaggcatcagcaccctgtacagaaacagctatggagccccagctgaggacatcaagcacaaccaggtgtctgcccagcctgtgccccaggagcccagcaggaaggactatgagacctaccagcccttccagaacagcaccaggaactatgatgagagcttctttgaggaccaggtgcaccaccggcccccagccagcgagtacaccatgcacctgggcctgaagagcactggaaactacgtggacttctacagcgctgcccggccctacagcgagctgaactatgagaccagccactacccagccagcccagacagctgggtgtag

SEQ ID NO: 146502 - DNA, 246 bp, Artificial Sequence
  Description of Artificial Sequence: Synthetic coding sequence
atgaaccgggagggcgcccctgggaagagccctgaggagatgtacatccagcagaaggtgcgggtgctgctgatgctgaggaagatgggcagcaacctgacagccagcgaggaggagttcctgcggacctacgccggcgtggtgaacagccagctgagccagctgcccccccacagcattgaccagggcgcagaagatgtggtgatggccttcagccgctcagaaacagaagatcggcggcagtag

SEQ ID NO: 146503 - DNA, 246 bp, Artificial Sequence; identical to SEQ ID NO: 146502
  Description of Artificial Sequence: Synthetic coding sequence

SEQ ID NO: 146504 - DNA, 246 bp, Artificial Sequence; identical to SEQ ID NO: 146502
  Description of Artificial Sequence: Synthetic coding sequence

SEQ ID NO: 146505 - DNA, 246 bp, Artificial Sequence; identical to SEQ ID NO: 146502
  Description of Artificial Sequence: Synthetic coding sequence

SEQ ID NO: 146506 - DNA, 246 bp, Artificial Sequence; identical to SEQ ID NO: 146502
  Description of Artificial Sequence: Synthetic coding sequence

SEQ ID NO: 146507 - DNA, 1692 bp, Artificial Sequence
  Description of Artificial Sequence: Synthetic coding sequence
atggatgtgggggagctgctgagctaccagcccaacagaggcaccaagaggcccagagatgatgaggaggaggagcagaagatgaggaggaagcagacaggcacccgggagcggggccgctaccgggaggaggagatgacagtggtggaggaggctgatgatgacaagaagaggctgctgcagatcatcgacagagatggagaggaggaggaggaggaggaggagcccctggatgagagctctgtgaagaagatgatcctgacctttgagaagaggagctacaagaaccaggagctgcgcatcaagttcccagacaaccctgagaagttcatggagagcgagctggacctgaatgacatcatccaggagatgcacgtggtggccaccatgccagacctgtaccacctgctggtggagctgaatgctgtgcagagcctgctgggcctgctgggccatgacaacacagatgtgtccattgctgtggtggacctgctgcaggagctgacagacatcgacaccctgcatgaaagtgaggagggcgctgaggtgctgattgatgccctggtggatggccaggtggtggccctgctggtgcagaacctggagcggctggatgaatctgtgaaggaggaggctgatggagtgcacaacaccctggccatcgtggagaacatggccgagttccggcctgagatgtgcacagagggcgcccagcagggcctgctgcagtggctgctgaagaggctgaaggccaagatgccctttgatgccaacaagctgtactgcagcgaggtgctggccatcctgctgcaggacaatgatgaaaatcgggagctgctgggggagctggatggcattgatgtgctgctgcagcagctgagcgtcttcaagaggcacaaccccagcacagctgaggagcaggagatgatggagaacctgtttgacagcctgtgcagctgcctgatgctgagcagcaaccgggagcgcttcctgaagggggagggcctgcagctgatgaacctgatgctgcgggagaagaagatcagccgcagcagcgccctgaaggtgctggaccacgccatgattggccctgagggcacagacaactgccacaagtttgtggacatcctgggcctgcggaccatcttccccctcttcatgaagagccccaggaagatcaagaaggtgggcaccacagagaaggagcacgaggagcacgtgtgcagcatcctggccagcctgctgaggaacctgcggggccagcagaggacccggctgctgaacaagttcacagaaaatgattctgagaaggtggaccggctgatggagctgcacttcaagtacctgggcgccatgcaggtggccgacaagaagattgaaggagagaagcatgacatggtgcggcggggggagatcatcgacaatgacacagaggaggagttctacctgcggcggctggatgctggcctgtttgtgctgcagcacatctgctacatcatggccgagatctgcaatgccaacgtgccccagatccggcagagggtgcaccagatcctgaacatgaggggcagcagcatcaagatcgtgcgccacatcatcaaggagtatgcagagaacattggagatggccgcagccctgagttccgggagaatgagcagaagaggatcctgggcctgctggagaacttctag

SEQ ID NO: 146508 - DNA, 1611 bp, Artificial Sequence
  Description of Artificial Sequence: Synthetic coding sequence
atgaggaggaagcagacaggcacccgggagcggggccgctaccgggaggaggagatgacagtggtggaggaggctgatgatgacaagaagaggctgctgcagatcatcgacagagatggagaggaggaggaggaggaggaggagcccctggatgagagctctgtgaagaagatgatcctgacctttgagaagaggagctacaagaaccaggagctgcgcatcaagttcccagacaaccctgagaagttcatggagagcgagctggacctgaatgacatcatccaggagatgcacgtggtggccaccatgccagacctgtaccacctgctggtggagctgaatgctgtgcagagcctgctgggcctgctgggccatgacaacacagatgtgtccattgctgtggtggacctgctgcaggagctgacagacatcgacaccctgcacgagagcgaggagggcgctgaggtgctgattgatgccctggtggatggccaggtggtggccctgctggtgcagaacctggagcggctggatgagagcgtgaaggaggaggctgatggagtgcacaacaccctggccatcgtggagaacatggccgagttccggcctgagatgtgcacagaaggagcccagcagggcctgctgcagtggctgctgaagaggctgaaggccaagatgccctttgatgccaacaagctgtactgcagcgaggtgctggccatcctgctgcaggacaatgatgagaaccgggagctgctgggggagctggatggcattgatgtgctgctgcagcagctgtctgtgttcaagaggcacaaccccagcacagctgaggagcaggagatgatggagaacctgtttgacagcctgtgcagctgcctgatgctgagcagcaaccgggagcgcttcctgaagggggagggcctgcagctgatgaacctgatgctgcgggagaagaagatcagccgcagcagcgccctgaaggtgctggaccacgccatgattggccctgagggcacagacaactgccacaagtttgtggacatcctgggcctgcggaccatcttccccctcttcatgaagagccccaggaagatcaagaaggtgggcaccacagagaaggagcacgaggagcacgtgtgcagcatcctggccagcctgctgaggaacctgcggggccagcagaggacccggctgctgaacaagttcacagaaaatgacagcgagaaggtggaccggctgatggagctgcacttcaagtacctgggcgccatgcaggtggccgacaagaagattgaaggagagaagcatgacatggtgagaagaggagagatcatcgacaatgacacagaggaggagttctacctgcggcggctggatgctggcctgtttgtgctgcagcacatctgctacatcatggccgagatctgcaatgccaacgtgccccagatccggcagagggtgcaccagatcctgaacatgaggggcagcagcatcaagatcgtgcgccacatcatcaaggagtatgcagaaaatattggagatggccgcagccctgagttcagagaaaatgagcagaagaggatcctgggcctgctggagaacttctag

SEQ ID NO: 146509 - DNA, 501 bp, Artificial Sequence
  Description of Artificial Sequence: Synthetic coding sequence
atgaggaggaagcagacaggcacccgggagcggggccgctaccgggaggaggagatgacagtggtggaggaggctgatgatgacaagaagaggctgctgcagatcatcgacagagatggagaggaggaggaggaggaggaggagcccctggatgagagctctgtgaagaagatgatcctgacctttgagaagaggagctacaagaaccaggagctgcgcatcaagttcccagacaaccctgagaagttcatggagagcgagctggacctgaatgacatcatccaggagatgcacgtggtggccaccatgccagacctgtaccacctgctggtggagctgaatgctgtgcagagcctgctgggcctgctgggccatgacaacacagatgtgtccattgctgtggtggacctgctgcaggagctgacagacatcgacaccctgcacgagagcgaggagggcgctgaggtgctgattgatgccctggtggatggccaggtgtag

SEQ ID NO: 146510 - DNA, 1443 bp, Artificial Sequence
  Description of Artificial Sequence: Synthetic coding sequence
atgatccgggccgcccctcctcctctcttcctgctgctgctgctgctgctgctgctggtgtcctgggccagcagaggagaggccgccccagaccaggatgagatccagaggctgcccggcctggccaagcagcccagcttccggcagtacagcggctacctgaagggcagcggcagcaagcacctgcactactggtttgtggagagccagaaggaccctgagaacagccctgtggtgctgtggctgaatggaggccctggctgcagcagcctggatggcctgctgacagagcacggccccttcctggtgcagccagatggagtgaccctggagtacaacccctacagctggaacctgattgccaacgtgctgtacctggagagccctgctggggtgggcttctcctacagtgatgacaagttctacgccaccaatgacacagaggtggcccagagcaactttgaggccctgcaggacttcttccgcctcttccctgagtacaagaacaacaagctgttcctgactggagagagctatgccggcatctacatccccaccctggccgtgctggtgatgcaggaccccagcatgaacctgcagggcctggccgtgggcaatggcctgagcagctatgagcagaatgacaacagcctggtgtactttgcctactaccacggcctgctgggcaaccggctgtggagcagcctgcagacccactgctgcagccagaacaagtgcaacttctatgacaacaaggacctggagtgtgtgaccaacctgcaggaggtggcccgcatcgtgggcaacagcggcctgaacatctacaacctgtatgccccctgtgccggcggcgtgcccagccacttccgctatgagaaggacacagtggtggtgcaggacctgggcaacatcttcacccggctgcccctgaagaggatgtggcaccaggccctgctgcggagcggggacaaggtgaggatggaccccccctgcaccaacaccacagctgccagcacctacctgaacaacccctacgtgaggaaggccctgaacatccctgagcagctgccccagtgggacatgtgcaacttcctggtgaacctgcagtacagaagactctaccgctccatgaacagccagtacctgaagctgctgagcagccagaagtaccagatcctgctgtacaatggagatgtggacatggcctgcaacttcatgggagatgagtggtttgtggacagcctgaaccagaagatggaggtgcagaggcggccctggctggtgaagtacggggacagcggggagcagattgctggctttgtgaaggagttcagccacatcgccttcctgaccatcaagggagctggccacatggtgcccacagacaagcccctggccgccttcaccatgttcagccgcttcctgaacaagcagccctactag

SEQ ID NO: 146511 - DNA, 1446 bp, Artificial Sequence
  Description of Artificial Sequence: Synthetic coding sequence
atgaccagcagcccccgggcccctcctggagagcagggccggggcggcgctgagatgatccgggccgcccctcctcctctcttcctgctgctgctgctgctgctgctgctggtgtcctgggccagcagaggagaggccgccccagaccaggatgagatccagaggctgcccggcctggccaagcagcccagcttccggcagtacagcggctacctgaagggcagcggcagcaagcacctgcactactggtttgtggagagccagaaggaccctgagaacagccctgtggtgctgtggctgaatggaggccctggctgcagcagcctggatggcctgctgacagagcacggccccttcctgattgccaacgtgctgtacctggagagccctgctggggtgggcttctcctacagtgatgacaagttctacgccaccaatgacacagaggtggcccagagcaactttgaggccctgcaggacttcttccgcctcttccctgagtacaagaacaacaagctgttcctgaccggggagagctatgccggcatctacatccccaccctggccgtgctggtgatgcaggaccccagcatgaacctgcagggcctggccgtgggcaatggcctgagcagctatgagcagaatgacaacagcctggtgtactttgcctactaccacggcctgctgggcaaccggctgtggagcagcctgcagacccactgctgcagccagaacaagtgcaacttctatgacaacaaggacctggagtgtgtgaccaacctgcaggaggtggccagaattgtgggcaacagcggcctgaacatctacaacctgtatgccccctgtgccggcggcgtgcccagccacttccgctatgagaaggacacagtggtggtgcaggacctgggcaacatcttcacccggctgcccctgaagaggatgtggcaccaggccctgctgcggagcggggacaaggtgaggatggaccccccctgcaccaacaccacagctgccagcacctacctgaacaacccctacgtgaggaaggccctgaacatccctgagcagctgccccagtgggacatgtgcaacttcctggtgaacctgcagtaccgccgcctgtaccgctccatgaacagccagtacctgaagctgctgagcagccagaagtaccagatcctgctgtacaatggagatgtggacatggcctgcaacttcatgggagatgagtggtttgtggacagcctgaaccagaagatggaggtgcagaggcggccctggctggtgaagtatggagacagcggggagcagattgctggctttgtgaaggagttcagccacatcgccttcctgaccatcaagggggccggccacatggtgcccacagacaagcccctggccgccttcaccatgttcagccgcttcctgaacaagcagccctactag

SEQ ID NO: 146512 - DNA, 870 bp, Artificial Sequence
  Description of Artificial Sequence: Synthetic coding sequence
atgatccgggccgcccctcctcctctcttcctgctgctgctgctgctgctgctgctggtgtcctgggccagcagaggagaggccgccccagaccaggatgagatccagaggctgcccggcctggccaagcagcccagcttccggcagtacagcggctacctgaagggcagcggcagcaagcacctgcactactggtttgtggagagccagaaggaccctgagaacagccctgtggtgctgtggctgaatggaggccctggctgcagcagcctggatggcctgctgacagagcacggccccttcctggtgcagccagatggagtgaccctggagtacaacccctacagctggaacctgattgccaacgtgctgtacctggagagccctgctggggtgggcttctcctacagtgatgacaagttctacgccaccaatgacacagaggtggcccagagcaactttgaggccctgcaggacttcttccgcctcttccctgagtacaagaacaacaagctgttcctgactggagagagctatgccggcatctacatccccaccctggccgtgctggtgatgcaggaccccagcatgaacctgcagggcctggccgtgggcaatggcctgagcagctatgagcagaatgacaacagcctggtgtactttgcctactaccacggcctgctgggcaaccggctgtggagcagcctgcagacccactgctgcagccagaacaagtgcaacttctatgacaacaaggacctggagtgtgtgaccaacctgcaggaggtggcccgcatcgtgggcaacagcggcctgaacatctacaacctgtatgccccctgtgccggcggcgtgcccagccacttctag

SEQ ID NO: 146513 - DNA, 1497 bp, Artificial Sequence
  Description of Artificial Sequence: Synthetic coding sequence
atgaccagcagcccccgggcccctcctggagagcagggccggggcggcgctgagatgatccgggccgcccctcctcctctcttcctgctgctgctgctgctgctgctgctggtgtcctgggccagcagaggagaggccgccccagaccaggatgagatccagaggctgcccggcctggccaagcagcccagcttccggcagtacagcggctacctgaagggcagcggcagcaagcacctgcactactggtttgtggagagccagaaggaccctgagaacagccctgtggtgctgtggctgaatggaggccctggctgcagcagcctggatggcctgctgacagagcacggccccttcctggtgcagccagatggagtgaccctggagtacaacccctacagctggaacctgattgccaacgtgctgtacctggagagccctgctggggtgggcttctcctacagtgatgacaagttctacgccaccaatgacacagaggtggcccagagcaactttgaggccctgcaggacttcttccgcctcttccctgagtacaagaacaacaagctgttcctgactggagagagctatgccggcatctacatccccaccctggccgtgctggtgatgcaggaccccagcatgaacctgcagggcctggccgtgggcaatggcctgagcagctatgagcagaatgacaacagcctggtgtactttgcctactaccacggcctgctgggcaaccggctgtggagcagcctgcagacccactgctgcagccagaacaagtgcaacttctatgacaacaaggacctggagtgtgtgaccaacctgcaggaggtggcccgcatcgtgggcaacagcggcctgaacatctacaacctgtatgccccctgtgccggcggcgtgcccagccacttccgctatgagaaggacacagtggtggtgcaggacctgggcaacatcttcacccggctgcccctgaagaggatgtggcaccaggccctgctgcggagcggggacaaggtgaggatggaccccccctgcaccaacaccacagctgccagcacctacctgaacaacccctacgtgaggaaggccctgaacatccctgagcagctgccccagtgggacatgtgcaacttcctggtgaacctgcagtacagaagactctaccgctccatgaacagccagtacctgaagctgctgagcagccagaagtaccagatcctgctgtacaatggagatgtggacatggcctgcaacttcatgggagatgagtggtttgtggacagcctgaaccagaagatggaggtgcagaggcggccctggctggtgaagtacggggacagcggggagcagattgctggctttgtgaaggagttcagccacatcgccttcctgaccatcaagggagctggccacatggtgcccacagacaagcccctggccgccttcaccatgttcagccgcttcctgaacaagcagccctactag

SEQ ID NO: 146514 - DNA, 1038 bp, Artificial Sequence
  Description of Artificial Sequence: Synthetic coding sequence
atgatccgggccgcccctcctcctctcttcctgctgctgctgctgctgctgctgctggtgtcctgggccagcagaggagaggccgccccagaccaggatgagatccagaggctgcccggcctggccaagcagcccagcttccggcagtacagcggctacctgaagggcagcggcagcaagcacctgcactactggtttgtggagagccagaaggaccctgagaacagccctgtggtgctgtggctgaatggaggccctggctgcagcagcctggatggcctgctgacagagcacggccccttcctgattgccaacgtgctgtacctggagagccctgctggggtgggcttctcctacagtgatgacaagttctacgccaccaatgacacagaggtggcccagagcaactttgaggccctgcaggacttcttccgcctcttccctgagtacaagaacaacaagctgttcctgaccggggagagctatgccggcatctacatccccaccctggccgtgctggtgatgcaggaccccagcatgaacctgcagggcctggccgtgggcaatggcctgagcagctatgagcagaatgacaacagcctggtgtactttgcctactaccacggcctgctgggcaaccggctgtggagcagcctgcagacccactgctgcagccagaacaagtgcaacttctatgacaacaaggacctggagtgtgtgaccaacctgcaggaggtggccagaattgtgggcaacagcggcctgaacatctacaacctgtatgccccctgtgccggcggcgtgcccagccacttccgctatgagaaggacacagtggtggtgcaggacctgggcaacatcttcacccggctgcccctgaagaggatgtggcaccaggccctgctgcggagcggggacaaggtgaggatggaccccccctgcaccaacaccacagctgccagcacctacctgaacaacccctacgtgaggaaggccctgaacatccctgagcagctgccccagtgggacatgtgctag

SEQ ID NO: 146515 - DNA, 1149 bp, Artificial Sequence
  Description of Artificial Sequence: Synthetic coding sequence
atgatgtttcctggcctgctggcccctcctgctggctaccccagcctgctgcggcccacccccaccctgaccctgccccagagcctgcagagcgccttcagcggccacagcagcttcctggtggaggacctgatccgcatcagccggcccccagcctacctgcccaggtctgtgcccacagcctccatgagccccccccggcagggcgcccccacagccctgacagacacaggagccagtgacctgggcagccctggccctggcagccggcggggcggcagccccccaacagccttctccccagccagcgagaccaccttcctgaagtttggagtgaatgccatcctgagcagcggccccaggacagagaccagccctgccctgctgcagagcgtgccccccaagacctttgccttcccctactttgagggcagcttccagcccttcatccgcagcagctacttccctgccagcagctctgtggtgcccatccctggcaccttctcctggcccctggccgcccggggcaagccccggcggggcatgctgcggcgggctgtgttcagtgatgtgcagaggaaggccctggagaagatgttccagaagcagaagtacatcagcaagccagacaggaagaagctggccgccaagctgggcctgaaggacagccaggacacagcccggaggacagagcccgccccagacagcaccccccggccccgggccagccctggggccccagacctgaccagcgccagccccttcttcagccctgctggcaccttccaggtgaagatctggttccagaacagaaggatgaagtggaggaacagcaaggagcgggagctgctgagcagcggcggctgccgggagcagaccctgcccaccaagctgaacccccacccagacctgagtgatgtgggccagaagggccctggaaatgaggaggaggaggagggccctggcagccccagccaccggctggcctaccacgccagcagtgacccccagcacctgcgggacccccggctgcccggccccctgccccccagccctgcccacagcagcagccctgggaagcccagcgacttcagtgacagcgaggaggaggaggagggggaggagcaggaggagatcaccgtgtcctag

SEQ ID NO: 146516 - DNA, 1341 bp, Artificial Sequence
  Description of Artificial Sequence: Synthetic coding sequence
atgggcgccggccccagctgtgacaccccagccaactgcacctacctggacctgctgggcacctgggtgttccaggtgggcagcagcggcagccagagagatgtgaactgcagcgtgatgggcccccaggagaagaaggtggtggtgtacctgcagaagctggacacagcctatgatgacctgggcaacagcggccacttcaccatcatctacaaccagggctttgaaattgtgctgaatgactacaagtggtttgccttcttcaagtacaaggaggagggcagcaaggtgaccacctactgcaatgagaccatgacaggctgggtgcatgatgtgctgggcaggaactgggcctgcttcaccgggaagaaggtgggcacagcctctgaaaatgtgtatgtgaacatcgcccacctgaagaacagccaggagaagtacagcaaccggctgtacaagtatgaccacaactttgtgaaggccatcaatgccatccagaagtcctggacagccaccacctacatggagtatgagaccctgaccctgggggacatgatccgccgcagcggcggccacagcaggaagatcccccggcccaagccagcccccctgacagctgagatccagcagaagatcctgcacctgcccacctcctgggactggagaaatgtgcacggcatcaactttgtgtcccctgtgaggaaccaggccagctgtggcagctgctacagctttgcctccatgggcatgctggaggcccgcatccgcatcctgaccaacaacagccagacccccatcctgagcccccaggaggtggtgtcctgcagccagtatgcccagggctgtgagggcggcttcccctacctgattgctgggaagtatgcccaggactttggcctggtggaggaggcctgcttcccctacacaggaacagacagcccctgcaagatgaaggaggactgcttccgctactacagcagcgagtaccactacgtgggcggcttctatggaggctgcaatgaggccctgatgaagctggagctggtgcaccacggccccatggctgtggcctttgaggtgtatgatgacttcctgcactacaagaagggcatctaccaccacacaggcctgcgggaccccttcaacccctttgagctgaccaaccacgctgtgctgctggtgggctatggaacagattctgccagcggcatggactactggatcgtgaagaacagctggggcaccggctggggagaaaatggctacttccgcatcagaagaggaacagatgaatgtgccatcgagagcattgctgtggccgccacccccatccccaagctgtag

SEQ ID NO: 146517 - DNA, 414 bp, Artificial Sequence
  Description of Artificial Sequence: Synthetic coding sequence
atgggcgccggccccagcctgctgctggccgccctgctgctgctgctgtctggagatggagctgtgcgctgtgacaccccagccaactgcacctacctggacctgctgggcacctgggtgttccaggtgggcagcagcggcagccagagagatgtgaactgcagcgtgatgggcccccaggagaagaaggtggtggtgtacctgcagaagctggacacagcctatgatgacctgggcaacagcggccacttcaccatcatctacaaccagggctttgagatcgtgctgaatgactacaagtggtttgccttcttcaaggatgtgacagacttcatcagccacctgttcatgcagctgggcaccgtgggcatctatgacctgccccacctgaggaacaagctggtgatcaagtag

SEQ ID NO: 146518 - DNA, 426 bp, Artificial Sequence
  Description of Artificial Sequence: Synthetic coding sequence
atgggcgccggccccagcctgctgctggccgccctgctgctgctgctgtctggagatggagctgtgcgctgtgacaccccagccaactgcacctacctggacctgctgggcacctgggtgttccaggtgggcagcagcggcagccagagagatgtgaactgcagcgtgatgggcccccaggagaagaaggtggtggtgtacctgcagaagctggacacagcctatgatgacctgggcaacagcggccacttcaccatcatctacaaccagggctttgagatcgtgctgaatgactacaagtggtttgccttcttcaaggatgtgacagacttcatcagccacctgttcatgcagctgggcaccgtgggcatctatgacctgccccacctgaggaacaagctggccatgaacagacgctggggctag

SEQ ID NO: 146519 - DNA, 1191 bp, Artificial Sequence
  Description of Artificial Sequence: Synthetic coding sequence
atgaagaccctgctgctgctgctgctggtgctgctggagctgggggaggcccagggcagcctgcaccgggtgcccctgcggcggcaccccagcctgaagaagaagctgcgggcccggagccagctgtctgagttctggaagagccacaacctggacatgatccagttcacagagagctgcagcatggaccagagcgccaaggagcccctcatcaactacctggacatggagtacttcggcaccatcagcatcggcagccccccccagaacttcaccgtcatctttgacaccggcagcagcaacctgtgggtgcccagcgtgtactgcaccagccctgcctgcaagacccacagccgcttccagcccagccagagcagcacctacagccagcccggccagagcttcagcatccagtatggaacaggcagcctgagcggcatcatcggggctgaccaggtgtctgtggagggcctgactgtggtgggccagcagtttggagagagcgtgacagagcccggccagacctttgtggatgctgagtttgatggcatcctgggcctgggctaccccagcctggccgtgggcggcgtgacccctgtgtttgacaacatgatggcccagaacctggtggacctgcccatgttttctgtgtacatgagcagcaaccctgagggcggggccggcagcgagctgatctttggaggctatgaccacagccacttcagcggcagcctgaactgggtgcctgtgaccaagcaggcctactggcagatcgccctggacaacatccaggtgggcggcaccgtgatgttctgcagcgagggctgccaggccatcgtggacaccggcaccagcctcatcaccggccccagcgacaagatcaagcagctgcagaatgccatcggggccgcccctgtggatggagaatatgctgtggagtgtgccaacctgaatgtgatgccagatgtgaccttcaccatcaacggggtgccctacaccctgagccccacagcctacaccctgctggactttgtggatggcatgcagttctgcagcagcggcttccagggcctggacatccaccccccagctggccccctgtggatcctgggagatgtgttcatccggcagttctacagcgtgtttgaccggggcaacaacagagtgggcctggccccagctgtgccctag

SEQ ID NO: 146520 - DNA, 1092 bp, Artificial Sequence
  Description of Artificial Sequence: Synthetic coding sequence
atgaagaccctgctgctgctgctgctggtgctgctggagctgggggaggcccagggcagcctgcaccgggtgcccctgcggcggcaccccagcctgaagaagaagctgcgggcccggagccagctgtctgagttctggaagagccacaacctggacatgatccagttcacagagagctgcagcatggaccagagcgccaaggagcccctcatcaactacctggacatggagtacttcggcaccatcagcatcggcagccccccccagaacttcaccgtcatctttgacaccggcagcagcaacctgtgggtgcccagcgtgtactgcaccagccctgcctgcaagacccacagccgcttccagcccagccagagcagcacctacagccagcccggccagagcttcagcatccagtatggaacaggcagcctgagcggcatcatcggggctgaccaggtgtctgtggagggcctgactgtggtgggccagcagtttggagagagcgtgacagagcccggccagacctttgtggatgctgagtttgatggcatcctgggcctgggctaccccagcctggccgtgggcggcgtgacccctgtgtttgacaacatgatggcccagaacctggtggacctgcccatgttttctgtgtacatgagcagcaaccctgagggcggggccggcagcgagctgatctttggaggctatgaccacagccacttcagcggcagcctgaactgggtgcctgtgaccaagcaggcctactggcagatcgccctggacaacatgctgtggagcgtgcccaccctgaccagctgcaggatgagccccagccccctgacagagagccccatccccagcgcccagctgcccaccccctactggacctcctggatggagtgcagcagcgctgctgtggccttcaaggacctgaccagcaccctgcagctgggccccagcggctcctggggcatgagcagctttgacagcttcacccagagcctgactgtgggcatcaccgtgtgggactggccccagcagagccccaaggagggcccctgtgtgtgtgcctgcctgagtgaccggccctag

SEQ ID NO: 146521 - DNA, 1206 bp, Artificial Sequence
  Description of Artificial Sequence: Synthetic coding sequence
atgaagaccctgctgctgctgctgctggtgctgctggagctgggggaggcccagggcagcctgcaccgggtgcccctgcggcggcaccccagcctgaagaagaagctgcgggcccggagccagctgtctgagttctggaagagccacaacctggacatgatccagttcacagagagctgcagcatggaccagagcgccaaggagcccctcatcaactacctggacatggagtacttcggcaccatcagcatcggcagccccccccagaacttcaccgtcatctttgacaccggcagcagcaacctgtgggtgcccagcgtgtactgcaccagccctgcctgcaagacccacagccgcttccagcccagccagagcagcacctacagccagcccggccagagcttcagcatccagtatggaacaggcagcctgagcggcatcatcggggctgaccaggtgtctgccttctcctaccaggtggagggcctgactgtggtgggccagcagtttggagagagcgtgacagagcccggccagacctttgtggatgctgagtttgatggcatcctgggcctgggctaccccagcctggccgtgggcggcgtgacccctgtgtttgacaacatgatggcccagaacctggtggacctgcccatgttttctgtgtacatgagcagcaaccctgagggcggggccggcagcgagctgatctttggaggctatgaccacagccacttcagcggcagcctgaactgggtgcctgtgaccaagcaggcctactggcagatcgccctggacaacatccaggtgggcggcaccgtgatgttctgcagcgagggctgccaggccatcgtggacaccggcaccagcctcatcaccggccccagcgacaagatcaagcagctgcagaatgccatcggggccgcccctgtggatggagaatatgctgtggagtgtgccaacctgaatgtgatgccagatgtgaccttcaccatcaatggagtgccctacaccctgagccccacagcctacaccctgctggactttgtggatggcatgcagttctgcagcagcggcttccagggcctggacatccaccccccagctggccccctgtggatcctgggagatgtgttcatccggcagttctacagcgtgtttgaccggggcaacaacagagtgggcctggccccagctgtgccctag

SEQ ID NO: 146522 - DNA, 867 bp, Artificial Sequence
  Description of Artificial Sequence: Synthetic coding sequence
atggagtacttcggcaccatcagcatcggcagccccccccagaacttcaccgtcatctttgacaccggcagcagcaacctgtgggtgcccagcgtgtactgcaccagccctgcctgcaagacccacagccgcttccagcccagccagagcagcacctacagccagcccggccagagcttcagcatccagtatggcaccggcagcctgagcggcatcattggagctgaccaggtgtctgtggagggcctgactgtggtgggccagcagtttggagagagcgtgacagagcccggccagacctttgtggatgctgagtttgatggcatcctgggcctgggctaccccagcctggccgtgggcggcgtgacccctgtgtttgacaacatgatggcccagaacctggtggacctgcccatgttttctgtgtacatgagcagcaaccctgagggcggggccggcagcgagctgatctttggaggctatgaccacagccacttcagcggcagcctgaactgggtgcctgtgaccaagcaggcctactggcagatcgccctggacaacatgctgtggagcgtgcccaccctgaccagctgcaggatgagccccagccccctgacagagagccccatccccagcgcccagctgcccaccccctactggacctcctggatggagtgcagcagcgctgctgtggccttcaaggacctgaccagcaccctgcagctgggccccagcggctcctggggcatgagcagctttgacagcttcacccagagcctgactgtgggcatcaccgtgtgggactggccccagcagagccccaaggagggcccctgtgtgtgtgcctgcctgagtgaccggccctag

SEQ ID NO: 146523 - DNA, 1455 bp, Artificial Sequence
  Description of Artificial Sequence: Synthetic coding sequence
atggccccctggctgcagctgctgagcctgctgggcctgctgcctggagctgtggccgccccagcccagccccgggccgccagcttccaggcctggggcccccccagccctgagctgctggcccccaccaggtttgccctggagatgttcaacagaggccgggccgccggcaccagggctgtgctgggcctggtgcggggccgggtgcggcgggccggccagggcagcctgtacagcctggaggccaccctggaggagcccccctgcaatgaccccatggtgtgccgcctgcctgtgtccaagaagaccctgctgtgcagcttccaggtgctggatgagctgggcagacatgtgctgctgaggaaggactgtggccctgtggacaccaaggtgcctggggccggggagcccaagagcgccttcacccagggcagcgccatgatcagcagcctgagccagaaccacccagacaacagaaatgagaccttcagcagcgtcatcagcctgctgaatgaagaccccctgagccaggacctgcctgtgaagatggccagcatcttcaagaacttcgtcatcacctacaacagaacctatgagagcaaggaggaggcccgctggaggctgtctgtgtttgtgaacaacatggtgcgggcccagaagatccaggccctggaccggggcacagcccagtatggagtgaccaagttcagtgacctgacagaggaggagttccgcaccatctacctgaacaccctgctgaggaaggagcccggcaacaagatgaagcaggccaagtctgtgggggacctggcccctcctgagtgggactggaggagcaaaggagctgtgaccaaggtgaaggaccagggcatgtgtggcagctgctgggccttctctgtgactggaaatgtggagggccagtggttcctgaaccagggcaccctgctgagcctgtctgagcaggagctgctggactgtgacaagatggacaaggcctgcatgggcggcctgcccagcaatgcctacagcgccatcaagaacctgggcggcctggagacagaagatgactacagctaccagggccacatgcagagctgcaacttctctgctgagaaggccaaggtgtacatcaatgacagcgtggagctgagccagaatgagcagaagctggccgcctggctggccaagaggggccccatctctgtggccatcaatgccttcggcatgcagttctaccgccacggcatcagccggcccctgcggcccctgtgcagcccctggctgattgaccatgctgtgctgctggtgggctacggcaacagaagtgatgtgcccttctgggccatcaagaacagctggggcacagactggggcgagaagggctactactacctgcaccggggcagcggggcctgtggggtgaacaccatggccagcagcgctgtggtggactag

SEQ ID NO: 146524 - DNA, 675 bp, Artificial Sequence
  Description of Artificial Sequence: Synthetic coding sequence
atggctgctgctgtgccccagagggcctggacagtggagcagctgcggtctgagcagctgcccaagaaggacatcatcaagttcctgcaggagcacggcagtgacagcttcctggccgagcacaagctgctgggcaacatcaagaatgtggccaagacagccaacaaggaccacctggtgacagcctacaaccacctgtttgagaccaagcgcttcaagggcacagagagcatcagcaaggtgtctgagcaggtgaagaatgtgaagctgaatgaagacaagcccaaggagaccaagtctgaggagaccctggatgagggcccccccaagtacaccaagtctgtgctgaagaagggggacaagaccaacttccccaagaagggagatgtggtgcactgctggtacacaggcaccctgcaggacggcaccgtgtttgacaccaacatccagaccagcgccaagaagaagaagaatgccaagcccctgtccttcaaggtgggcgtgggcaaggtgatccggggctgggatgaggccctgctgaccatgagcaagggggagaaggcccggctggagattgagcctgagtgggcctacggcaagaagggccagccagatgccaagatccccccaaatgccaagctgacctttgaggtggagctggtggacattgattag

SEQ ID NO: 146525 - DNA, 801 bp, Artificial Sequence
  Description of Artificial Sequence: Synthetic coding sequence
atgagctctgtgtttgggaagccccgggccggcagcggcccccagagcgcccccctggaggtgaacctggccatcctgggcagaagaggagctgggaagagcgccctgactgtgaagttcctgaccaagcgcttcatcagtgaatatgaccccaacctggaggacacctacagcagcgaggagaccgtggaccaccagcctgtgcacctgcgggtgatggacacagctgacctggacacccccaggaactgtgagcgctacctgaactgggcccacgccttcctggtggtgtacagcgtggacagccggcagagctttgacagcagcagcagctacctggagctgctggccctgcacgccaaggagacccagaggagcatcccagccctgctgctgggcaacaagctggacatggcccagtaccggcaggtgaccaaggccgagggcgtggccctggccggccgcttcggctgcctcttctttgaggtgtctgcctgcctggactttgaacatgtgcagcacgtgttccatgaagctgtgcgggaggcccggcgggagctggagaagagccccctgacccggcccctcttcatcagcgaggagcgggccctgccccaccaggcccccctgacagcccggcacggcctggccagctgcaccttcaacaccctgagcaccatcaacctgaaggagatgcccaccgtggcccaggccaagctggtgacagtgaagagcagccgggcccagagcaagaggaaggcccccaccctgaccctgctgaagggcttcaagatcttctag

SEQ ID NO: 146526 - DNA, 972 bp, Artificial Sequence
  Description of Artificial Sequence: Synthetic coding sequence
atgtgggccaccctgcccctgctgtgtgccgctgagctgtgtgtgaacagcctggagaagttccacttcaagtcctggatgagcaagcacaggaagacctacagcacagaggagtaccaccaccggctgcagacctttgccagcaactggaggaagatcaatgcccacaacaacggcaaccacaccttcaagatggccctgaaccagttcagtgacatgagctttgctgagatcaagcacaagtacctgtggagcgagccccagaactgcagcgccaccaagagcaactacctgcggggcaccggcccctacccaccttctgtggactggaggaagaagggcaactttgtgtcccctgtgaagaaccagggcgcctgtggcagctgctggaccttcagcaccactggagccctggagagcgccatcgccatcgccaccgggaagatgctgagcctggccgagcagcagctggtggactgtgcccaggacttcaacaaccacggctgccagggcggcctgcccagccaggcctttgagtacatcctgtacaacaagggcatcatgggagaggacacctacccctaccagggcaaggatggctactgcaagttccagcccgggaaggccatcggctttgtgaaggatgtggccaacatcaccatctatgatgaggaggccatggtggaggccgtggccctgtacaaccctgtgtcctttgcctttgaggtgacccaggacttcatgatgtacagaacaggcatctacagcagcaccagctgccacaagaccccagacaaggtgaaccacgctgtgctggccgtgggctacggggagaagaatggcatcccctactggatcgtgaagaacagctggggcccccagtggggcatgaatggctacttcctgattgagcggggcaagaacatgtgtggcctggccgcctgtgccagctaccccatccccctggtgtag

SEQ ID NO: 146527 - DNA, 621 bp, Artificial Sequence
  Description of Artificial Sequence: Synthetic coding sequence
atgtgggccaccctgcccctgctgtgtgccggggcctggctgctgggcgtgcctgtgtgtggggctgctgagctgtgtgtgaacagcctggagaagttccacttcaagtcctggatgagcaagcacaggaagacctacagcacagaggagtaccaccaccggctgcagacctttgccagcaactggaggaagatcaatgcccacaacaacggcaaccacaccttcaagatggccctgaaccagttcagtgacatgagctttgctgagatcaagcacaagtacctgtggagcgagccccagaactgcagcgccaccaagagcaactacctgcggggcaccggcccctacccaccttctgtggactggaggaagaagggcaactttgtgtcccctgtgaagaaccaggtgtgcctggccatcagcatcctgagcctgcagaatggccacaccccccggcagtacaccaggaagaacaacagcaagggcccccagaaccaccacaagcacatcccagcctctgtgagcagccgccacctgagccctggccggcccagcctgccccagctgcgggagatctgtgagggcaagaggctgggggaggcctctgtgaacctgggctag

SEQ ID NO: 146528 - DNA, 990 bp, Artificial Sequence
  Description of Artificial Sequence: Synthetic coding sequence
atgtggggcctgaaggtgctgctgctgcctgtggtgtcctttgccctgtacccagaggagatcctggacacccactgggagctgtggaagaagacccacaggaagcagtacaacaacaaggtggatgagatcagccggcggctcatctgggagaagaacctgaagtacatcagcatccacaacctggaggccagcctgggcgtgcacacctatgagctggccatgaaccacctgggggacatgaccagcgaggaggtggtgcagaagatgacaggcctgaaggtgcccctgagccacagccgcagcaatgacaccctgtacatccctgagtgggagggccgggccccagacagcgtggactacaggaagaagggctacgtgacccctgtgaagaaccagggccagtgtggcagctgctgggccttcagctctgtgggcgccctggagggccagctgaagaagaagacaggcaagctgctgaacctgagcccccagaacctggtggactgtgtgtctgaaaatgatggctgcggcggcggctacatgaccaatgccttccagtatgtgcagaagaacagaggaattgattctgaagatgcctacccctacgtgggccaggaggagagctgcatgtacaaccccaccgggaaggccgccaagtgccggggctaccgggagatccctgagggcaatgagaaggccctgaagagagctgtggcccgggtgggccctgtgtctgtggccattgatgccagcctgaccagcttccagttctacagcaaaggagtgtactatgatgagagctgcaacagcgacaacctgaaccacgctgtgctggccgtgggctacggcatccagaagggcaacaagcactggatcatcaagaacagctggggcgagaactggggcaacaagggctacatcctgatggccaggaacaagaacaatgcctgtggcatcgccaacctggccagcttccccaagatgtag

SEQ ID NO: 146529 - DNA, 777 bp, Artificial Sequence
  Description of Artificial Sequence: Synthetic coding sequence
atgcacaaggaaaatgaggagatctacaacgtgtctgaaaataggaagcactgccccatcttcccctgccccctgctgaccaggtctgggaaggtgcctgagttcagacatgagcgggaggagcggctggaggagatgatccggcggcagaacctggatggcaacctgagctttgtgatgtggggcctgaaggtgctgctgctgcctgtggtgtcctttgccctgtacccagaggagatcctggacacccactgggagctgtggaagaagacccacaggaagcagtacaacaacaaggtggatgagatcagcagaagactcatctgggagaagaacctgaagtacatcagcatccacaacctggaggccagcctgggcgtgcacacctatgagctggccatgaaccacctgggggacatgaccagcgaggaggtggtgcagaagatgacaggcctgaaggtgcccctgagccacagccgcagcaatgacaccctgtacatccctgagtgggagggccgggccccagattctgtggactacaggaagaagggctacgtgacccctgtgaagaaccagggccagtgtggcagctgctgggccttcagctctgtgggcgccctggagggccagctgaagaagaagacaggcaagctgctgaacctgagcccccagaacctggtggactgtgtgtctgaaaatgatggctgcggcggcggctacatgaccaatgccttccagtatgtgcagaagaacagaggcatcgacagtgaagattag

SEQ ID NO: 146530 - DNA, 1005 bp, Artificial Sequence
  Description of Artificial Sequence: Synthetic coding sequence
atgaacctgagcctggtgctggccgccttctgcctgggcatcgccagcgctgtgcccaagtttgaccagaacctggacaccaagtggtaccagtggaaggccacccacagaagactctacggggccaatgaggagggctggaggagagctgtgtgggagaagaacatgaagatgattgagctgcacaatggagagtacagccagggcaagcacggcttcaccatggccatgaatgccttcggggacatgaccaatgaggagttccggcagatgatgggctgcttcaggaaccagaagttcaggaagggcaaggtgttccgggagcccctcttcctggacctgcccaagtctgtggactggaggaagaagggctacgtgacccctgtgaagaaccagaagcagtgtggcagctgctgggccttcagcgccaccggggccctggagggccagatgttcaggaagacaggcaagctggtgtccctgtctgagcagaacctggtggactgcagccggccccagggcaaccagggctgcaatggaggcttcatggcccgggccttccagtatgtgaaggaaaatggaggcctggacagcgaggagagctacccctacgtggccgtggatgagatctgcaagtacagacctgagaacagcgtggccaatgacaccggcttcaccgtggtggcccctgggaaggagaaggccctgatgaaggctgtggccaccgtgggccccatctctgtggccatggatgctggccacagcagcttccagttctacaagagcggcatctactttgagccagactgcagcagcaagaacctggaccatggagtgctggtggtgggctacggctttgagggcgccaacagcaacaacagcaagtactggctggtgaagaacagctggggccctgagtggggcagcaatggctacgtgaagatcgccaaggacaagaacaaccactgcggcatcgccacagctgccagctacccaaatgtgtag

SEQ ID NO: 146531 - DNA, 1005 bp, Artificial Sequence; identical to SEQ ID NO: 146530
  Description of Artificial Sequence: Synthetic coding sequence

SEQ ID NO: 146532 - DNA, 996 bp, Artificial Sequence
  Description of Artificial Sequence: Synthetic coding sequence
atgaagaggctggtgtgtgtgctgctggtgtgcagcagcgctgtggcccagctgcacaaggaccccaccctggaccaccactggcacctgtggaagaagacctacggcaagcagtacaaggagaagaatgaggaggccgtgcggcggctcatctgggagaagaacctgaagtttgtgatgctgcacaacctggagcacagcatgggcatgcacagctatgacctgggcatgaaccacctgggggacatgaccagcgaggaggtgatgagcctgatgagcagcctgcgggtgcccagccagtggcagaggaacatcacctacaagagcaaccccaaccgcatcctgcctgacagcgtggactggagggagaagggctgtgtgacagaggtgaagtaccagggcagctgtggggcctgctgggccttctctgctgtgggcgccctggaggcccagctgaagctgaagacaggcaagctggtgtccctgagcgcccagaacctggtggactgcagcacagagaagtatggcaacaagggctgcaatggaggcttcatgaccacagccttccagtacatcatcgacaacaagggcatcgacagtgatgccagctacccctacaaggccatggaccagaagtgccagtatgacagcaagtacagagctgccacctgcagcaagtacacagagctgccctacggcagagaagatgtgctgaaggaggccgtggccaacaagggccctgtgtctgtgggcgtggatgcccggcaccccagcttcttcctgtaccgcagcggcgtgtactatgagcccagctgcacccagaatgtgaaccacggcgtgctggtggtgggctatggagacctgaatggcaaggagtactggctggtgaagaacagctggggccacaactttggagaggagggctacatccgcatggccaggaacaagggcaaccactgcggcatcgccagcttccccagctacccagagatctag

SEQ ID NO: 146533 - DNA, 846 bp, Artificial Sequence
  Description of Artificial Sequence: Synthetic coding sequence
atgaagaggctggtgtgtgtgctgctggtgtgcagcagcgctgtggcccagctgcacaaggaccccaccctggaccaccactggcacctgtggaagaagacctacggcaagcagtacaaggagaagaatgaggaggccgtgcggcggctcatctgggagaagaacctgaagtttgtgatgctgcacaacctggagcacagcatgggcatgcacagctatgacctgggcatgaaccacctgggggacatgggcagctgtggggcctgctgggccttctctgctgtgggcgccctggaggcccagctgaagctgaagacaggcaagctggtgtccctgagcgcccagaacctggtggactgcagcacagagaagtatggcaacaagggctgcaatggaggcttcatgaccacagccttccagtacatcatcgacaacaagggcatcgacagtgatgccagctacccctacaaggccatggaccagaagtgccagtatgacagcaagtacagagctgccacctgcagcaagtacacagagctgccctacggcagagaagatgtgctgaaggaggccgtggccaacaagggccctgtgtctgtgggcgtggatgcccggcaccccagcttcttcctgtaccgcagcggcgtgtactatgagcccagctgcacccagaatgtgaaccacggcgtgctggtggtgggctatggagacctgaatggcaaggagtactggctggtgaagaacagctggggccacaactttggagaggagggctacatccgcatggccaggaacaagggcaaccactgcggcatcgccagcttccccagctacccagagatctag

SEQ ID NO: 146534 - DNA, 1131 bp, Artificial Sequence
  Description of Artificial Sequence: Synthetic coding sequence
atggccctgacagcccaccccagctgcctgctggccctgctggtggccggcctggcccagggcatccggggccccctgcgggcccaggacctgggcccccagcccctggagctgaaggaggccttcaagctgttccagatccagttcaacagaagctacctgagccctgaggagcacgcccaccggctggacatctttgcccacaacctggcccaggcccagaggctgcaggaggaggacctgggcacagctgagtttggagtgacccccttcagtgacctgacagaggaggagtttggccagctgtatggctaccgccgggctgctggaggagtgcccagcatgggccgggagatccgctctgaggagcctgaggagagcgtgcccttcagctgtgactggaggaaggtggccagcgccatcagccccatcaaggaccagaagaactgcaactgctgctgggccatggctgctgctggcaacatcgagaccctgtggaggatctccttctgggactttgtggatgtgtctgtgcaggagctgctggactgtggccgctgtggagatggctgccacggcggctttgtgtgggatgccttcatcaccgtgctgaacaacagcggcctggccagcgagaaggactaccccttccagggcaaggtgcgggcccaccgctgccaccccaagaagtaccagaaggtggcctggatccaggacttcatcatgctgcagaacaatgagcaccgcatcgcccagtacctggccacctacggccccatcaccgtgaccatcaacatgaagcccctgcagctgtacaggaagggcgtcatcaaggccacccccaccacctgtgacccccagctggtggaccacagcgtgctgctggtgggcttcggctctgtgaagtctgaggagggcatctgggccgagaccgtgagcagccagagccagccccagcccccccaccccaccccctactggatcctgaagaacagctggggcgcccagtggggcgagaagggctacttccggctgcaccggggcagcaacacctgtggcatcaccaagttccccctgacagcccgggtgcagaagccagacatgaagccccgggtgtcctgccccccatag

SEQ ID NO: 146535 - DNA, 2679 bp, Artificial Sequence
  Description of Artificial Sequence: Synthetic coding sequence
atgacagaccccttctgtgtgggcggccggcggctgcccggcagcagcaagagcggccctgggaaggatggcagcaggaaggaggtgcggctgcccatgctgcatgacccccccaagatgggcatgcctgtggtgcggggcggccagacagtgcccggccaggcccccctgtgctttgatcctggcagccctgccagtgacaagacagagggcaagaagaagggccggcccaaggccgagaaccaggccctgcgggacatccccctgagcctgatgaatgactggaaggatgagttcaaggcccacagccgggtgaagtgccccaacagcggctgctggctggagttccccagcatctacggcctgaagtaccactaccagcgctgccagggcggggccatcagtgaccggctggccttcccctgccccttctgtgaggccgccttcaccagcaagacccagctggagaagcaccgcatctggaaccacatggaccggcccctgcctgccagcaagccaggccccatcagcaggcctgtgaccatcagcaggcctgtgggcgtgtccaagcccatcggcgtgtccaagcctgtgaccatcggcaagcctgtgggcgtgtccaagcccatcggcatcagcaagcctgtgtctgtgggccggcccatgcctgtgaccaaggccatccctgtgaccaggcctgtgcctgtgaccaagcctgtgacagtgtcccggcccatgcctgtgaccaaggccatgcctgtgaccaagcccatcaccgtgaccaagtctgtgcctgtgaccaagcctgtgcctgtgaccaagcccatcaccgtgaccaagctggtgacagtgaccaagcctgtgcctgtgaccaagcctgtgacagtgtcccggcccatcgtggtgtccaagcctgtgacagtgtcccggcccatcgccatcagccgccacaccccaccctgcaagatggtgctgctgaccaggtctgagaacaaggccccccgggccactggaagaaattctgggaagaagagagctgctgacagcctggacacctgccccatcccccccaagcaggcccggccagaaaatggagaatatggccccagctccatgggccagagcagcgccttccagctgtctgctgacaccagcagcggcagcctgagccctggcagccggcccagcggcggcatggaggccctgaaggctgctggccctgccagccccccagaagaagatcctgagaggaccaagcacaggaggaagcagaagacccccaagaagttcaccggggagcagcccagcatcagcggcaccttcggcctgaagggcctggtgaaggccgaggacaaggcccgggtgcacaggagcaagaagcaggagggccctggcccagaagatgccaggaagaaggtgcctgctgcccccatcaccgtgtccaaggaggccccagcccctgtggcccacccagcccctgggggccctgaggagcagtggcagagggccatccacgagcggggggaggccgtgtgccccacctgcaatgtggtgaccaggaagaccctggtgggcctgaagaagcacatggaggtgtgccagaagctgcaggatgccctgaagtgccagcactgcaggaagcagttcaagagcaaggccggcctgaactaccacaccatggccgagcacagcgccaagcccagtgatgctgaggccagcgagggcggggagcaggaggagcgggagcggctgaggaaggtgctgaagcagatgggccgcctgcgctgcccccaggagggctgtggggccgccttcagcagcctgatgggctaccagtaccaccagaggcgctgtgggaagccaccctgtgaggtggacagccccagcttcccctgcacccactgcggcaagacctaccgcagcaaggccggccatgactaccacgtgcgctctgagcacacagcccctcctcctgaggagcccacagacaagagccctgaggccgaggaccccctgggcgtggagaggaccccatctggccgggtgcggaggaccagcgcccaggtggccgtgttccacctgcaggagattgctgaagatgagctggcccgggactggaccaagaggaggatgaaggatgacctggtgcctgagacagcccggctgaactacaccaggcctggcctgcccaccctgaacccccagctgctggaggcctggaagaatgaggtgaaggagaagggccacgtgaactgccccaatgactgctgtgaggccatctacagctctgtgtctggcctgaaggcccacctggccagctgcagcaagggggcccacctggccggcaagtaccgctgcctgctgtgccccaaggagttcagcagcgagagcggcgtgaagtaccacatcctgaagacccatgctgagaactggttccgcaccagcgctgaccccccacccaagcacaggagccaggacagcctggtgcccaagaaggagaagaagaagaacctggccggcggcaagaagaggggcaggaagcccaaggagaggaccccagaggagcctgtggccaagctgcccccaagaagagatgactggcccccaggctgccgggacaagggggcccggggcagcacaggcaggaaggtgggcgtgtccaaggcccctgagaagtag

SEQ ID NO: 146536 - DNA, 2343 bp, Artificial Sequence
  Description of Artificial Sequence: Synthetic coding sequence
atggaccagaacagcgtgcctgagaaggcccagaatgaggccgacaccaacaatgctgaccgcttcttccgcagccacagcagccccccccaccaccggcccggccacagccgggccctgcaccactatgagctgcaccaccacggcgtgccccaccagagaggagagagccaccaccccccagagttccaggacttccatgaccaggccctgagcagccacgtgcaccagagccaccaccacagcgaggccagaaatcatggccgggcccacggccccaccggcttcggcctggcccccagccagggcgctgtgcccagccacaggagctatggagaggactaccatgatgagctgcagagagatggccgccgccaccatgatggcagccagtatggaggcttccaccagcagagcgacagccactaccaccggggcagccaccacggccggccccagtacctgggggagaacctgagccactacagcagcggcgtgccccaccacggggaggccagccaccacggcggcagctacctgccccacggccccaacccctacagcgagagcttccaccacagcgaggccagccacctgagcggcctgcagcatgatgagagccagcaccaccaggtgccccaccggggctggccccaccaccaccaggtgcaccaccacggccgcagccgccaccacgaggcccaccagcacggcaagagcccccaccacggggagaccatcagcccccacagctctgtgggcagctaccagaggggcatcagtgactaccacagcgagtaccaccagggcgaccaccaccccagcgagtaccaccacggggaccacccccaccacacccagcaccactaccaccagacccaccgccaccgggactaccaccagcaccaggaccaccacggggcctaccacagcagctacctgcatggagactatgtgcagagcaccagccagctgagcatcccccacaccagccgcagcctcatccatgatgcccctggccctgctgccagcaggactggagtcttcccctaccacgtggcccacccccggggcagcgcccacagcatgaccaggagcagcagcaccatccgcagccgggtgacccagatgagcaagaaggtgcacacccaggacatcagcaccaagcacagcgaggactggggcaaggaggagggccagttccagaagaggaagacaggccgcctgcagaggaccaggaagaagggccacagcaccaacctcttccagtggctgtgggagaagctgaccttcctgatccagggcttccgggagatgatccggaacctgacccagagcctggcctttgagaccttcatcttctttgtggtgtgcctgaacacagtgatgctggtggcccagacctttgctgaggtggagatccggggggagtggtacttcatggccctggacagcatcttcttctgcatctacgtggtggaggccctgctgaagatcatcgccctgggcctgagctacttctttgacttctggaacaacctggacttcttcatcatggccatggctgtgctggacttcctgctgatgcagacccacagctttgccatctaccaccagagcctcttccgcatcctgaaggtgttcaagagcctgcgggccctgcgggccatccgggtgctgcggcggctgtccttcctgacctctgtgcaggaggtgacaggcaccctgggccagagcctgcccagcattgctgccatcctgatcctgatgttcacctgcctcttcctgttctctgctgtgctgcgggccctcttcaggaagagtgaccccaagcgcttccagaacatcttcaccaccatcttcaccctcttcaccctgctgaccctggatgactggagcctcatctacatggacagccgggcccagggcgcctggtacatcatccccatcctggtgatctacatcatcatccagtacttcatcttcctgaacctggtgatcaccgtgctggtggacagcttccagacagccctcttcaagggcctggagaaggccaagcaggagcgggccgcccgcatccaggagaagctgctggaggacagcctgacagagctgcgggctgctgagcccaaggaggtggccagcgagggcaccatgctgaagaggctcatcgagaagaagtttggcaccatgacagagaagcagcaggagctgctcttccactacctgcagctggtggcctctgtggagcaggagcagcagaagttccgcagccaggccgctgtgattgatgagatcgtggacaccacctttgaagctggggaggaggacttcagaaattag

SEQ ID NO: 146537 - DNA, 1197 bp, Artificial Sequence
  Description of Artificial Sequence: Synthetic coding sequence
atgagccagcaccgccaccagaggcacagcagggtcatcagcagcagccctgtggacaccacctctgtgggcttctgccccaccttcaagaagttcaagagaaatgatgatgagtgccgggcctttgtgaagagggtcatcatgagccgcttcttcaagatcatcatgatcagcacagtgaccagcaatgccttcttcatggccctgtggaccagctatgacatccgctaccgcctcttccggctgctggagttcagcgagatcttctttgtgtccatctgcaccagcgagctgtccatgaaggtgtatgtggaccccatcaactactggaagaatggctacaacctgctggatgtgatcatcatcatcgtgatgttcctgccctatgccctgcggcagctgatgggcaagcagttcacctacctgtacatcgcagatggcatgcagagcctgcgcatcctgaagctgattggctacagccagggcatccgcaccctcatcacagctgtgggccagacagtgtacacagtggcctctgtgctgctgctgctcttcctgctgatgtacatctttgccatcctgggcttctgcctgtttggcagcccagacaacggggaccatgacaactggggcaacctggccgccgccttcttcaccctcttcagcctggccaccgtggatggctggacagacctgcagaagcagctggacaaccgggagtttgccctgagccgggccttcaccatcatcttcatcctgctggccagcttcatcttcctgaacatgtttgtgggcgtgatgatcatgcacacagaggacagcatcaggaagtttgagcgggagctgatgctggagcagcaggagatgctgatgggagagaagcaggtgatcctgcagaggcagcaggaggagatcagccggctgatgcacatccagaagaatgctgactgcaccagcttcagcgagctggtggagaacttcaagaagaccctgagccacacagaccccatggtgctggatgactttggcaccagcctgcccttcatcgacatctacttcagcaccctggactaccaggacaccaccgtgcacaagctgcaggagctgtactatgaaattgtgcacgtgctgagcctgatgctggaggacctgccccaggagaagccccagagcctggagaaggtggatgagaagtag

SEQ ID NO: 146538 - DNA, 1419 bp, Artificial Sequence
  Description of Artificial Sequence: Synthetic coding sequence
atgagggacaatgagaaggcctggtggcagcagtggaccagccacacaggcctggagggctggggcggcacccaggaggacaggatgggctttggaggagctgtggccgccctgcggggccggcccagccccctgcagagcaccatccacgagagctatggccggcctgaggagcaggtgctgatcaaccggcaggagatcaccaacaaggcagatgcctgggacatgcaggagttcatcacccacatgtacatcaagcagctgctgcggcacccagccttccagctgctgctggccctgctgctggtgatcaatgccatcaccatcgccctgcggaccaacagctacctggaccagaagcactatgagctgttcagcaccattgatgacatcgtgctgaccatcctgctgtgtgaggtgctgctgggctggctgaatggcttctggatcttctggaaggatggctggaacatcctgaacttcatcatcgtgttcatcctgctgctgcgcttcttcatcaatgagatcaacatccccagcatcaactacaccctgcgggccctgcggctggtgcacgtgtgcatggctgtggagcccctggcccgcatcatccgggtcatcctgcagagcgtgcctgacatggccaacatcatggtgctgatcctcttcttcatgctggtgttttctgtgtttggagtgaccctgtttggagcctttgtgcccaagcacttccagaacatccaggtggccctgtacaccctcttcatctgcatcacccaggacggctgggtggacatctacagcgacttccagacagagaagcgggagtatgccatggagattggaggagccatctacttcaccatcttcatcaccatcggggccttcatcggcatcaacctcttcgtcatcgtggtgaccaccaacctggagcagatgatgaaggccggggagcagggccagcagcagaggatcaccttcagcgagaccggggctgaggaggaggaggagaatgaccagctgcccctggtgcactgtgtggtggcccggtctgagaagagcggcctgctgcaggagcccctggccggcggccccctgagcaacctgtctgagaacacctgtgacaacttctgcctggtgctggaggccatccaggagaacctgcggcagtacaaggagatcagagatgagctgaacatgattgtggaggaggtgcgggccatccgcttcaaccaggagcaggagagcgaggtgctgaacagaagaagcagcaccagcggcagcctggagaccaccagcagcaaggacatccggcagatgagccagcagcaggacctgctgagcgccctggtgtccatggagaaggtgcatgacagcagcagccagatcctgctgaagaagcacaagagcagccactag

SEQ ID NO: 146539 - DNA, 3351 bp, Artificial Sequence
  Description of Artificial Sequence: Synthetic coding sequence
atggagagccccctcatctacgtgtctgtgctgctgctgaacatctttgagttcagcagcggcatcgtgtacaacaaggatgacacagagaagagatttgcctgcagcaacaagggcttcccccaggagaatgagatcatcaagctgtacctgttcctggagaacctgaagatccagtgcttcttccagacagaaaatgagatcgccagcaaggccatgctgtctgtgttcaccagcggcggcctggcccccagcctgggcatcatgaacagcacctacaacggcatcttccacttcaacctgaccctcttcagtgaccgcatcctgtggctggtggacatcccccgggagaacatcacccagagcacagacattgctgctgtggaggagtggctggtgcgcatcaccctgcaccacggcctgaacatctatgccacagagggcaccctgctggatgtgatccgggagcccatcctgcagtggaccccaggagatgtgattcctgagagcgagatcagcaagctgtacccccacgtggtggacctgaaggtgaccaagtgcccctgtgccaatgatgtggccctgctgggcttcatcgtggacaccatcgtggatggagtgtacatcggcatcacctttggaggcttctggcatgactatgacaccacctggttcaacatgacccagaccatctacagccagctgcaggaggagtatgaggacctgagcctggtggacatggtgctgaccaaccacttcctggtgatcctgaccagcctgggcctgtttgtgtctgaggacctgcgctaccccagccgccacagcctgtccttcagcagagctgacttctgtggctttgagcgggtggactatgtgaagggcaagctgtggtacaatgaacgctgctttgccaaccgggagcactttgaggtggactatgtgacagtgacctttgagaggaacagaaccctgtctgagagcagcagctgcttctacagccaggagcccttcctggagtgggtgccctgcctgccccacatcttcaagggcatcaagatcttccccaccgtgctgaccttcctggtggaccaggagcggggcaccggggtgtacctgttctacaacaaggtgaggaagacagccatcgcctctgtgtccaccctgagaaataatgagcccaacagccagagcaagttccccatcttccgcttccccagcagcttcagcagccctgtgggcatggtgttccaccccaggagccacttcctgtatgcctacggcaaccagatctggctgtctgtggatggcggcaacaccttccagctgattgccaacttccatgatgacatcatcaagaagaccttccacagcttctacaccagcgccatcacctttgtgtcccagaggggcaaggtgtacagcaccaaggccggcatgggccgctacagcgctgtgggctctgtgacagagcgcatcttcaccctgtactatgaccacctgggcttcctgcacaagctgaccctgggccgctttgaggccagcggccccccaacagccttcggcaacagcaggaacctgtttggccagcccccagacatgggctttgaaacagccctggccccccagcacaccagcctggatgagatcatcttctttgcctacgtgcctgaaaatgagccccaggagaccatctacagcaagaagtttggaaacatccactacggcaaggtgatccacagcggcaagacaggccgggcctacatcaggaaggtgctgcagcacaccacccccaagggcttcctgagctctgtgattgctgagatgaaggagcccttcggcctggaggaggtgaatgaaagcagctgcctgagcagcagcctgctgatcaacaaggctggaaatgtgtacaagctgaccctggacagccaggtggtgcaggccctgtttgaggacacagacatcgagaagacagtggtgctgcccggctacagcagcttcctgatcaccagcatcctggacaacaagaatgccctggccatcgccaccatgcctgagagcgcccccaacaacatgaccttcctgaagagcacctggttcctgtacaactttggccagagaaatggaagaacctggaagatctacagcaagccctgcaactactggttccagcatgatgacagccccagcctgaacatcgtgaagtacatcgacctgggcaacagctatgtgctgaaggccaaggtgatcagaaatgccaagggcttcaggatgctggagatccccctgctgactgtgtttgtgggcaaccccaacctgctggaggtgacagctgaggtgacctttgatgacacagacagctatgtgatcaccatctctgctgccagcaaggtgctgcaccagggcagcaccagcctggccttcatcatgtggagcgccagcacagaatgttttgtgaccaccatggtgcccaccctgaagagcagctgcagctacctgcgctccatgcaccacatccccagcaagttcatcccctttgaggactggatcagcggcgtgcacaaggacagccagggcttcaacctgatcaagaccctgcccatcaactacagaccacccagcaacatgggcatcgccatccccctgacagacaacttctaccacgccgaccccagcaagcccatccccaggaacatgttccacatgagcaagaagacaggcaagttcaagcagtgtgccaacgtgtccacccgggaggagtgcaactgcaccaaggaccagaagttcagccatgctgtggccttcagtgactgccgggagaaggtgccccgcttcaagttccccatcacccagtaccctgtgtccctggagatcatcaatgaagatggccgggtgcccctgcagagcccctacctggtgacagtgacagaggtgaacatgaggcacaactggaagctgaagcacacagtgcctgagaacatcaagaggatgaagcagctggtggagcccatcctgggcgctgctgtgtacaaccccagcggcctgaacctgagcatcaagggcagcgagctgttccacttccgggtgaccgtcatcagcggcgtgaccttctgcaacctgattgaggagttccagatctacgtggatgaggcccccctgcccttccctggccacaccctgattgctgtggccacagctgtggtgctgggcggcctcatcttcatcgccttcatgttccagctgcagggcatccacccctggaggaccttccagcgctggatcagaagaaaccaggagaagttcagcagcatcagcctgtctgagctgatccacaggagcaagtctgaggagtag

SEQ ID NO: 146540 - DNA, 225 bp, Artificial Sequence
  Description of Artificial Sequence: Synthetic coding sequence
atggagagccccctcatctacgtgtctgtgctgctgctgaacatctttgagttcagcagcggcatcgtgtacaacaaggatgacacagagaagagatttgcctgcagcaacaagggcttcccccaggagaatgagatcatcaagctgtacctgttcctggagaacctgaagatccagtgcttcttccagacagaaaatgagatcgccagcaaggccatgctgtag

SEQ ID NO: 146541 - DNA, 303 bp, Artificial Sequence
  Description of Artificial Sequence: Synthetic coding sequence
atggagagccccctcatctacgtgtctgtgctgctgctgaacatctttgagttcagcagcggcatcgtgtacaacaaggatgacacagagaagagatttgcctgcagcaacaagggcttcccccaggagaatgagatcatcaagctgtacctgttcctggagaacctgaagatccagtgcttcttccagacagaaaatgagatcgccagcaaggccatgctgtctgtgttcaccagcggcggcctggcccccagcctgggcatcatgaacagcacctacaacggcatcttccacttcaactag

SEQ ID NO: 146542 - DNA, 225 bp, Artificial Sequence; identical to SEQ ID NO: 146540
  Description of Artificial Sequence: Synthetic coding sequence

SEQ ID NO: 146543 - DNA, 795 bp, Artificial Sequence
  Description of Artificial Sequence: Synthetic coding sequence
atgcacaacccagatggcagcgccagccccacagctgaccccggcagcgagctgcagaccctgggccaggccgcccggcggcccccaccacccagggctggccatgatgcccccaggaggacccggcccagcgccaggaagcccctgagctgcttcagccggcggcccatgcccacccgggagccccccaagacccggggcagccggggccacctgcacacccaccccccaggccctggcccccccctgcagggcctggccccccggggcctgaagaccagcgccccccggcccccctgccagccccagcccggcccccacaaggccaagaccaagaagatcgtgtttgaagatgagctgctgagccaggccctgctgggcgccaagaagcccatcggggccatccccaagggccacaagccccggccccaccctgtgcctgactatgagctgaagtacccacctgtgagcagcgagcgggagaggagccgctacgtggccgtgttccaggaccagtatggagagttcctggagctgcagcacgaggtgggctgtgcccaggccaagctgcggcagctggaggccctgctgagcagcctgcccccaccccagagccagaaggaggcccaggtggccgcccgggtgtggagggagtttgagatgaagaggatggaccccggcttcctggacaagcaggcccgctgccactacctgaagggcaagctgcggcacctgaagacccagatccagaagtttgatgaccagggcgacagcgagggctctgtgtacttctag

SEQ ID NO: 146544 - DNA, 3480 bp, Artificial Sequence
  Description of Artificial Sequence: Synthetic coding sequence
atgtgtggccctgccatgtttcctgctggccccccctggccccgggtgcgggtggtgcaggtgctgtgggccctgctggccgtgctgctggcctcctggaggctgtgggccatcaaggacttccaggagtgcacctggcaggtggtgctgaatgagttcaagagggtgggggagagcggcgtgtctgacagcttctttgagcaggagcctgtggacacagtgagcagcctcttccacatgctggtggacagccccatcgaccccagcgagaagtacctgggcttcccctactacctgaagatcaactacagctgtgaggagaagcccagcgaggacctggtgaggatgggccacctgaccggcctgaagcccctggtgctggtgaccttccagagccctgtgaacttctaccgctggaagattgagcagctgcagatccagatggaggccgcccccttccgcagcaaggagccctgcatggccgaggaggtgtgcagcatgtcctggtacacccccatgcccatcaagaagggctctgtggtgatgagggtggacatcagcagcaatggcctgggcaccttcatcccagacaagcgcttccagatgaacatcaatggcttcctgaagagggaccgggacaacaacatccagttcaccgtgggggaggagctgttcaacctgatgccccagtactttgtgggcgtgagcagccggcccctgtggcacacagtggaccagagccctgtgctgatcctgggcggcatccccaatgagaagtatgtgctgatgacagacaccagcttcaaggacttcagcctggtggagctgagcattgacagctgctgggtgggcagcttctactgcccccacagcggcttcaccgccaccatctatgacaccatcgccacagagagcaccctcttcatccggcagaaccagctggtgtactacttcaccggcacctacaccaccctgtatgaaagaaacagaggcagcggctcctggatccgggtgctggccagcgagtgcatcaagaagctgtgccctgtgtacttccacagcaatggaagtgagtacatcatggccctgaccaccgggaagcatgagggctacgtgcacttcggcaccatcagagatggccaggtgtcctttgagatgctgccccggcagtggagcgtgtgtgagcagattggagtgaccacctgcagcatcatctggagcgagtacatcgccggggagtacaccctgctgctgctggtggagagcggctatggaaatgccagcaagcgcttccaggtggtgtcctacaacacagccagtgatgacctggagctgctgtaccacatccctgagttcatccctgaggcccggggcctggagttcctgatgatcctgggcacagagagctacaccagcacagccatggcccccaagggcatcttctgcaacccctacaacaacctgatcttcatctggggcaacttcctgctgcagagcagcaacaaggagaacttcatctacctggccgacttccccaaggagctgagcatcaagtacatggcccgctccttcagaggagctgtggccatcgtgacagaaacagaggagatctggtacctgctggagggcagctacagagtgtaccagctgttccccagcaagggctggcaggtgcacatcagcctgaagctgatgcagcagagcagcctgtatgccagcaatgagaccatgctgaccctcttctatgaggacagcaagctgtaccagctggtgtacctgatgaacaaccagaagggccagctggtgaagaggctggtgcctgtggagcagctgctgatgtaccagcagcacaccagccactatgacctggagaggaagggcggctacctgatgctgtccttcatcgacttctgccccttctctgtgatgaggctgcggagcctgcccagcccccagcgctacacccggcaggagcgctaccgggcccggcccccccgggtgctggagaggagcggcttccacaatgaaaacagcctggccatctaccagggcctggtgtactacctgctgtggctgcacagcgtgtatgacaagccctatgctgaccctgtgcatgaccccacctggcgctggtgggccaacaacaagcaggaccaggactactacttcttcctggccagcaactggaggtctgctgggggcgtgtccattgagatggacagctatgagaagatctacaacctggagagcgcctatgagctgcctgagcgcatcttcctggacaagggcacagagtacagctttgccatcttcctgagcgcccagggccacagcttccgcacccagagcgagctgggcacagccttccagctgcacagccaggtggatgtgggcgtggtgctggccgaccccggctgcatcgaggcctctgtgaagcaggaggtgctgatcaacagaaattctgtgctcttcagcatcaccctgaaggacaagaagctgtgctatgaccagggcatcagcggccaccacctgatggagacctccatgacagtgaatgtggtgggcagcagcggcctgtgcttccaggagacccacctgggcccccacatgcagggcaacctgatggtgcctgtgttcatcggctgccccccaggcaagaggctggcctttgacatcacctacaccctggagtacagccggctgaagaacaagcactactttgactgtgtgaatgtgaaccctgagatgccctgcttcctgttccgggacatcttctaccccttcttcctgatccaggacctggtgactggagacagcggcagcttccagggcagctatgtgctgctggtggtgggcggcggccccaccctggacagcctgaaggactacagtgaagatgagatctaccgcttcaacagccccctggacaagaccaacagcctcatctggaccaccaggaccaccaggaccaccaaggacagcgccttccacatcatgagccatgagagccctggcatcgagtggctgtgcctggagaatgccccctgctatgacaacgtgccccagggcatctttgcccctgagttcttcttcaaggtgctggtgagcaacagaggagtggacaccagcacctactgcaactaccagctgaccttcctgctgcacatccacggcctgcccctgagccccaagagggccctcttcatcatcatggtgtctgcctctgtgtttgtgggcctggtgatcttctacatcgccttctgcctgctgtggcccctggtggtgaagggctgcaccatgatccgctggaagatcaacaacctgattgccagcgagagctactacacctacgccagcatcagcggcatcagctccatgcccagcctgcggcacagcaggatgggctccatgttcagcagcaggatgacagaggacagagctgagcccaaggaggccgtggagcggcagctgatgacctag

SEQ ID NO: 146545 - DNA, 3480 bp, Artificial Sequence; identical to SEQ ID NO: 146544
  Description of Artificial Sequence: Synthetic coding sequence

SEQ ID NO: 146546 - DNA, 1983 bp, Artificial Sequence
  Description of Artificial Sequence: Synthetic coding sequence
atggatgtgctggtgtctgaatgttctgcccggctgctgcagcaggaggaggagatcaagagcctgacagctgagattgaccggctgaagaactgtggctgcctgggcgccagccccaacctggagcagctgcaggaggagaacctgaagctgaagtaccgcctgaacatcctgaggaagagcctgcaggccgagaggaacaagcccaccaagaacatgatcaacatcatcagccggctgcaggaggtgtttggccacgccatcaaggccgcctacccagacctggagaacccccccctgctggtgacccccagccagcaggccaagtttggagactaccagtgcaacagcgccatgggcatcagccagatgctgaagaccaaggagcagaaggtgaacccccgggagattgctgagaacatcaccaagcacctgcctgacaatgaatgtattgagaaggtggagattgctggccctggcttcatcaacgtgcacctgaggaaggactttgtgtctgagcagctgaccagcctgctggtgaatggagtgcagctgcctgccctgggggagaacaagaaggtgattgtggacttcagcagccccaacatcgccaaggagatgcacgtgggccacctgcggagcaccatcattggagagagcatcagccggctgtttgaatttgctggctatgatgtgctgcggctgaaccacgtgggggactggggcacccagtttggcatgctgattgcccacctgcaggacaagttcccagactacctgactgtgagcccccccatcggggacctgcaggtgttctacaaggagagcaagaagagatttgacacagaggaggagttcaagaagagggcctaccagtgtgtggtgctgctgcagggcaagaacccagacatcaccaaggcctggaagctgatctgtgatgtgtcccggcaggagctgaacaagatctatgatgccctggatgtgtccctgattgagcggggggagagcttctaccaggacaggatgaatgacatcgtgaaggagtttgaggaccggggctttgtgcaggtggatgatggcaggaagatcgtgtttgtgcccggctgcagcatccccctgaccatcgtgaagagtgatggcggctacacctatgacaccagtgacctggccgccatcaagcagaggctgtttgaggagaaggctgacatgatcatctacgtggtggacaatggccagagcgtgcacttccagaccatctttgctgctgcccagatgattggctggtatgaccccaaggtgaccagggtcttccacgccggctttggagtggtgctgggggaggacaagaagaagttcaagaccaggtctggagaaacagtgcggctgatggacctgctgggggagggcctgaagaggtccatggacaagctgaaggagaaggagcgggacaaggtgctgacagctgaggagctgaatgctgcccagacctctgtggcctacggctgcatcaagtatgctgacctgagccacaaccggctgaatgactacatcttctcctttgacaagatgctggatgaccggggcaacacagctgcctacctgctgtatgccttcacccgcatccgcagcatcgcccggctggccaacattgatgaggagatgctgcagaaggccgcccgggagaccaagatcctgctggaccacgagaaggagtggaagctgggccgctgcatcctgcgcttccctgagatcctgcagaagatcctggatgacctcttcctgcacaccctgtgtgactacatctatgagctggccacagccttcacagagttctatgacagctgctactgtgtggagaaggaccggcagacaggcaagatcctgaaggtgaacatgtggaggatgctgctgtgtgaggccgtggccgctgtgatggccaagggctttgacatcctgggcatcaagcctgtgcagaggatgtag

SEQ ID NO: 146547 - DNA, 465 bp, Artificial Sequence
  Description of Artificial Sequence: Synthetic coding sequence
atgtgctggacccgcatccggcccggcacccccagcagccctggggcccagaggcccaccccctatgagtggatgagaagatctgtggccgccggcggcggcggcggcagcggcaagaccaggaccaaggacaagtacagagtggtgtacacagaccaccagaggctggagctggagaaggagttccactacagccgctacatcaccatccggaggaagtctgagctggccgccaacctgggcctgacagagcggcaggtgaagatctggttccagaacagaagagccaaggagaggaaggtgaacaagaagaagcagcagcagcagcagcccccccagccccccatggcccatgacatcacagccaccccagctggccccagcctgggcggcctgtgccccagcaacaccagcctgctggccaccagcagccccatgcctgtgaaggaggagttcctgccctag

SEQ ID NO: 146548 - DNA, 183 bp, Artificial Sequence
  Description of Artificial Sequence: Synthetic coding sequence
atgagaggaggcccccggggccaccacgtgtgtggcctgtgtgccggccagggctttgcccgggtgccccggcccagccaggccagccagcccaggcctggccctgccagcctgtgccccagcaacaccagcctgctggccaccagcagccccatgcctgtgaaggaggagttcctgccctag

SEQ ID NO: 146549 - DNA, 942 bp, Artificial Sequence
  Description of Artificial Sequence: Synthetic coding sequence
atgtatgtgtcctacctgctggacaaggatgtgtccatgtaccccagctctgtgcgccacagcggcggcctgaacctggccccccagaactttgtgagccccccccagtacccagactatggaggctaccacgtggccgctgctgctgctgctgctgccaacctggacagcgcccagagccctggccccagctggccagctgcctatggagcccccctgcgggaggactggaatggctacgcccctgggggcgctgctgctgctgccaatgctgtggcccacggcctgaatggaggcagccctgctgctgccatgggctacagcagccctgctgactaccacccccaccaccacccccaccaccacccccaccaccctgctgctgcccccagctgtgccagcggcctgctgcagaccctgaaccctggccccccaggccctgctgccacagctgctgctgagcagctgagccctgggggccagaggaggaacctgtgtgagtggatgaggaagccagcccagcagagcctgggcagccaggtgaagaccaggaccaaggacaagtacagagtggtgtacacagaccaccagaggctggagctggagaaggagttccactacagccgctacatcaccatccggaggaaggccgagctggccgccaccctgggcctgtctgagcggcaggtgaagatctggttccagaacagaagagccaaggagaggaagatcaacaagaagaagctgcagcagcagcagcagcagcagcccccccagcccccacctcctccaccccagcccccccagccccagcccggccccctgcggtctgtgcctgagcccctgagccctgtgagcagcctgcaggcctctgtgcccggctctgtgcctggggtgctgggccccactggaggagtgctgaaccccaccgtgacccagtag

SEQ ID NO: 146550 - DNA, 855 bp, Artificial Sequence
  Description of Artificial Sequence: Synthetic coding sequence
atgtatggcagctgcctgctggagaaggaggccggcatgtacccaggcaccctgatgagccctggaggagatggaacagctggcactggaggcaccggcggcggcggcagccccatgcctgccagcaactttgctgctgccccagccttcagccactacatgggctacccccacatgcccagcatggacccccactggcccagcctgggcgtgtggggcagcccctacagccccccccgggaggactggagcgtgtacccaggccccagcagcaccatgggcaccgtgcctgtgaatgatgtgaccagcagccctgctgccttctgcagcacagactacagcaacctgggccctgtgggcggcggcaccagcggcagcagcctgcccggccaggccggcggcagcctggtgcccacagatgctggagctgccaaggccagcagccccagccgcagccgccacagcccctatgcctggatgaggaagacagtgcaggtgacaggcaagaccaggaccaaggagaagtacagagtggtgtacacagaccaccagaggctggagctggagaaggagttccactgcaaccgctacatcaccatccagaggaagtctgagctggccgtgaacctgggcctgtctgagcggcaggtgaagatctggttccagaacagaagagccaaggagaggaagatgatcaagaagaagatcagccagtttgagaacagcggcggctctgtgcagagcgacagcgacagcatcagccctggagagctgcccaacaccttcttcaccaccccatctgctgtgcggggcttccagcccatcgagatccagcaggtgattgtgtctgagtag

SEQ ID NO: 146551 - DNA, 456 bp, Artificial Sequence
  Description of Artificial Sequence: Synthetic coding sequence
atgatggccgaggagcacacagacctggaggcccagatcgtgaaggacatccactgcaaggagattgacctggtgaacagagaccccaagaacatcaatgaagacatcgtgaaggtggactttgaagatgtgattgctgagcctgtgggcacctacagctttgatggagtgtggaaggtgtcctacaccaccttcaccgtgtccaagtactggtgctaccgcctgctgagcaccctgctgggcgtgcccctggccctgctgtggggcttcctgtttgcctgcatctccttctgccacatctgggccgtggtgccctgcatcaagagctacctgattgagatccagtgcatcagccacatctacagcctgtgcatccgcaccttctgcaaccccctgtttgctgccctgggccaggtgtgcagcagcatcaaggtggtgctgaggaaggaggtgtag

SEQ ID NO: 146552 - DNA, 456 bp, Artificial Sequence; identical to SEQ ID NO: 146551
  Description of Artificial Sequence: Synthetic coding sequence

SEQ ID NO: 146553 - DNA, 813 bp, Artificial Sequence
  Description of Artificial Sequence: Synthetic coding sequence
atggctgaccacatgatggccatgaaccacggccgcttcccagatggcaccaacggcctgcaccaccacccagcccacaggatgggcatgggccagttccccagcccccaccaccaccagcagcagcagccccagcacgccttcaatgccctgatgggagagcacatccactacggggccggcaacatgaatgccaccagcggcatcagacatgccatgggccctggcaccgtgaatggaggccaccccccatctgccctggccccagctgcccgcttcaacaacagccagttcatgggcccccctgtggccagccagggcggcagcctgcctgcctccatgcagctgcagaagctgaacaaccagtacttcaaccaccacccctacccccacaaccactacatgccagacctgcaccctgctgctggccaccagatgaatggcaccaaccagcacttccgggactgcaaccccaagcacagcggcggcagcagcaccccaggcggcagcggcggcagcagcacccctgggggcagcggcagcagcagcggcggcggggccggcagcagcaacagcggcggcggcagcggcagcggcaacatgcctgcctctgtggcccacgtgcctgctgccatgctgccccccaacgtcatcgacacagacttcattgatgaggaggtgctgatgagcctggtgattgagatgggcctggaccgcatcaaggagctgcctgagctgtggctgggccagaatgaatttgacttcatgacagactttgtgtgcaagcagcagcccagccgggtgtcctgctag

SEQ ID NO: 146554 - DNA, 645 bp, Artificial Sequence
  Description of Artificial Sequence: Synthetic coding sequence
atggctgaccacatgatggccatgaaccacggccgcttcccagatggcaccaacggcctgcaccaccacccagcccacaggatgggcatgggccagttccccagcccccaccaccaccagcagcagcagccccagcacgccttcaatgccctgatgggagagcacatccactacggggccggcaacatgaatgccaccagcggcatcagacatgccatgggccctggcaccgtgaatggaggccaccccccatctgccctggccccagctgcccgcttcaacaacagccagttcatgggcccccctgtggccagccagggcggcagcctgcctgcctccatgcagctgcagaagctgaacaaccagtacttcaaccaccacccctacccccacaaccactacatgccagacctgcaccctgctgctggccaccagatgaatggcaccaaccagcacttccgggactgcaacccccccaacgtcatcgacacagacttcattgatgaggaggtgctgatgagcctggtgattgagatgggcctggaccgcatcaaggagctgcctgagctgtggctgggccagaatgaatttgacttcatgacagactttgtgtgcaagcagcagcccagccgggtgtcctgctag

SEQ ID NO: 146555 - DNA, 813 bp, Artificial Sequence; identical to SEQ ID NO: 146553
  Description of Artificial Sequence: Synthetic coding sequence

SEQ ID NO: 146556 - DNA, 813 bp, Artificial Sequence; identical to SEQ ID NO: 146553
  Description of Artificial Sequence: Synthetic coding sequence

SEQ ID NO: 146557 - DNA, 1797 bp, Artificial Sequence
  Description of Artificial Sequence: Synthetic coding sequence
atggagaacagcagcgctgccagcgccagcagcgaggccggcagcagccgcagccaggagattgaggagctggagcgcttcatcgacagctatgtgctggagtaccaggtgcagggcctgctggccgacaagacagaaggagatggagagagcgagaggacccagagccacatcagccagtggacagctgactgcagcgagcccctggacagcagctgcagcttcagccggggccgggccccaccccagcagaatggcagcaaggacaacagcctggacatgctgggcacagacatctgggccgccaacacctttgacagcttcagcggggccacctgggacctgcagcctgagaagctggacttcacccagttccacaggaaggtgcgccacacccccaagcagcccctgccccacatcgaccgggagggctgtgggaagggcaagctggaggatggagatggcatcaacctgaatgacatcgagaaggtgctgcctgcctggcagggctaccaccccatgcctcatgaggtggagatcgcccacaccaagaagctgttcagaagaagaagaaatgacagaagacggcagcagaggcctcctgggggcaacaagccccagcagcacggggaccaccagcccggcagcgccaagcacaacagagaccaccagaagagctaccagggcggcagcgccccccaccccagcggccggcccacccaccacggctacagccagaacagacgctggcaccacggcaacatgaagcaccccccaggggacaagggggaggccggggcccacagaaatgccaaggagaccatgaccatcgagaaccccaagctggaggacacagctggggacaccggccacagcagcctggaggcccccaggagcccagacaccctggcccctgtggccagcgagcggctgcccccccagcagagcggcggccctgaggtggagaccaagaggaaggacagcatcctgcctgagcgcatcggggagcggcccaagatcaccctgctgcagagcagcaaggaccggctgcggcggcggctgaaggagaaggatgaggtggccgtggagaccaccaccccccagcagaacaagatggacaagctgattgagatcctgaacagcatgaggaacaacagcagtgatgtggacaccaagctgaccaccttcatggaggaggcccagaacagcaccaacagcgaggagatgctgggggagatcgtgaggaccatctaccagaaggctgtgtctgacaggagctttgccttcaccgctgccaagctgtgtgacaagatggccctcttcatggtggagggcaccaagttccgcagcctgctgctgaacatgctgcagaaggacttcaccgtgcgggaggagctgcagcagcaggatgtggagcgctggctgggcttcatcaccttcctgtgtgaggtgtttggcaccatgaggagcagcactggagagcccttccgggtgctggtgtgccccatctacacctgcctgcgggagctgctgcagagccaggatgtgaaggaggatgctgtgctgtgctgcagcatggagctgcagagcacaggccgcctgctggaggagcagctgcctgagatgatgacagagctgctggccagcgcccgggacaagatgctgtgccccagcgagagcatgctgaccaggagcctgctgctggaggtgattgagctgcacgccaacagctggaaccccctgaccccacccatcacccagtactacaacagaaccatccagaagctgacagcctag

SEQ ID NO: 146558 - DNA, 1803 bp, Artificial Sequence
  Description of Artificial Sequence: Synthetic coding sequence
atggagaacagcagcgctgccagcgccagcagcgaggccggcagcagccgcagccaggagattgaggagctggagcgcttcatcgacagctatgtgctggagtaccaggtgcagggcctgctggccgacaagacagaaggagatggagagagcgagaggacccagagccacatcagccagtggacagctgactgcagcgagcccctggacagcagctgcagcttcagccggggccgggccccaccccagcagaatggcagcaaggacaacagcctggacatgctgggcacagacatctgggccgccaacacctttgacagcttcagcggggccacctgggacctgcagcctgagaagctggacttcacccagttccacaggaaggtgcgccacacccccaagcagcccctgccccacatcgaccgggagggctgtgggaagggcaagctggaggatggagatggcatcaacctgaatgacatcgagaaggtgctgcctgcctggcagggctaccaccccatgcctcatgaggtggagatcgcccacaccaagaagctgttcagaagaagaagaaatgacagaagacggcagcagaggcctcctgggggcaacaagccccagcagcacggggaccaccagcccggcagcgccaagcacaacagagaccaccagaagagctaccagggcggcagcgccccccaccccagcggccggcccacccaccacggctacagccagaacagacgctggcaccacggcaacatgaagcaccccccaggggacaagggggaggccggggcccacagaaatgccaaggagaccatgaccatcgagaaccccaagctggaggacacagctggggacaccggccacagcagcctggaggcccccaggagcccagacaccctggcccctgtggccagcgagcggctgcccccccagcagagcggcggccctgaggtggagaccaagaggaaggacagcatcctgcctgagcgcatcggggagcggcccaagatcaccctgctgcagagcagcaaggaccggctgcggcggcggctgaaggagaaggtgcctgatgaggtggccgtggagaccaccaccccccagcagaacaagatggacaagctgattgagatcctgaacagcatgaggaacaacagcagtgatgtggacaccaagctgaccaccttcatggaggaggcccagaacagcaccaacagcgaggagatgctgggggagatcgtgaggaccatctaccagaaggctgtgtctgacaggagctttgccttcaccgctgccaagctgtgtgacaagatggccctcttcatggtggagggcaccaagttccgcagcctgctgctgaacatgctgcagaaggacttcaccgtgcgggaggagctgcagcagcaggatgtggagcgctggctgggcttcatcaccttcctgtgtgaggtgtttggcaccatgaggagcagcactggagagcccttccgggtgctggtgtgccccatctacacctgcctgcgggagctgctgcagagccaggatgtgaaggaggatgctgtgctgtgctgcagcatggagctgcagagcacaggccgcctgctggaggagcagctgcctgagatgatgacagagctgctggccagcgcccgggacaagatgctgtgccccagcgagagcatgctgaccaggagcctgctgctggaggtgattgagctgcacgccaacagctggaaccccctgaccccacccatcacccagtactacaacagaaccatccagaagctgacagcctag

SEQ ID NO: 146559 - DNA, 1947 bp, Artificial Sequence
  Description of Artificial Sequence: Synthetic coding sequence
atgggccgcctgccctgtggccccctgcccggccagtggacagctgactgcagcgagcccctggacagcagctgcagcttcagccggggccgggccccaccccagcagaatggcagcaaggacaacagcctggacatgctgggcacagacatctgggccgccaacacctttgacagcttcagcggggccacctgggacctgcagcctgagaagctggacttcacccagttccacaggaaggtgcgccacacccccaagcagcccctgccccacatcgaccgggagggctgtgggaagggcaagctggaggatggagatggcatcaacctgaatgacatcgagaaggtgctgcctgcctggcagggctaccaccccatgcctcatgaggtggagatcgcccacaccaagaagctgttcagaagaagaagaaatgacagaagacggcagcagaggcctcctgggggcaacaagccccagcagcacggggaccaccagcccggcagcgccaagcacaacagagaccaccagaagagctaccagggcggcagcgccccccaccccagcggccggcccacccaccacggctacagccagaacagacgctggcaccacggcaacatgaagcaccccccaggggacaagggggaggccggggcccacagaaatgccaaggagaccatgaccatcgagaaccccaagctggaggacacagctggggacaccggccacagcagcctggaggcccccaggagcccagacaccctggcccctgtggccagcgagcggctgcccccccagcagagcggcggccctgaggtggagaccaagaggaaggacagcatcctgcctgagcgcatcggggagcggcccaagatcaccctgctgcagagcagcaaggaccggctgcggcggcggctgaaggagaaggatgaggtggccgtggagaccaccaccccccagcagaacaagatggacaagctgattgagatcctgaacagcatgaggaacaacagcagtgatgtggacaccaagctgaccaccttcatggaggaggcccagaacagcaccaacagcgaggagatgctgggggagatcgtgaggaccatctaccagaaggctgtgtctgacaggagctttgccttcaccgctgccaagctgtgtgacaagatggccctcttcatggtggagggcaccaagttccgcagcctgctgctgaacatgctgcagaaggacttcaccgtgcgggaggagctgcagcagcaggatgtggagcgctggctgggcttcatcaccttcctgtgtgaggtgtttggcaccatgaggagcagcactggagagcccttccgggtgctggtgtgccccatctacacctgcctgcgggagctgctgcagagccaggatgtgaaggaggatgctgtgctgtgctgcagcatggagctgcagagcacaggccgcctgctggaggagcagctgcctgagatgatgacagagctgctggccagcgcccgggacaagatgctgtgccccagcgagagcatgctgaccaggagcctgctgctggaggtgattgagctgcacgccaacagctggaaccagggcgcctggcaggccgcccacggccagctgggcccctggtgcaccggcccagatggccaggccggcggccagggctggccctggagggagaaggagatgggcagaagagctggccgggtgggcggccagagcggggcccgggcctgcaagctgacccccatccgggaggcctgcttcttcttcctggtggccctggccctgcccttcctgaccccagccagccccctgcccatccggcccatcccccatggagccctgtgtgagggcagccaccgctgtgacagcagcgagaccctggccgccagccacgccggggcccccctgggcagcgagaggaccagcgagggctag

SEQ ID NO: 146560 - DNA, 1077 bp, Artificial Sequence
  Description of Artificial Sequence: Synthetic coding sequence
atggagagcgctgacttctatgaagctgagcccaggcctcccatgagcagccacctgcagagccccccccacgcccccagcagcgctgccttcggcttccccagaggagctggccctgcccagcccccagcccctcctgctgcccctgagcccctgggcggcatctgtgagcacgagaccagcattgacatcagcgcctacatcgaccctgctgccttcaatgatgagttcctggccgacctcttccagcacagccggcagcaggagaaggccaaggctgctgtgggccccaccggcggcggcggcggcggggactttgactacccaggggccccagctggccctggaggagctgtgatgcctggaggagcccacggccccccacctggctacggctgtgccgccgccggctacctggatggccgcctggagcccctgtatgagcgggtgggcgccccagccctgcggcccctggtgatcaagcaggagccccgggaggaggatgaggccaagcagctggccctggccggcctcttcccctaccagcccccacctcctcctccacccagccacccccacccccaccccccaccagcccacctggccgccccccacctgcagttccagatcgcccactgcggccagaccaccatgcacctgcagcccggccaccccaccccaccacccacccctgtgcccagcccccacccagccccagccctgggcgccgccggcctgcccggccctggcagcgccctgaagggcctgggcgccgcccacccagacctgcgggccagcggcggcagcggggccggcaaggccaagaagtctgtggacaagaacagcaatgagtacagagtgcggcgggagaggaacaacattgctgtgaggaagagccgggacaaggccaagcagagaaatgtggagacccagcagaaggtgctggagctgaccagtgacaatgaccggctgaggaagagggtggagcagctgagccgggagctggacaccctgcggggcatcttccggcagctgcctgagagcagcctggtgaaggccatgggcaactgtgcctag

SEQ ID NO: 146561 - DNA, 810 bp, Artificial Sequence
  Description of Artificial Sequence: Synthetic coding sequence
atgtctgctgccctcttcagcctggatggccctgcccggggggccccctggccagctgagcccgcccccttctatgagcccggccgggccggcaagccaggaagaggagctgagcccggggccctgggggagcctggagctgctgccccagccatgtatgatgatgaaagtgccatcgacttcagcgcctacatcgacagcatggctgctgtgcccaccctggagctgtgccatgatgagctgtttgctgacctcttcaacagcaaccacaaggccggcggggccggccccctggagctgctgcccggcggccctgcccggcccctgggccctggccctgctgccccccggctgctgaagcgggagccagactggggagatggagatgcccctggcagcctgctgcctgcccaggtggccgcctgtgcccagacagtggtgtccctggccgccgccggccagcccaccccacccaccagccctgagcccccaagaagcagcccccggcagaccccagcccctggccctgcccgggagaagtctgctgggaagaggggccctgaccggggcagccctgagtaccggcagaggcgggagaggaacaacattgctgtgaggaagagccgggacaaggccaagagaagaaaccaggagatgcagcagaagctggtggagctgtctgcagaaaatgagaagctgcaccagagggtggagcagctgacccgggacctggccggcctgcggcagttcttcaagcagctgcccagcccccccttcctgcctgctgctggaacagctgactgcaggtag

SEQ ID NO: 146562 - DNA, 402 bp, Artificial Sequence
  Description of Artificial Sequence: Synthetic coding sequence
atgtctgctgccctcttcagcctggatggccctgcccggggggccccctggccagctgagcccgcccccttctatgagcccggccgggccggcaagccaggaagaggagctgagcccggggccctgggggagcctggagctgctgccccagccatgtatgatgatgaaagtgccatcgacttcagcgcctacatcgacagcatggctgctgtgcccaccctggagctgtgccatgatgagctgtttgctgacctcttcaacagcaaccacaaggcccgggccccctgggcccgggccctgcccctgcctgcctgcagcagcgccagccccactggagccacagccaccaggcctgcccgctgctgcccccggcgctggccccgggcccaccggccctggtag

SEQ ID NO: 146563 - DNA, 1092 bp, Artificial Sequence
  Description of Artificial Sequence: Synthetic coding sequence
atggccagcggggacttctgcagccctggagagggcatggagatcctgcagcaggtgtgcagcaagcagctgcccccctgcaacctgagcaaggaggacctgctgcagaacccctacttcagcaagctgctgctgaacctgagccagcacgtggatgagagcggcctgagcctgaccctggccaaggagcaggcccaggcctggaaggaggtgcggctgcacaagaccacctggctgcggtctgagatcctgcacagggtcatccaggagctgctggtggactactacgtgaagatccaggacaccaacgtgaccagcgaggacaagaagttccacgagaccctggagcagaggctgctggtgacagagctgatgaggctgctgggccccagccaggagcgggagatcccccccctgctgggcctggagaaggctgacctgctggagctgatgcccctgtctgaagattttgtgtggatgagggcccggctgcagcaggaggtggaggagcagctgaagaagaagtgcttcaccctgctgtgctactatgaccccaacagtgatgctgacagcgagaccgtgaaggccgccaaggtgtggaagctggccgaggtgctggtgggggagcagcagcagtgccaggatgccaagagccagcagaaggagcagatgctgctgctggagaagaagtctgctgcctacagccaggtgctgctgcgctgcctgaccctgctgcagaggctgctgcaggagcaccggctgaagacccagagcgagctggaccgcatcaatgcccagtacctggaggtgaagtgtggggccatgatcctgaagctgaggatggaggagctgaagatcctgagtgacacctacacagtggagaaggtggaggtgcacaggctcatccgggaccggctggagggcgccatccacctgcaggagcaggacatggagaacagccggcaggtgctgaacagctatgaggtgctgggggaggagtttgaccggctggtgaaggagtacacagtgctgaagcaggccacagagaacaagcgctgggccctgcaggagttcagcaaggtgtacagatag

SEQ ID NO: 146564 - DNA, 1359 bp, Artificial Sequence
  Description of Artificial Sequence: Synthetic coding sequence
atgggcagcagccagagcgtggagatccctgggggcggcacagagggctaccacgtgctgcgggtgcaggagaacagccctggccacagagctggcctggagcccttctttgacttcatcgtgtccatcaatggcagccggctgaacaaggacaatgacaccctgaaggacctgctgaaggccaacgtggagaagcctgtgaagatgctgatctacagcagcaagaccctggagctgcgggagacctctgtgacccccagcaacctgtggggcggccagggcctgctgggcgtgtccatccgcttctgcagctttgatggagccaatgaaaatgtgtggcacgtgctggaggtggagagcaacagccctgctgccctggccggcctgcggccccacagcgactacatcattggagctgacacagtgatgaatgaaagtgaagatctcttcagcctgattgagacccatgaggccaagcccctgaagctgtatgtgtacaacacagacacagacaactgccgggaggtgatcatcacccccaacagcgcctggggcggggagggcagcctgggctgcggcatcggctacggctacctgcaccgcatccccacccggccctttgaggagggcaagaagatcagcctgcccggccagatggccggcacccccatcacccccctgaaggatggcttcacagaggtgcagctgagctctgtgaacccccccagcctgagccccccaggcaccaccggcatcgagcagagcctgaccggcctgagcatcagcagcaccccacctgctgtgtcctctgtgctgagcactggagtgcccaccgtgcccctgctgcccccccaggtgaaccagagcctgacctctgtgccccccatgaacccagccaccaccctgcccggcctgatgcccctgcctgctggcctgcccaacctgcccaacctgaacctgaacctgcctgccccccacatcatgcctggggtgggcctgcctgagctggtgaaccctggcctgccccccctgcccagcatgccacccaggaacctgcccggcatcgcccccctgcccctgcccagcgagttcctgcccagcttccccctggtgcctgagagcagcagcgctgccagcagcggggagctgctgagcagcctgccccccaccagcaatgcccccagcgaccctgccaccaccacagccaaggcagatgctgccagcagcctgactgtggatgtgaccccacccacagccaaggcccccaccaccgtggaggacagagtgggggacagcacccctgtgtctgagaagcctgtgtctgctgctgtggatgccaatgccagcgagagcccctag

SEQ ID NO: 146565 - DNA, 2997 bp, Artificial Sequence
  Description of Artificial Sequence: Synthetic coding sequence
atggctgctgtgaaggagcccctggagttccacgccaagaggccctggaggcctgaggaggccgtggaggaccctgatgaggaggatgaggacaacaccagcgaggctgaaaatggcttcagcctggaggaggtgctgcggctgggcggcaccaagcaggactacctgatgctggccaccctggatgaaaatgaggaggtgattgatggcggcaagaagggggccattgatgacctgcagcagggcgagctggaggccttcatccagaacctgaacctggccaagtacaccaaggccagcctggtggaggaggatgagcctgctgagaaggagaacagcagcaagaaggaggtgaagatccccaagatcaacaacaagaacacagctgagagccagaggacctctgtgaacaaggtgaagaacaagaacagacctgagccccacagtgatgaaaatggcagcaccacccccaaggtgaagaaggacaagcagaacatctttgagttctttgagcggcagaccctgctgctgcggcctgggggcaagtggtatgacctggagtacagcaatgagtacagcctgaagccccagccccaggatgtggtgtccaagtacaagaccctggcccagaagctgtaccagcacgagatcaacctcttcaagagcaagaccaacagccagaagggggccagcagcacctggatgaaggccatcgtgagcagcggcaccctgggggacaggatggccgccatgatcctgctgatccaggatgatgctgtgcacaccctgcagtttgtggagaccctggtgaacctggtgaagaagaagggcagcaagcagcagtgcctgatggccctggacaccttcaaggagctgctgatcacagacctgctgcctgacaacaggaagctgcgcatcttcagccagaggccctttgacaagctggagcagctgagcagcggcaacaaggacagccgggaccggcggctcatcctgtggtactttgagcaccagctgaagcacctggtggccgagtttgtgcaggtgctggagaccctgagccatgacaccctggtgaccaccaagacccgggccctgactgtggcccacgagctgctgtgcaacaagccagaggaggagaaggccctgctggtgcaggtggtgaacaagctgggggacccccagaaccgcatcgccaccaaggccagccacctgctggagaccctgctgtgcaagcaccccaacatgaagggcgtggtgtctggagaggtggagcggctgctcttccgcagcaacatcagcagcaaggcccagtactatgccatctgcttcctgaaccagatggccctgagccatgaggagagcgagctggccaacaagctgatcaccgtgtacttctgcttcttccgcacctgtgtgaagaagaaggatgtggagagcaagatgctgagcgccctgctgactggagtgaacagagcctacccctacagccagacaggagatgacaaggtgcgggagcagattgacaccctcttcaaggtgctgcacatcgtgaacttcaacacctctgtgcaggccctgatgctgctcttccaggtgatgaacagccagcagaccatcagtgaccgctactacacagccctgtacaggaagatgctggaccccggcctgatgacctgcagcaagcaggccatgttcctgaacctggtgtacaagagcctgaaggctgacatcgtgctgcggcgggtgaaggcctttgtgaagaggctgctgcaggtgacctgccagcagatgccacccttcatctgtggggccctgtacctggtgtctgagatcctgaaggccaagccaggcctgcggagccagctggatgaccaccctgagagtgatgatgaggagaacttcattgatgccaatgatgatgaggacatggagaagttcacagatgctgacaaggagacagagatcgtgaagaagctggagacagaggagaccgtgcctgagacagatgtggagaccaagaagccagaggtggcctcctgggtgcactttgacaacctgaagggcggcaagcagctgaacaagtatgaccccttcagcaggaaccccctcttctgtggggctgagaacaccagcctgtgggagctgaagaagctgtctgtgcacttccaccccagcgtggccctgtttgccaagaccatcctgcagggcaactacatccagtacagcggggaccccctgcaggacttcaccctgatgaggttcctggacagatttgtgtacagaaaccccaagccccacaagggcaaggaaaatacagattctgtggtgatgcagcccaagaggaagcacttcatcaaggacatccgccacctgcctgtgaacagcaaggagttcctggccaaggaggagagccagatccctgtggatgaggtgttcttccaccgctactacaagaaggtggccgtgaaggagaagcagaagagagatgctgatgaggagagcattgaagatgtggatgatgaggagtttgaggagctgattgacacctttgaagatgacaactgcttcagcagcggcaaggatgacatggactttgctggaaatgtgaagaagaggaccaagggggccaaggacaacaccctggatgaggacagcgagggcagtgatgatgagctgggcaacctggatgatgatgaggtgtccctgggctccatggatgatgaggagtttgctgaggtggatgaagatggcggcaccttcatggatgtgctggatgatgaaagtgaatctgtgcctgagctggaggtgcacagcaaggtgtccaccaagaagagcaagaggaaaggaacagatgactttgattttgctggcagcttccagggccccaggaagaagaagaggaacctgaatgacagcagcctgtttgtgtctgctgaggagtttggccacctgctggatgagaacatgggcagcaagtttgacaacatcgcctag

SEQ ID NO: 146566 - DNA, 1992 bp, Artificial Sequence
  Description of Artificial Sequence: Synthetic coding sequence
atggccgccacagagatctctgtgctgtctgagcagttcaccaagatcaaggagctggagctgatgcctgagaagggcctgaaggaggaggagaaggatggagtgtgccgggagaaggaccacaggagccccagcgagctggaggccgagaggaccagcggggccttccaggacagcgtgctggaggaggaggtggagctggtgctggcccccagcgaggagagcgagaagtacatcctgaccctgcagacagtgcacttcaccagcgaggccgtggagctgcaggacatgagcctgctgagcatccagcagcaggagggcgtgcaggtggtggtgcagcagcccggccctggcctgctgtggctggaggagggcccccggcagagcctgcagcagtgtgtggccatcagcatccagcaggagctgtacagcccccaggagatggaggtgctgcagttccacgccctggaggagaatgtgatggtggccagcgaggacagcaagctggccgtgtccctggccgagaccaccggcctcatcaagctggaggaggagcaggagaagaaccagctgctggccgagaggaccaaggagcagctgttctttgtggagaccatgtctggagatgagaggagtgatgaaattgtgctgactgtgagcaacagcaatgtggaggagcaggaggaccagcccacagctggccaggctgatgctgagaaggccaagagcaccaagaaccagaggaagaccaagggggccaagggcaccttccactgtgatgtgtgcatgttcaccagcagcaggatgagcagcttcaacagacacatgaagacccacaccagcgagaagccccacctgtgccacctgtgcctgaagaccttcagaacagtgaccctgctgagaaatcatgtgaacacccacacaggcacccggccctacaagtgcaatgactgcaacatggcctttgtgaccagcggggagctggtgcgccaccggcgctacaagcacacccatgagaagcccttcaagtgcagcatgtgcaagtatgcctctgtggaggccagcaagctgaagagacatgtgcgcagccacactggagagcggcccttccagtgctgccagtgcagctatgccagccgggacacctacaagctgaagaggcacatgaggacccacagcggggagaagccctatgagtgccacatctgccacacccgcttcacccagagcggcaccatgaagatccacatcctgcagaagcatggagaaaatgtgcccaagtaccagtgcccccactgtgccaccatcatcgccaggaagagtgacctgcgggtgcacatgaggaacctgcacgcctacagcgctgctgagctgaagtgccgctactgcagcgctgtgttccacgagagatatgccctgatccagcaccagaagacccacaagaatgagaagcgcttcaagtgcaagcactgcagctatgcctgcaagcaggagcggcacatgacagcccacatccgcacccacactggagagaagcccttcacctgcctgagctgcaacaagtgcttccggcagaagcagctgctgaatgcccacttcaggaagtaccatgatgccaacttcatccccaccgtgtacaagtgcagcaaatgtgggaagggcttcagccgctggatcaacctgcaccgccacagcgagaagtgtggcagcggggaggccaagtctgctgccagcggcaagggccgccgcaccaggaagaggaagcagaccatcctgaaggaggccaccaagggccagaaggaggccgccaagggctggaaggaggccgccaatggagatgaagctgctgctgaggaggccagcaccaccaagggggagcagtttcctggagagatgtttcctgtggcctgccgggagaccacagcccgggtgaaggaggaggtggatgaaggagtgacctgtgagatgctgctgaacaccatggacaagtag

SEQ ID NO: 146567 - DNA, 1992 bp, Artificial Sequence; identical to SEQ ID NO: 146566
  Description of Artificial Sequence: Synthetic coding sequence

SEQ ID NO: 146568 - DNA, 1284 bp, Artificial Sequence
  Description of Artificial Sequence: Synthetic coding sequence
atggccgccacagagatctctgtgctgtctgagcagttcaccaagatcaaggagctggagctgatgcctgagaagggcctgaaggaggaggagaaggatggagtgtgccgggagaaggaccacaggagccccagcgagctggaggccgagaggaccagcggggccttccaggacagcgtgctggaggaggaggtggagctggtgctggcccccagcgaggagagcgagaagtacatcctgaccctgcagacagtgcacttcaccagcgaggccgtggagctgcaggacatgagcctgctgagcatccagcagcaggagggcgtgcaggtggtggtgcagcagcccggccctggcctgctgtggctggaggagggcccccggcagagcctgcagcagtgtgtggccatcagcatccagcaggagctgtacagcccccaggagatggaggtgctgcagttccacgccctggaggagaatgtgatggtggccagcgaggacagcaagctggccgtgtccctggccgagaccaccggcctcatcaagctggaggaggagcaggagaagaaccagctgctggccgagaggaccaaggagcagctgttctttgtggagaccatgtctggagatgagaggagtgatgaaattgtgctgactgtgagcaacagcaatgtggaggagcaggaggaccagcccacagctggccaggctgatgctgagaaggccaagagcaccaagaaccagaggaagaccaagggggccaagggcaccttccactgtgatgtgtgcatgttcaccagcagcaggatgagcagcttcaacagacacatgaagacccacaccagcgagaagccccacctgtgccacctgtgcctgaagaccttcagaacagtgaccctgctgagaaatcatgtgaacacccacacaggcacccggccctacaagtgcaatgactgcaacatggcctttgtgaccagcggggagctggtgcgccaccggcgctacaagcacacccatgagaagcccttcaagtgcagcatgtgcaagtatgcctctgtggaggccagcaagctgaagagacatgtgcgcagccacactggagagcggcccttccagtgctgccagtgcagctatgccagccgggacacctacaagctgaagaggcacatgaggacccacagcgaggccaccagcaagaggagcctgcaggagatcccccgctgcaagttccacccagactgcctgcagatgctgcaggtgtggcagaggctcttccccctggactag

SEQ ID NO: 146569 - DNA, 1722 bp, Artificial Sequence
  Description of Artificial Sequence: Synthetic coding sequence
atggccgccacagagatctctgtgctgtctgagcagttcaccaagatcaaggagctggagctgatgcctgagaagggcctgaaggaggaggagaaggatggagtgtgccgggagaaggaccacaggagccccagcgagctggaggccgagaggaccagcggggccttccaggacagcgtgctggaggaggaggtggagctggtgctggcccccagcgaggagagcgagaagtacatcctgaccctgcagacagtgcacttcaccagcgaggccgtggagctgcaggacatgagcctgctgagcatccagcagcaggagggcgtgcaggtggtggtgcagcagcccggccctggcctgctgtggctggaggagggcccccggcagagcctgcagcagtgtgtggccatcagcatccagcaggagctgtacagcccccaggagatggaggtgctgcagttccacgccctggaggagaatgtgatggtggccagcgaggacagcaagctggccgtgtccctggccgagaccaccggcctcatcaagctggaggaggagcaggagaagaaccagctgctggccgagaggaccaaggagcagctgttctttgtggagaccatgtctggagatgagaggagtgatgaaattgtgctgactgtgagcaacagcaatgtggaggagcaggaggaccagcccacagctggccaggctgatgctgagaaggccaagagcaccaagaaccagaggaagaccaagggggccaagggcaccttccactgtgatgtgtgcatgttcaccagcagcaggatgagcagcttcaacagacacatgaagacccacaccagcgagaagccccacctgtgccacctgtgcctgaagaccttcagaacagtgaccctgctgagaaatcatgtgaacacccacacaggcacccggccctacaagtgcaatgactgcaacatggcctttgtgaccagcggggagctggtgcgccaccggcgctacaagcacacccatgagaagcccttcaagtgcagcatgtgcaagtatgcctctgtggaggccagcaagctgaagagacatgtgcgcagccacactggagagcggcccttccagtgctgccagtgcagctatgccagccgggacacctacaagctgaagaggcacatgaggacccacagcggggagaagccctatgagtgccacatctgccacacccgcttcacccagagcggcaccatgaagatccacatcctgcagaagcatggagaaaatgtgcccaagtaccagtgcccccactgtgccaccatcatcgccaggaagagtgacctgcgggtgcacatgaggaacctgcacgcctacagcgctgctgagctgaagtgccgctactgcagcgctgtgttccacgagagatatgccctgatccagcaccagaagacccacaagaatgagaagcgcttcaagtgcaagcactgcagctatgcctgcaagcaggagcggcacatgacagcccacatccgcacccacactggagagaagcccttcacctgcctgagctgcaacaagtgcttccggcagaagcagctgctgaatgcccacttcaggaagtaccatgatgccaacttcatccccaccgtgtacaagtgcagcaaatgtgggaagggcttcagccgctggatcaccagcaagtggagcggcctgaagccccagaccttcatcacctag

SEQ ID NO: 146570 - DNA, 2103 bp, Artificial Sequence
  Description of Artificial Sequence: Synthetic coding sequence
atggccgccacagagatctctgtgctgtctgagcagttcaccaagatcaaggagctggagctgatgcctgagaagggcctgaaggaggaggagaaggatggagtgtgccgggagaaggaccacaggagccccagcgagctggaggccgagaggaccagcggggccttccaggacagcgtgctggaggaggaggtggagctggtgctggcccccagcgaggagagcgagaagtacatcctgaccctgcagacagtgcacttcaccagcgaggccgtggagctgcaggacatgagcctgctgagcatccagcagcaggagggcgtgcaggtggtggtgcagcagcccggccctggcctgctgtggctggaggagggcccccggcagagcctgcagcagtgtgtggccatcagcatccagcaggagctgtacagcccccaggagatggaggtgctgcagttccacgccctggaggagaatgtgatggtggccagcgaggacagcaagctggccgtgtccctggccgagaccaccggcctcatcaagctggaggaggagcaggagaagaaccagctgctggccgagaggaccaaggagcagctgttctttgtggagaccatgtctggagatgagaggagtgatgaaattgtgctgactgtgagcaacagcaatgtggaggagcaggaggaccagcccacagctggccaggctgatgctgagaaggccaagagcaccaagaaccagaggaagaccaagggggccaagggcaccttccactgtgatgtgtgcatgttcaccagcagcaggatgagcagcttcaacagacacatgaagacccacaccagcgagaagccccacctgtgccacctgtgcctgaagaccttcagaacagtgaccctgctgagaaatcatgtgaacacccacacaggcacccggccctacaagtgcaatgactgcaacatggcctttgtgaccagcggggagctggtgcgccaccggcgctacaagcacacccatgagaagcccttcaagtgcagcatgtgcaagtatgcctctgtggaggccagcaagctgaagagacatgtgcgcagccacactggagagcggcccttccagtgctgccagtgcagctatgccagccgggacacctacaagctgaagaggcacatgaggacccacagcggggagaagccctatgagtgccacatctgccacacccgcttcacccagagcggcaccatgaagatccacatcctgcagaagcatggagaaaatgtgcccaagtaccagtgcccccactgtgccaccatcatcgccaggaagagtgacctgcgggtgcacatgaggaacctgcacgcctacagcgctgctgagctgaagtgccgctactgcagcgctgtgttccacgagagatatgccctgatccagcaccagaagacccacaagaatgagaagcgcttcaagtgcaagcactgcagctatgcctgcaagcaggagcggcacatgacagcccacatccgcacccacactggagagaagcccttcacctgcctgagctgcaacaagtgcttccggcagaagcagctgctgaatgcccacttcaggaagtaccatgatgccaacttcatccccaccgtgtacaagtgcagcaaatgtgggaagggcttcagccgctggatcaacctgcaccgccacagcgagaagtgtggcagcggggaggccaagtctgctgccagcggcaagggccgccgcaccaggaagaggaagcagaccatcctgaaggaggccaccaagggccagaaggaggccgccaagggctggaaggaggccgccaatggagatgaagctgctgctgaggaggccagcaccaccaagggggagcagtttcctggagagatgtttcctgtggcctgccgggagaccacagcccgggtgaaggaggaggtggatgaaggagtgacctgtgagatgctgctgaacaccatggacaacagcgctggctgcaccggccgcatgatgctggtgtctgcctggctgctgggccggccccaggagacctacaaccagggcagaagaagaagaggcagccggcgggtgacctggtag

SEQ ID NO: 146571 - DNA, 1356 bp, Artificial Sequence
  Description of Artificial Sequence: Synthetic coding sequence
atggccgccacagagatctctgtgctgtctgagcagttcaccaagatcaaggagctggagctgatgcctgagaagggcctgaaggaggaggagaaggatggagtgtgccgggagaaggaccacaggagccccagcgagctggaggccgagaggaccagcggggccttccaggacagcgtgctggaggaggaggtggagctggtgctggcccccagcgaggagagcgagaagtacatcctgaccctgcagacagtgcacttcaccagcgaggccgtggagctgcaggacatgagcctgctgagcatccagcagcaggagggcgtgcaggtggtggtgcagcagcccggccctggcctgctgtggctggaggagggcccccggcagagcctgcagcagtgtgtggccatcagcatccagcaggagctgtacagcccccaggagatggaggtgctgcagttccacgccctggaggagaatgtgatggtggccagcgaggacagcaagctggccgtgtccctggccgagaccaccggcctcatcaagctggaggaggagcaggagaagaaccagctgctggccgagaggaccaaggagcagctgttctttgtggagaccatgtctggagatgagaggagtgatgaaattgtgctgactgtgagcaacagcaatgtggaggagcaggaggaccagcccacagctggccaggctgatgctgagaaggccaagagcaccaagaaccagaggaagaccaagggggccaagggcaccttccactgtgatgtgtgcatgttcaccagcagcaggatgagcagcttcaacagacacatgaagacccacaccagcgagaagccccacctgtgccacctgtgcctgaagaccttcagaacagtgaccctgctgagaaatcatgtgaacacccacacaggcacccggccctacaagtgcaatgactgcaacatggcctttgtgaccagcggggagctggtgcgccaccggcgctacaagcacacccatgagaagcccttcaagtgcagcatgtgcaagtatgcctctgtggaggccagcaagctgaagagacatgtgcgcagccacactggagagcggcccttccagtgctgccagtgcagctatgccagccgggacacctacaagctgaagaggcacatgaggacccacagcggggagaagccctatgagtgccacatctgccacacccgcttcacccagagcggcaccatgaagatccacatcctgcagaagcatggagaaaatgtgcccaagtaccagtgcccccactgtgccaccatcatcgccaggaagagtgacctgcgcttcctgggcctgcccttcccctag

SEQ ID NO: 146572 - DNA, 1842 bp, Artificial Sequence
  Description of Artificial Sequence: Synthetic coding sequence
atggccgccacagagatctctgtgctgtctgagcagttcaccaagatcaaggagctggagctgatgcctgagaagggcctgaaggaggaggagaaggatggagtgtgccgggagaaggaccacaggagccccagcgagctggaggccgagaggaccagcggggccttccaggacagcgtgctggaggaggaggtggagctggtgctggcccccagcgaggagagcgagaagtacatcctgaccctgcagacagtgcacttcaccagcgaggccgtggagctgcaggacatgagcctgctgagcatccagcagcaggagggcgtgcaggtggtggtgcagcagcccggccctggcctgctgtggctggaggagggcccccggcagagcctgcagcagtgtgtggccatcagcatccagcaggagctgtacagcccccaggagatggaggtgctgcagttccacgccctggaggagaatgtgatggtggccagcgaggacagcaagctggccgtgtccctggccgagaccaccggcctcatcaagctggaggaggagcaggagaagaaccagctgctggccgagaggaccaaggagcagctgttctttgtggagaccatgtctggagatgagaggagtgatgaaattgtgctgactgtgagcaacagcaatgtggaggagcaggaggaccagcccacagctggccaggctgatgctgagaaggccaagagcaccaagaaccagaggaagaccaagggggccaagggcaccttccactgtgatgtgtgcatgttcaccagcagcaggatgagcagcttcaacagacacatgaagacccacaccagcgagaagccccacctgtgccacctgtgcctgaagaccttcagaacagtgaccctgctgagaaatcatgtgaacacccacacaggcacccggccctacaagtgcaatgactgcaacatggcctttgtgaccagcggggagctggtgcgccaccggcgctacaagcacacccatgagaagcccttcaagtgcagcatgtgcaagtatgcctctgtggaggccagcaagctgaagagacatgtgcgcagccacactggagagcggcccttccagtgctgccagtgcagctatgccagccgggacacctacaagctgaagaggcacatgaggacccacagcggcgtgcacatgaggaacctgcacgcctacagcgctgctgagctgaagtgccgctactgcagcgctgtgttccacgagagatatgccctgatccagcaccagaagacccacaagaatgagaagcgcttcaagtgcaagcactgcagctatgcctgcaagcaggagcggcacatgacagcccacatccgcacccacactggagagaagcccttcacctgcctgagctgcaacaagtgcttccggcagaagcagctgctgaatgcccacttcaggaagtaccatgatgccaacttcatccccaccgtgtacaagtgcagcaaatgtgggaagggcttcagccgctggatcaacctgcaccgccacagcgagaagtgtggcagcggggaggccaagtctgctgccagcggcaagggccgccgcaccaggaagaggaagcagaccatcctgaaggaggccaccaagggccagaaggaggccgccaagggctggaaggaggccgccaatggagatgaagctgctgctgaggaggccagcaccaccaagggggagcagtttcctggagagatgtttcctgtggcctgccgggagaccacagcccgggtgaaggaggaggtggatgaaggagtgacctgtgagatgctgctgaacaccatggacaagtag

SEQ ID NO: 146573 - DNA, 1452 bp, Artificial Sequence
  Description of Artificial Sequence: Synthetic coding sequence
atggccgccacagagatctctgtgctgtctgagcagttcaccaagatcaaggagctggagctgatgcctgagaagggcctgaaggaggaggagaaggatggagtgtgccgggagaaggaccacaggagccccagcgagctggaggccgagaggaccagcggggccttccaggacagcgtgctggaggaggaggtggagctggtgctggcccccagcgaggagagcgagaagtacatcctgaccctgcagacagtgcacttcaccagcgaggccgtggagctgcaggacatgagcctgctgagcatccagcagcaggagggcgtgcaggtggtggtgcagcagcccggccctggcctgctgtggctggaggagggcccccggcagagcctgcagcagtgtgtggccatcagcatccagcaggagctgtacagcccccaggagatggaggtgctgcagttccacgccctggaggagaatgtgatggtggccagcgaggacagcaagctggccgtgtccctggccgagaccaccggcctcatcaagctggaggaggagcaggagaagaaccagctgctggccgagaggaccaaggagcagctgttctttgtggagaccatgtctggagatgagaggagtgatgaaattgtgctgactgtgagcaacagcaatgtggaggagcaggaggaccagcccacagctggccaggctgatgctgagaaggccaagagcaccaagaaccagaggaagaccaagggggccaagggcaccttccactgtgatgtgtgcatgttcaccagcagcaggatgagcagcttcaacagacacatgaagacccacaccagcgagaagccccacctgtgccacctgtgcctgaagaccttcagaacagtgaccctgctgagaaatcatgtgaacacccacacaggcacccggccctacaagtgcaatgactgcaacatggcctttgtgaccagcggggagctggtgcgccaccggcgctacaagcacacccatgagaagcccttcaagtgcagcatgtgcaagtatgcctctgtggaggagcggcacatgacagcccacatccgcacccacactggagagaagcccttcacctgcctgagctgcaacaagtgcttccggcagaagcagctgctgaatgcccacttcaggaagtaccatgatgccaacttcatccccaccgtgtacaagtgcagcaaatgtgggaagggcttcagccgctggatcctgtgggtgggcaacagcgaggtggccgagctgggcggccctggcagcggccccctgctgcggctgcagagcggctgccccccaggcctgcaccaccccaaggccggcctgggccctgaggaccccctgcccggccagctgcggcacaccacagctggcaccggcctgagcagcctgctgcagggccccctgtgccgggccgcctag

SEQ ID NO: 146574 - DNA, 1998 bp, Artificial Sequence
  Description of Artificial Sequence: Synthetic coding sequence
atggccgccacagagatctctgtgctgtctgagcagttcaccaagatcaaggagctggagctgatgcctgagaagggcctgaaggaggaggagaaggatggagtgtgccgggagaaggaccacaggagccccagcgagctggaggccgagaggaccagcggggccttccaggacagcgtgctggaggaggaggtggagctggtgctggcccccagcgaggagagcgagaagtacatcctgaccctgcagacagtgcacttcaccagcgaggccgtggagctgcaggacatgagcctgctgagcatccagcagcaggagggcgtgcaggtggtggtgcagcagcccggccctggcctgctgtggctggaggagggcccccggcagagcctgcagcagtgtgtggccatcagcatccagcaggagctgtacagcccccaggagatggaggtgctgcagttccacgccctggaggagaatgtgatggtggccagcgaggacagcaagctggccgtgtccctggccgagaccaccggcctcatcaagctggaggaggagcaggagaagaaccagctgctggccgagaggaccaaggagcagctgttctttgtggagaccatgtctggagatgagaggagtgatgaaattgtgctgactgtgagcaacagcaatgtggaggagcaggaggaccagcccacagctggccaggctgatgctgagaaggccaagagcaccaagaaccagaggaagaccaagggggccaagggcaccttccactgtgatgtgtgcatgttcaccagcagcaggatgagcagcttcaacagacacatgaagacccacaccagcgagaagccccacctgtgccacctgtgcctgaagaccttcagaacagtgaccctgctgagaaatcatgtgaacacccacacaggcacccggccctacaagtgcaatgactgcaacatggcctttgtgaccagcggggagctggtgcgccaccggcgctacaagcacacccatgagaagcccttcaagtgcagcatgtgcaagtatgcctctgtggaggccagcaagctgaagagacatgtgcgcagccacactggagagcggcccttccagtgctgccagtgcagctatgccagccgggacacctacaagctgaagaggcacatgaggacccacagcggggagaagccctatgagtgccacatctgccacacccgcttcacccagagcggcaccatgaagatccacatcctgcagaagcatggagaaaatgtgcccaagtaccagtgcccccactgtgccaccatcatcgccaggaagagtgacctgcgggtgcacatgaggaacctgcacgcctacagcgctgctgagctgaagtgccgctactgcagcgctgtgttccacgagagatatgccctgatccagcaccagaagacccacaagaatgagaagcgcttcaagtgcaagcactgcagctatgcctgcaagcaggagcggcacatgacagcccacatccgcacccacactggagagaagcccttcacctgcctgagctgcaacaagtgcttccggcagaagcagctgctgaatgcccacttcaggaagtaccatgatgccaacttcatccccaccgtgtacaagtgcagcaaatgtgggaagggcttcagccgctggatcaacctgcaccgccacagcgagaagtgtggcagcggggaggccaagtctgctgccagcggcaagggccgccgcaccaggaagaggaagcagaccatcctgaaggaggccaccaagggccagaaggaggccgccaagggctggaaggaggccgccaatggagatggagtcatcagcgcccacaggaacctgtgcctgctgggcagcagtgacagccacgcctctgtgtctggagctggcatcacagatgcccggcaccacgcctggctgattgtgctgctcttcctggtggagatgggcttctaccacgtgagccacagctag

SEQ ID NO: 146575 - DNA, 1212 bp, Artificial Sequence
  Description of Artificial Sequence: Synthetic coding sequence
atgttcaccagcagcaggatgagcagcttcaacagacacatgaagacccacaccagcgagaagccccacctgtgccacctgtgcctgaagaccttcagaacagtgaccctgctgagaaatcatgtgaacacccacacaggcacccggccctacaagtgcaatgactgcaacatggcctttgtgaccagcggggagctggtgcgccaccggcgctacaagcacacccatgagaagcccttcaagtgcagcatgtgcaagtatgcctctgtggaggccagcaagctgaagagacatgtgcgcagccacactggagagcggcccttccagtgctgccagtgcagctatgccagccgggacacctacaagctgaagaggcacatgaggacccacagcggggagaagccctatgagtgccacatctgccacacccgcttcacccagagcggcaccatgaagatccacatcctgcagaagcatggagaaaatgtgcccaagtaccagtgcccccactgtgccaccatcatcgccaggaagagtgacctgcgggtgcacatgaggaacctgcacgcctacagcgctgctgagctgaagtgccgctactgcagcgctgtgttccacgagagatatgccctgatccagcaccagaagacccacaagaatgagaagcgcttcaagtgcaagcactgcagctatgcctgcaagcaggagcggcacatgacagcccacatccgcacccacactggagagaagcccttcacctgcctgagctgcaacaagtgcttccggcagaagcagctgctgaatgcccacttcaggaagtaccatgatgccaacttcatccccaccgtgtacaagtgcagcaaatgtgggaagggcttcagccgctggatcaacctgcaccgccacagcgagaagtgtggcagcggggaggccaagtctgctgccagcggcaagggccgccgcaccaggaagaggaagcagaccatcctgaaggaggccaccaagggccagaaggaggccgccaagggctggaaggaggccgccaatggagatggagtcatcagcgcccacaggaacctgtgcctgctgggcagcagtgacagccacgcctctgtgtctggagctggcatcacagatgcccggcaccacgcctggctgattgtgctgctcttcctggtggagatgggcttctaccacgtgagccacagctag

SEQ ID NO: 146576 - DNA, 1269 bp, Artificial Sequence
  Description of Artificial Sequence: Synthetic coding sequence
atgtctggagatgagaggagtgatgagatcgtgctgactgtgagcaacagcaatgtggaggagcaggaggaccagcccacagctggccaggctgatgctgagaaggccaagagcaccaagaaccagaggaagaccaagggggccaagggcaccttccactgtgatgtgtgcatgttcaccagcagcaggatgagcagcttcaacagacacatgaagacccacaccagcgagaagccccacctgtgccacctgtgcctgaagaccttcagaacagtgaccctgctgaggaaccacgtgaacacccacacaggcacccggccctacaagtgcaatgactgcaacatggcctttgtgaccagcggggagctggtgcgccaccggcgctacaagcacacccatgagaagcccttcaagtgcagcatgtgcaagtatgcctctgtggaggccagcaagctgaagagacatgtgcgcagccacactggagagcggcccttccagtgctgccagtgcagctatgccagccgggacacctacaagctgaagaggcacatgaggacccacagcggggagaagccctatgagtgccacatctgccacacccgcttcacccagagcggcaccatgaagatccacatcctgcagaagcacggggagaatgtgcccaagtaccagtgcccccactgtgccaccatcatcgccaggaagagtgacctgcgggtgcacatgaggaacctgcacgcctacagcgctgctgagctgaagtgccgctactgcagcgctgtgttccacgagagatatgccctgatccagcaccagaagacccacaagaatgagaagcgcttcaagtgcaagcactgcagctatgcctgcaagcaggagcggcacatgacagcccacatccgcacccacactggagagaagcccttcacctgcctgagctgcaacaagtgcttccggcagaagcagctgctgaatgcccacttcaggaagtaccatgatgccaacttcatccccaccgtgtacaagtgcagcaaatgtgggaagggcttcagccgctggatcctgtgggtgggcaacagcgaggtggccgagctgggcggccctggcagcggccccctgctgcggctgcagagcggctgccccccaggcctgcaccaccccaaggccggcctgggccctgaggaccccctgcccggccagctgcggcacaccacagctggcaccggcctgagcagcctgctgcagggccccctgtgcagagctgcctag

SEQ ID NO: 146577 - DNA, 1296 bp, Artificial Sequence
  Description of Artificial Sequence: Synthetic coding sequence
atgttccacagcccccggcggctgtgcagcgccctgctgcagagagatgcccctggcctgcggcggctgcctgcccctggcctgcggcggcccctgagccccccagctgctgtgcccaggcctgccagcccccggctgctggccgccgccagcgctgccagcggggccgcccggagctgcagcaggacagtgtgcagcatgggcaccggcaccagccggctgtacagcgccctggccaagaccctgaacagcagcgctgccagccagcaccctgagtacctggtgtccccagaccctgagcacctggagcccatcgaccccaaggagctgctggaggagtgcagagctgtgctgcacacccggcccccacgcttccagagggactttgtggacctgaggacagactgccccagcacccacccccccatccgggtgatgcagtggaacatcctggcccaggccctgggggagggcaaggacaactttgtgcagtgccctgtggaggccctgaagtgggaggagaggaagtgcctgatcctggaggagatcctggcctaccagcctgacatcctgtgcctgcaggaggtggaccactactttgacaccttccagcccctgctgagccggctgggctaccagggcaccttcttccccaagccctggagcccctgcctggatgtggagcacaacaatggaccagatggctgtgccctcttcttcctgcagaaccgcttcaagctggtgaacagcgccaacatccggctgacagccatgaccctgaagaccaaccaggtggccatcgcccagaccctggagtgcaaggagagcggccggcagttctgcatcgctgtgacccacctgaaggccaggacaggctgggagcgcttccgcagcgcccagggctgtgacctgctgcagaacctgcagaacatcacccagggcgccaagatccccctcatcgtgtgtggggacttcaatgctgagcccacagaggaggtgtacaagcactttgccagcagcagcctgaacctgaacagcgcctacaagctgctgtctgcagatggccagagcgagcccccctacaccacctggaagatccgcaccagcggagaatgtcgccacaccctggactacatctggtacagcaagcacgccctgaatgtgcgcagcgccctggacctgctgacagaggagcagatcggccccaaccggctgcccagcttcaactaccccagcgaccacctgagcctggtgtgtgacttctccttcacagaggagagtgatggcctgtcctag

SEQ ID NO: 146578 - DNA, 2133 bp, Artificial Sequence
  Description of Artificial Sequence: Synthetic coding sequence
atgagccgcagcccagatgccaaggaggaccctgtggagtgccccctgtgcatggagcccctggagattgatgacatcaacttcttcccctgcacctgtggctaccagatctgccgcttctgctggcaccgcatcagaacagatgaaaatggcctgtgcccagcctgcaggaagccctacccagaggaccctgctgtgtacaagcccctgagccaggaggagctgcagaggatcaagaatgagaagaagcagaagcagaatgaaaggaagcagaagatcagtgaaaataggaagcacctggcctctgtgcgggtggtgcagaagaacctggtgtttgtggtgggcctgagccagaggctggccgaccctgaggtgctgaagaggcctgagtactttgggaagtttgggaagatccacaaggtggtgatcaacaacagcaccagctatgccggcagccagggccccagcgccagcgcctacgtgacctacatccgctcagaagatgccctgcgggccatccagtgtgtgaacaacgtggtggtggatggccgcaccctgaaggccagcctgggcaccaccaagtactgcagctacttcctgaagaacatgcagtgccccaagccagactgcatgtacctgcacgagctgggagatgaggccgccagcttcaccaaggaggagatgcaggccggcaagcaccaggagtatgagcagaagctgctgcaggagctgtacaagctgaaccccaacttcctgcagctgagcacaggctctgtggacaagaacaagaacaaggtgacccccctgcagagccccatcgacaagcccagcgacagcctgagcattggaaatggagacaacagccagcagatcagcaacagcgacacccccagccccccacctggcctgagcaagagcaaccctgtgatccccatcagcagcagcaaccacagcgcccggagcccctttgaaggagctgtgacagagagccagagcctcttcagtgacaacttccgccaccccaaccccatccccagcggcctgccccccttccccagcagcccccagaccagcagtgactggcccacagcccctgagccccagagcctcttcaccagcgagaccatccctgtgagcagcagcacagactggcaggccgccttcggcttcggcagcagcaagcagccagaagatgacctgggctttgacccctttgatgtgaccaggaaggccctggccgacctgattgagaaggagctgtctgtgcaggaccagcccagcctgagccccaccagcctgcagaacagcagcagccacaccaccacagccaagggccctggcagcggcttcctgcaccctgctgctgccaccaatgccaacagcctgaacagcaccttctctgtgctgccccagcgcttcccccagttccagcagcacagagctgtgtacaacagcttctccttccctggccaggccgcccgctacccctggatggccttccccaggaacagcatcatgcacctgaaccacacagccaaccccaccagcaacagcaacttcctggacctgaacctgcccccccagcacaacacaggcctgggcggcatccctgtggccgacaacagcagctctgtggagagcctgaacatgaaggagtggcaggacggcctgcgggccctgctgcccaacatcaacatcaactttggaggcctgcccaacagcagcagccccagcaatgccaaccacagcgcccccaccagcaacacagccaccacagacagcctgtcctgggacagccctggctcctggacagatcctgccatcatcaccggcatcccagccagcagcggcaacagcctggacagcctgcaggatgacaaccccccccactggctgaagagcctgcaggccctgacagagatggatggccccagcgctgcccccagccagacccaccacagcgcccccttcagcacccagatccccctgcaccgggcctcctggaacccctaccccccacccagcaaccccagcagcttccacagccccccacctggcttccagacagccttccggccccccagcaagacccccacagacctgctgcagagcagcaccctggacagacactag

SEQ ID NO: 146579 - DNA, 3684 bp, Artificial Sequence
  Description of Artificial Sequence: Synthetic coding sequence
atgacccagaaggtggaggagctgaaggagaccgtgaaggaggagttcatgccctgggtgtcccagtacctggtgatgaagagggtgtccattgagcccaacttccacagcctgtacagcaacttcctggacaccctgaagaaccctgagttcaacaagatggtgctgaatgagacctacagaaacatcaaggacctggatgtgaagagcctgctgctggaggcctacgtgaagggccagcaggagctgctgtatgtggtgccctttgtggccaaggtgctggagagcagcatccgctctgtggtgttccggccccccaacccctggaccatggccatcatgaatgtgctggccgagctgcaccaggagcatgacctgaagctgaacctgaagtttgaaattgaggtgctgtgcaagaacctggccctggacatcaatgagctgaagccaggcaacctgctgaaggacaaggaccggctgaagaacctggatgagcagctgagcgcccccaagaaggatgtgaagcagcctgaggagctgccccccatcaccaccaccaccaccagcaccaccccagccaccaacaccacctgcacagccaccgtgcccccccagccccagtacagctaccatgacatcaacgtgtacagcctggccggcctggccccccacatcaccctgaaccccaccatccccctcttccaggcccacccccagctgaagcagtgtgtgcggcaggccatcgagagagctgtgcaggagctggtgcaccctgtggtggacaggagcatcaagatcgccatgaccacctgtgagcagatcgtgaggaaggactttgccctggacagcgaggagagcaggatgagaattgctgcccaccacatgatgaggaacctgacagctggcatggccatgatcacctgccgggagcccctgctgatgagcatcagcaccaacctgaagaacagctttgccagcgccctgaggacagccagcccccagcagcgggagatgatggaccaggccgccgcccagctggcccaggacaactgtgagctggcctgctgcttcatccagaagacagctgtggagaaggccggccctgagatggacaagaggctggccacagaatttgagctgaggaagcacgcccggcaggagggccgccgctactgtgaccctgtggtgctgacctaccaggccgagaggatgcctgagcagatccggctgaaggtgggcggcgtggaccccaagcagctggccgtgtatgaggagtttgccagaaatgtgcccggcttcctgcccaccaatgacctgagccagcccaccggcttcctggcccagcccatgaagcaggcctgggccacagatgatgtggcccagatctatgacaagtgcatcacagagctggagcagcacctgcacgccatcccccccaccctggccatgaacccccaggcccaggccctgcggagcctgctggaggtggtggtgctgagcaggaacagcagagatgccatcgccgccctgggcctgctgcagaaggctgtggagggcctgctggatgccaccagcggggctgatgctgacctgctgctgcgctaccgggagtgccacctgctggtgctgaaggccctgcaggacggccgggcctacggcagcccctggtgcaacaagcagatcacccgctgcctgattgaatgtagagatgagtacaagtacaacgtggaggccgtggagctgctgatccggaaccacctggtgaacatgcagcagtatgacctgcacctggcccagagcatggagaatggcctgaactacatggctgtggcctttgccatgcagctggtgaagatcctgctggtggatgagaggtctgtggcccacgtgacagaagctgacctcttccacaccatcgagaccctgatgaggatcaatgcccacagcagaggaaatgcccctgagggcctgccccagctgatggaggtggtgcgcagcaactatgaggccatgattgaccgggcccacggcggccccaacttcatgatgcacagcggcatcagccaggcctctgaatatgatgaccccccaggcctgcgggagaaggccgagtacctgctgcgggagtgggtgaacctgtaccacagcgctgctgctggccgggacagcaccaaggccttcagcgcctttgtgggccagatgcaccagcagggcatcctgaagacagatgacctgatcacccgcttcttccggctgtgcacagagatgtgtgtggagatctcctaccgggcccaggccgagcagcagcacaacccagctgccaaccccaccatgatccgggccaagtgctaccacaacctggatgcctttgtgcggctcatcgccctgctggtgaagcacagcggggaggccaccaacacagtgaccaagatcaacctgctgaacaaggtgctgggcatcgtggtgggcgtgctgctgcaggaccatgatgtgcggcagagcgagttccagcagctgccctaccaccgcatcttcatcatgctgctgctggagctgaatgcccctgagcacgtgctggagaccatcaacttccagaccctgacagccttctgcaacaccttccacatcctgcggcccaccaaggcccctggctttgtgtatgcctggctggagctgatcagccaccgcatcttcatcgccaggatgctggcccacaccccccagcagaagggctggcccatgtatgcccagctgctgattgacctcttcaagtacctggcccccttcctgagaaatgtggagctgaccaagcccatgcagatcctgtacaagggcaccctgcgggtgctgctggtgctgctgcatgacttccctgagttcctgtgtgactaccactacggcttctgtgatgtgattcctcccaactgcatccagctgaggaacctgatcctgagcgccttccccaggaacatgaggctgcctgaccccttcacccccaacctgaaggtggacatgctgtctgagatcaacatcgccccccgcatcctgaccaacttcaccggggtgatgccaccccagttcaagaaggacctggacagctacctgaagaccaggagccctgtgaccttcctgagtgacctgcggagcaacctgcaggtgtccaatgaacctggcaaccgctacaacctgcagctgatcaatgccctggtgctgtatgtgggcacccaggccatcgcccacatccacaacaagggcagcacccccagcatgagcaccatcacccacagcgcccacatggacatcttccagaacctggccgtggacctggacacagagggccgctacctgttcctgaatgccatcgccaaccagctgcgctaccccaacagccacacccactacttcagctgcaccatgctgtacctgtttgctgaggccaacacagaggccatccaggagcagatcaccagggtgctgctggagcggctcatcgtgaaccggccccacccctggggcctgctgatcaccttcatcgagctgatcaagaacccagccttcaagttctggaaccatgaatttgtgcactgtgcccctgagattgagaagctgttccagagcgtggcccagtgctgcatgggccagaagcaggcccagcaggtgatggagggcaccggggccagctag

SEQ ID NO: 146580 - DNA, 7131 bp, Artificial Sequence
  Description of Artificial Sequence: Synthetic coding sequence
atgaacctggacagcctgagcctggccctgagccagatctcctacctggtggacaacctgaccaagaagaactaccgggccagccagcaggagatccagcacatcgtgaacagacatggccctgaggccgacagacacctgctgcgctgcctcttcagccacgtggacttctctggagatggcaagagcagcggcaaggacttccaccagacccagttcctgatccaggagtgtgccctgctgatcaccaagcccaacttcatcagcaccctgtcctatgccatcgacaaccccctgcactaccagaagagcctgaagccagccccccacctgtttgcccagctgagcaaggtgctgaagctgagcaaggtgcaggaggtgatcttcggcctggccctgctgaacagcagcagcagtgacctgcggggctttgctgcccagttcatcaagcagaagctgcctgacctgctgcggagctacattgatgctgatgtgtctggcaaccaggagggcggcttccaggacatcgccatcgaggtgctgcacctgctgctgagccacctgctgtttggccagaagggggccttcggcgtgggccaggagcagattgatgccttcctgaagaccctgcggcgggacttcccccaggagcgctgccctgtggtgctggcccccctgctgtacccagagaagagggacatcctgatggaccgcatcctgcctgattctggaggagtggccaagaccatgatggagagcagcctggccgacttcatgcaggaggtgggctacggcttctgtgccagcattgaggagtgcaggaacatcatcgtgcagtttggagtgcgggaggtgacagctgcccaggtggcccgggtgctgggcatgatggcccggacccacagcggcctgacagatggcatccccctgcagagcatcagcgcccctggcagcggcatctggagcgatggcaaggacaagagtgatggagcccaggcccacacctggaatgtggaggtgctgattgatgtgctgaaggagctgaaccccagcctgaacttcaaggaggtgacctatgagctggaccaccctggcttccagatccgggacagcaagggcctgcacaacgtggtgtatggcatccagaggggcctgggcatggaggtgtttcctgtggacctgatctaccggccctggaagcacgccgagggccagctgtccttcatccagcacagcctcatcaaccctgagatcttctgctttgctgactacccctgccacacagtggccacagacatcctgaaggcccccccagaagatgacaaccgggagatcgccacctggaagagcctggacctgattgagagcctgctgcggctggccgaggtgggccagtatgagcaggtgaagcagctgttctccttccccatcaagcactgcccagacatgctggtgctggccctgctgcagatcaacacctcctggcacaccctgcggcatgagctgatcagcaccctgatgcccatcttcctgggcaaccaccccaacagcgccatcatcctgcactacgcctggcacggccagggccagagccccagcatccggcagctgatcatgcacgccatggccgagtggtacatgagaggagagcagtatgaccaggccaagctgagccgcatcctggatgtggcccaggacctgaaggccctgtccatgctgctgaatggcaccccatttgcctttgtgattgacctggccgccctggccagcagaagagagtacctgaagctggacaagtggctgacagacaagatccgggagcacggggagcccttcatccaggcctgcatgaccttcctgaagaggcgctgccccagcatcctgggcggcctggcccctgagaaggaccagcccaagagcgcccagctgcccccagagaccctggccaccatgctggcctgcctgcaggcctgtgccggctctgtgtcccaggagctgtctgagaccatcctgaccatggtggccaactgcagcaatgtgatgaacaaggcccggcagcccccacctggggtgatgcccaagggccggcccccatctgccagcagcctggatgccatcagccctgtgcagattgaccccctggccggcatgaccagcctgagcatcggcggcagcgctgccccccacacccagagcatgcagggcttcccccccaacctgggcagcgccttcagcaccccccagagccctgccaaggccttcccccccctgagcacccccaaccagaccacagccttctctggaattggaggcctgagcagccagctgcctgtgggcggcctgggcaccggcagcctgactggaattggaactggagccctgggcctgcctgctgtgaacaatgacccctttgtgcagaggaagctgggcaccagcggcctgaaccagcccaccttccagcagagcaagatgaagcccagcgacctgagccaggtgtggccagaggccaaccagcacttcagcaaggagattgatgatgaggccaacagctacttccagaggatctacaaccaccccccccaccccaccatgtctgtggatgaggtgctggagatgctgcagcgcttcaaggacagcaccatcaagcgggagcgggaggtgttcaactgcatgctgaggaacctgtttgaggagtaccgcttcttcccccagtacccagacaaggagctgcacatcacagcctgcctgtttggaggcatcatcgagaagggcctggtgacctacatggccctgggcctggccctgcgctacgtgctggaggccctgaggaagcccttcggcagcaagatgtactactttggaattgctgccctggaccgcttcaagaaccggctgaaggactacccccagtactgccagcacctggccagcatcagccacttcatgcagttcccccaccacctgcaggagtacatcgagtatggccagcagagccgggacccccctgtgaagatgcagggcagcatcaccaccccaggcagcatcgccctggcccaggcccaggcccaggcccaggtgcctgccaaggcccccctggccggccaggtgtccaccatggtgaccaccagcaccaccaccaccgtggccaagacagtgacagtgacccggcccaccggggtgtccttcaagaaggatgtgcccccatccatcaacaccaccaacatcgacaccctgctggtggccacagaccagacagagcgcatcgtggagcccccagagaacatccaggagaagatcgccttcatcttcaacaacctgagccagagcaacatgacccagaaggtggaggagctgaaggagaccgtgaaggaggagttcatgccctgggtgtcccagtacctggtgatgaagagggtgtccattgagcccaacttccacagcctgtacagcaacttcctggacaccctgaagaaccctgagttcaacaagatggtgctgaatgagacctacagaaacatcaaggtgctgctgaccagtgacaaggctgctgccaacttcagtgacaggagcctgctgaagaacctgggccactggctgggcatgatcaccctggccaagaacaagcccatcctgcacacagacctggatgtgaagagcctgctgctggaggcctacgtgaagggccagcaggagctgctgtatgtggtgccctttgtggccaaggtgctggagagcagcatccgctctgtggtgttccggccccccaacccctggaccatggccatcatgaatgtgctggccgagctgcaccaggagcatgacctgaagctgaacctgaagtttgaaattgaggtgctgtgcaagaacctggccctggacatcaatgagctgaagccaggcaacctgctgaaggacaaggaccggctgaagaacctggatgagcagctgagcgcccccaagaaggatgtgaagcagcctgaggagctgccccccatcaccaccaccaccaccagcaccaccccagccaccaacaccacctgcacagccaccgtgcccccccagccccagtacagctaccatgacatcaacgtgtacagcctggccggcctggccccccacatcaccctgaaccccaccatccccctcttccaggcccacccccagctgaagcagtgtgtgcggcaggccatcgagagagctgtgcaggagctggtgcaccctgtggtggacaggagcatcaagatcgccatgaccacctgtgagcagatcgtgaggaaggactttgccctggacagcgaggagagcaggatgagaattgctgcccaccacatgatgaggaacctgacagctggcatggccatgatcacctgccgggagcccctgctgatgagcatcagcaccaacctgaagaacagctttgccagcgccctgaggacagccagcccccagcagcgggagatgatggaccaggccgccgcccagctggcccaggacaactgtgagctggcctgctgcttcatccagaagacagctgtggagaaggccggccctgagatggacaagaggctggccacagaatttgagctgaggaagcacgcccggcaggagggccgccgctactgtgaccctgtggtgctgacctaccaggccgagaggatgcctgagcagatccggctgaaggtgggcggcgtggaccccaagcagctggccgtgtatgaggagtttgccagaaatgtgcccggcttcctgcccaccaatgacctgagccagcccaccggcttcctggcccagcccatgaagcaggcctgggccacagatgatgtggcccagatctatgacaagtgcatcacagagctggagcagcacctgcacgccatcccccccaccctggccatgaacccccaggcccaggccctgcggagcctgctggaggtggtggtgctgagcaggaacagcagagatgccatcgccgccctgggcctgctgcagaaggctgtggagggcctgctggatgccaccagcggggctgatgctgacctgctgctgcgctaccgggagtgccacctgctggtgctgaaggccctgcaggacggccgggcctacggcagcccctggtgcaacaagcagatcacccgctgcctgattgagtgcagagatgagtacaagtacaacgtggaggccgtggagctgctgatccggaaccacctggtgaacatgcagcagtatgacctgcacctggcccagagcatggagaatggcctgaactacatggctgtggcctttgccatgcagctggtgaagatcctgctggtggatgagaggtctgtggcccacgtgacagaggccgacctcttccacaccatcgagaccctgatgaggatcaatgcccacagcagaggaaatgcccctgagggcctgccccagctgatggaggtggtgcgcagcaactatgaggccatgattgaccgggcccatggaggccccaacttcatgatgcacagcggcatcagccaggcctctgaatatgatgatcctcctggcctgcgggagaaggccgagtacctgctgcgggagtgggtgaacctgtaccacagcgctgctgctggccgggacagcaccaaggccttcagcgcctttgtgggccagatgcaccagcagggcatcctgaagacagatgacctgatcacccgcttcttccggctgtgcacagagatgtgtgtggagatctcctaccgggcccaggccgagcagcagcacaacccagctgccaaccccaccatgatccgggccaagtgctaccacaacctggatgcctttgtgcggctgattgccctgctggtgaagcacagcggggaggccaccaacacagtgaccaagatcaacctgctgaacaaggtgctgggcatcgtggtgggcgtgctgctgcaggaccatgatgtgcggcagagcgagttccagcagctgccctaccaccgcatcttcatcatgctgctgctggagctgaatgcccctgagcacgtgctggagaccatcaacttccagaccctgacagccttctgcaacaccttccacatcctgcggcccaccaaggcccctggctttgtgtatgcctggctggagctgatcagccaccgcatcttcatcgccaggatgctggcccacaccccccagcagaagggctggcccatgtatgcccagctgctgattgacctcttcaagtacctggcccccttcctgagaaatgtggagctgaccaagcccatgcagatcctgtacaagggcaccctgcgggtgctgctggtgctgctgcatgacttccctgagttcctgtgtgactaccactacggcttctgtgatgtgatcccccccaactgcatccagctgaggaacctgatcctgagcgccttccccaggaacatgaggctgcctgaccccttcacccccaacctgaaggtggacatgctgtctgagatcaacatcgccccccgcatcctgaccaacttcaccggggtgatgccaccccagttcaagaaggacctggacagctacctgaagaccaggagccctgtgaccttcctgagtgacctgcggagcaacctgcaggtgtccaatgagcccggcaaccgctacaacctgcagctgatcaatgccctggtgctgtatgtgggcacccaggccatcgcccacatccacaacaagggcagcacccccagcatgagcaccatcacccacagcgcccacatggacatcttccagaacctggccgtggacctggacacagagggccgctacctgttcctgaatgccatcgccaaccagctgcgctaccccaacagccacacccactacttcagctgcaccatgctgtacctgtttgctgaggccaacacagaggccatccaggagcagatcaccagggtgctgctggagcggctgattgtgaaccggccccacccctggggcctgctgatcaccttcatcgagctgatcaagaacccagccttcaagttctggaaccacgagtttgtgcactgtgcccctgagattgagaagctgttccagagcgtggcccagtgctgcatgggccagaagcaggcccagcaggtgatggagggcactggagccagctag

SEQ ID NO: 146581 - DNA, 6453 bp, Artificial Sequence
  Description of Artificial Sequence: Synthetic coding sequence
atgaacctggacagcctgagcctggccctgagccagatctcctacctggtggacaacctgaccaagaagaactaccgggccagccagcaggagatccagcacatcgtgaacagacatggccctgaggccgacagacacctgctgcgctgcctcttcagccacgtggacttctctggagatggcaagagcagcggcaaggacttccaccagacccagttcctgatccaggagtgtgccctgctgatcaccaagcccaacttcatcagcaccctgtcctatgccatcgacaaccccctgcactaccagaagagcctgaagccagccccccacctgtttgcccagctgagcaaggtgctgaagctgagcaaggtgcaggaggtgatcttcggcctggccctgctgaacagcagcagcagtgacctgcggggctttgctgcccagttcatcaagcagaagctgcctgacctgctgcggagctacattgatgctgatgtgtctggcaaccaggagggcggcttccaggacatcgccatcgaggtgctgcacctgctgctgagccacctgctgtttggccagaagggggccttcggcgtgggccaggagcagattgatgccttcctgaagaccctgcggcgggacttcccccaggagcgctgccctgtggtgctggcccccctgctgtacccagagaagagggacatcctgatggaccgcatcctgcctgattctggaggagtggccaagaccatgatggagagcagcctggccgacttcatgcaggaggtgggctacggcttctgtgccagcattgaggagtgcaggaacatcatcgtgcagtttggagtgcgggaggtgacagctgcccaggtggcccgggtgctgggcatgatggcccggacccacagcggcctgacagatggcatccccctgcagagcatcagcgcccctggcagcggcatctggagcgatggcaaggacaagagtgatggagcccaggcccacacctggaatgtggaggtgctgattgatgtgctgaaggagctgaaccccagcctgaacttcaaggaggtgacctatgagctggaccaccctggcttccagatccgggacagcaagggcctgcacaacgtggtgtatggcatccagaggggcctgggcatggaggtgtttcctgtggacctgatctaccggccctggaagcacgccgagggccagctgtccttcatccagcacagcctcatcaaccctgagatcttctgctttgctgactacccctgccacacagtggccacagacatcctgaaggcccccccagaagatgacaaccgggagatcgccacctggaagagcctggacctgattgagagcctgctgcggctggccgaggtgggccagtatgagcaggtgaagcagctgttctccttccccatcaagcactgcccagacatgctggtgctggccctgctgcagatcaacacctcctggcacaccctgcggcatgagctgatcagcaccctgatgcccatcttcctgggcaaccaccccaacagcgccatcatcctgcactacgcctggcacggccagggccagagccccagcatccggcagctgatcatgcacgccatggccgagtggtacatgagaggagagcagtatgaccaggccaagctgagccgcatcctggatgtggcccaggacctgaaggccctgtccatgctgctgaatggcaccccatttgcctttgtgattgacctggccgccctggccagcagaagagagtacctgaagctggacaagtggctgacagacaagatccgggagcacggggagcccttcatccaggcctgcatgaccttcctgaagaggcgctgccccagcatcctgggcggcctggcccctgagaaggaccagcccaagagcgcccagctgcccccagagaccctggccaccatgctggcctgcctgcaggcctgtgccggctctgtgtcccaggagctgtctgagaccatcctgaccatggtggccaactgcagcaatgtgatgaacaaggcccggcagcccccacctggggtgatgcccaagggccggcccccatctgccagcagcctggatgccatcagccctgtgcagattgaccccctggccggcatgaccagcctgagcatcggcggcagcgctgccccccacacccagagcatgcagggcttcccccccaacctgggcagcgccttcagcaccccccagagccctgccaaggccttcccccccctgagcacccccaaccagaccacagccttctctggaattggaggcctgagcagccagctgcctgtgggcggcctgggcaccggcagcctgactggaattggaactggagccctgggcctgcctgctgtgaacaatgacccctttgtgcagaggaagctgggcaccagcggcctgaaccagcccaccttccagcagacagacctgagccaggtgtggccagaggccaaccagcacttcagcaaggagattgatgatgaggccaacagctacttccagaggatctacaaccaccccccccaccccaccatgtctgtggatgaggtgctggagatgctgcagcgcttcaaggacagcaccatcaagcgggagcgggaggtgttcaactgcatgctgaggaacctgtttgaggagtaccgcttcttcccccagtacccagacaaggagctgcacatcacagcctgcctgtttggaggcatcatcgagaagggcctggtgacctacatggccctgggcctggccctgcgctacgtgctggaggccctgaggaagcccttcggcagcaagatgtactacttcggcattgctgccctggaccgcttcaagaaccggctgaaggactacccccagtactgccagcacctggccagcatcagccacttcatgcagttcccccaccacctgcaggagtacattgaatatggccagcagagccgggacccccctgtgaagatgcagggcagcatcaccaccccaggcagcatcgccctggcccaggcccaggcccaggcccaggtgcctgccaaggcccccctggccggccaggtgtccaccatggtgaccaccagcaccaccaccaccgtggccaagacagtgacagtgacccggcccactggagtgtccttcaagaaggatgtgccccccagcatcaacaccaccaacatcgacaccctgctggtggccacagaccagacagaaagaattgtggagcccccagagaacatccaggagaagatcgccttcatcttcaacaacctgagccagagcaacatgacccagaaggtggaggagctgaaggagaccgtgaaggaggagttcatgccctgggtgtcccagtacctggtgatgaagagggtgtccattgagcccaacttccacagcctgtacagcaacttcctggacaccctgaagaaccctgagttcaacaagatggtgctgaatgagacctacagaaacatcaaggtgctgctgaccagtgacaaggccgccgccaacttcagtgacaggagcctgctgaagaacctgggccactggctgggcatgatcaccctggccaagaacaagcccatcctgcacacagacctggatgtgaagagcctgctgctggaggcctacgtgaagggccagcaggagctgctgtatgtggtgccctttgtggccaaggtgctggagagcagcatccgctctgtggtgttccggccccccaacccctggaccatggccatcatgaatgtgctggccgagctgcaccaggagcatgacctgaagctgaacctgaagtttgaaattgaggtgctgtgcaagaacctggccctggacatcaatgagctgaagccaggcaacctgctgaaggacaaggaccggctgaagaacctggatgagcagctgagcgcccccaagaaggatgtgaagcagcctgaggagctgccccccatcaccaccaccaccaccagcaccaccccagccaccaacaccacctgcacagccaccgtgcccccccagccccagtacagctaccatgacatcaacgtgtacagcctggccggcctggccccccacatcaccctgaaccccaccatccccctcttccaggcccacccccagctgaagcagtgtgtgcggcaggccatcgagagagctgtgcaggagctggtgcaccctgtggtggacaggagcatcaagatcgccatgaccacctgtgagcagatcgtgaggaaggactttgccctggacagcgaggagagcaggatgagaattgctgcccaccacatgatgaggaacctgacagctggcatggccatgatcacctgccgggagcccctgctgatgagcatcagcaccaacctgaagaacagctttgccagcgccctgaggacagccagcccccagcagcgggagatgatggaccaggccgccgcccagctggcccaggacaactgtgagctggcctgctgcttcatccagaagacagctgtggagaaggccggccctgagatggacaagaggctggccacagaatttgagctgaggaagcacgcccggcaggagggccgccgctactgtgaccctgtggtgctgacctaccaggccgagaggatgcctgagcagatccggctgaaggtgggcggcgtggaccccaagcagctggccgtgtatgaggagtttgccagaaatgtgcccggcttcctgcccaccaatgacctgagccagcccaccggcttcctggcccagcccatgaagcaggcctgggccacagatgatgtggcccagatctatgacaagtgcatcacagagctggagcagcacctgcacgccatcccccccaccctggccatgaacccccaggcccaggccctgcggagcctgctggaggtggtggtgctgagcaggaacagcagagatgccatcgccgccctgggcctgctgcagaaggctgtggagggcctgctggatgccaccagcggggctgatgctgacctgctgctgcgctaccgggagtgccacctgctggtgctgaaggccctgcaggacggccgggcctacggcagcccctggtgcaacaagcagatcacccgctgcctgattgaatgtagagatgagtacaagtacaacgtggaggccgtggagctgctgatccggaaccacctggtgaacatgcagcagtatgacctgcacctggcccagagcatggagaatggcctgaactacatggctgtggcctttgccatgcagctggtgaagatcctgctggtggatgagaggtctgtggcccacgtgacagaagctgacctcttccacaccatcgagaccctgatgaggatcaatgcccacagcagaggaaatgcccctgagggcctgccccagctgatggaggtggtgcgcagcaactatgaggccatgattgaccgggcccacggcggccccaacttcatgatgcacagcggcatcagccaggcctctgaatatgatgaccccccaggcctgcgggagaaggccgagtacctgctgcgggagtgggtgaacctgtaccacagcgctgctgctggccgggacagcaccaaggccttcagcgcctttgtgggccagatgcaccagcagggcatcctgaagacagatgacctgatcacccgcttcttccggctgtgcacagagatgtgtgtggagatctcctaccgggcccaggccgagcagcagcacaacccagctgccaaccccaccatgatccgggccaagtgctaccacaacctggatgcctttgtgcggctcatcgccctgctggtgaagcacagcggggaggccaccaacacagtgaccaagatcaacctgctgaacaaggtgctgggcatcgtggtgggcgtgctgctgcaggaccatgatgtgcggcagagcgagttccagcagctgccctaccaccgcatcttcatcatgctgctgctggagctgaatgcccctgagcacgtgctggagaccatcaacttccagaccctgacagccttctgcaacaccttccacatcctgcggcccaccaaggcccctggctttgtgtatgcctggctggagctgatcagccaccgcatcttcatcgccaggatgctggcccacaccccccagcagaagggctggcccatgtatgcccagctgctgattgacctcttcaagtacctggcccccttcctgagaaatgtggagctgaccaagcccatgcagatcctgtacaagggcaccctgcgggtgctgctggtgctgctgcatgacttccctgagttcctgtgtgactaccactacggcttctgtgatgtgattcctcccaactgcatccagctgaggaacctgatcctgagcgccttccccaggaacatgaggctgcctgaccccttcacccccaacctgaaggagatcatgctgtag

SEQ ID NO: 146582 - DNA, 3213 bp, Artificial Sequence
  Description of Artificial Sequence: Synthetic coding sequence
atgctgctgaatggcaccccatttgccttcgtcatcgacctggccgccctggccagccggcgggagtacctgaagctggacaagtggctgacagacaagatccgggagcacggggagcccttcatccaggcctgcatgaccttcctgaagaggcgctgccccagcatcctgggcggcctggcccctgagaaggaccagcccaagagcgcccagctgcccccagagaccctggccaccatgctggcctgcctgcaggcctgtgccggctctgtgtcccaggagctgtctgagaccatcctgaccatggtggccaactgcagcaatgtgatgaacaaggcccggcagcccccacctggggtgatgcccaagggccggccccccagcgccagcagcctggatgccatcagccctgtgcagattgaccccctggccggcatgaccagcctgagcattggaggcagcgctgccccccacacccagagcatgcagggcttcccccccaacctgggcagcgccttcagcaccccccagagccctgccaaggccttcccccccctgagcacccccaaccagaccacagccttcagcggcatcggcggcctgagcagccagctgcctgtgggcggcctgggcaccggcagcctgaccggcatcggcaccggggccctgggcctgcctgctgtgaacaatgacccctttgtgcagaggaagctgggcaccagcggcctgaaccagcccaccttccagcagagcaagatgaagcccagcgacctgagccaggtgtggccagaggccaaccagcacttcagcaaggagattgatgatgaggccaacagctacttccagaggatctacaaccaccccccccaccccaccatgtctgtggatgaggtgctggagatgctgcagcgcttcaaggacagcaccatcaagcgggagcgggaggtgttcaactgcatgctgaggaacctgtttgaggagtaccgcttcttcccccagtacccagacaaggagctgcacatcacagcctgcctgtttggaggcatcatcgagaagggcctggtgacctacatggccctgggcctggccctgcgctacgtgctggaggccctgaggaagcccttcggcagcaagatgtactacttcggcattgctgccctggaccgcttcaagaaccggctgaaggactacccccagtactgccagcacctggccagcatcagccacttcatgcagttcccccaccacctgcaggagtacattgaatatggccagcagagccgggacccccctgtgaagatgcagggcagcatcaccaccccaggcagcatcgccctggcccaggcccaggcccaggcccaggtgcctgccaaggcccccctggccggccaggtgtccaccatggtgaccaccagcaccaccaccaccgtggccaagacagtgacagtgacccggcccactggagtgtccttcaagaaggatgtgccccccagcatcaacaccaccaacatcgacaccctgctggtggccacagaccagacagaaagaattgtggagcccccagagaacatccaggagaagatcgccttcatcttcaacaacctgagccagagcaacatgacccagaaggtggaggagctgaaggagaccgtgaaggaggagttcatgccctgggtgtcccagtacctggtgatgaagagggtgtccattgagcccaacttccacagcctgtacagcaacttcctggacaccctgaagaacctgatcacccgcttcttccggctgtgcacagagatgtgtgtggagatctcctaccgggcccaggccgagcagcagcacaacccagctgccaaccccaccatgatccgggccaagtgctaccacaacctggatgcctttgtgcggctgattgccctgctggtgaagcacagcggggaggccaccaacacagtgaccaagatcaacctgctgaacaaggtgctgggcatcgtggtgggcgtgctgctgcaggaccatgatgtgcggcagagcgagttccagcagctgccctaccaccgcatcttcatcatgctgctgctggagctgaatgcccctgagcacgtgctggagaccatcaacttccagaccctgacagccttctgcaacaccttccacatcctgcggcccaccaaggcccctggctttgtgtatgcctggctggagctgatcagccaccgcatcttcatcgccaggatgctggcccacaccccccagcagaagggctggcccatgtatgcccagctgctgattgacctcttcaagtacctggcccccttcctgagaaatgtggagctgaccaagcccatgcagatcctgtacaagggcaccctgcgggtgctgctggtgctgctgcatgacttccctgagttcctgtgtgactaccactacggcttctgtgatgtgatcccccccaactgcatccagctgaggaacctgatcctgagcgccttccccaggaacatgaggctgcctgaccccttcacccccaacctgaaggtggacatgctgtctgagatcaacatcgccccccgcatcctgaccaacttcaccggggtgatgccaccccagttcaagaaggacctggacagctacctgaagaccaggagccctgtgaccttcctgagtgacctgcggagcaacctgcaggtgtccaatgagcccggcaaccgctacaacctgcagctgatcaatgccctggtgctgtatgtgggcacccaggccatcgcccacatccacaacaagggcagcacccccagcatgagcaccatcacccacagcgcccacatggacatcttccagaacctggccgtggacctggacacagagggccgctacctgttcctgaatgccatcgccaaccagctgcgctaccccaacagccacacccactacttcagctgcaccatgctgtacctgtttgctgaggccaacacagaggccatccaggagcagatcaccagggtgctgctggagcggctgattgtgaaccggccccacccctggggcctgctgatcaccttcatcgagctgatcaagaacccagccttcaagttctggaaccacgagtttgtgcactgtgcccctgagattgagaagctgttccagagcgtggcccagtgctgcatgggccagaagcaggcccagcaggtgatggagggcactggagccagctag

SEQ ID NO: 146583 - DNA, 4656 bp, Artificial Sequence
  Description of Artificial Sequence: Synthetic coding sequence
atgaacctggacagcctgagcctggccctgagccagatctcctacctggtggacaacctgaccaagaagaactaccgggccagccagcaggagatccagcacatcgtgaacagacatggccctgaggccgacagacacctgctgcgctgcctcttcagccacgtggacttctctggagatggcaagagcagcggcaaggacttccaccagacccagttcctgatccaggagtgtgccctgctgatcaccaagcccaacttcatcagcaccctgtcctatgccatcgacaaccccctgcactaccagaagagcctgaagccagccccccacctgtttgcccagctgagcaaggtgctgaagctgagcaaggtgcaggaggtgatcttcggcctggccctgctgaacagcagcagcagtgacctgcggggctttgctgcccagttcatcaagcagaagctgcctgacctgctgcggagctacattgatgctgatgtgtctggcaaccaggagggcggcttccaggacatcgccatcgaggtgctgcacctgctgctgagccacctgctgtttggccagaagggggccttcggcgtgggccaggagcagattgatgccttcctgaagaccctgcggcgggacttcccccaggagcgctgccctgtggtgctggcccccctgctgtacccagagaagagggacatcctgatggaccgcatcctgcctgattctggaggagtggccaagaccatgatggagagcagcctggccgacttcatgcaggaggtgggctacggcttctgtgccagcattgaggagtgcaggaacatcatcgtgcagtttggagtgcgggaggtgacagctgcccaggtggcccgggtgctgggcatgatggcccggacccacagcggcctgacagatggcatccccctgcagagcatcagcgcccctggcagcggcatctggagcgatggcaaggacaagagtgatggagcccaggcccacacctggaatgtggaggtgctgattgatgtgctgaaggagctgaaccccagcctgaacttcaaggaggtgacctatgagctggaccaccctggcttccagatccgggacagcaagggcctgcacaacgtggtgtatggcatccagaggggcctgggcatggaggtgtttcctgtggacctgatctaccggccctggaagcacgccgagggccagctgtccttcatccagcacagcctcatcaaccctgagatcttctgctttgctgactacccctgccacacagtggccacagacatcctgaaggcccccccagaagatgacaaccgggagatcgccacctggaagagcctggacctgattgagagcctgctgcggctggccgaggtgggccagtatgagcaggtgaagcagctgttctccttccccatcaagcactgcccagacatgctggtgctggccctgctgcagatcaacacctcctggcacaccctgcggcatgagctgatcagcaccctgatgcccatcttcctgggcaaccaccccaacagcgccatcatcctgcactacgcctggcacggccagggccagagccccagcatccggcagctgatcatgcacgccatggccgagtggtacatgagaggagagcagtatgaccaggccaagctgagccgcatcctggatgtggcccaggacctgaaggccctgtccatgctgctgaatggcaccccatttgcctttgtgattgacctggccgccctggccagcagaagagagtacctgaagctggacaagtggctgacagacaagatccgggagcacggggagcccttcatccaggcctgcatgaccttcctgaagaggcgctgccccagcatcctgggcggcctggcccctgagaaggaccagcccaagagcgcccagctgcccccagagaccctggccaccatgctggcctgcctgcaggcctgtgccggctctgtgtcccaggagctgtctgagaccatcctgaccatggtggccaactgcagcaatgtgatgaacaaggcccggcagcccccacctggggtgatgcccaagggccggcccccatctgccagcagcctggatgccatcagccctgtgcagattgaccccctggccggcatgaccagcctgagcatcggcggcagcgctgccccccacacccagagcatgcagggcttcccccccaacctgggcagcgccttcagcaccccccagagccctgccaaggccttcccccccctgagcacccccaaccagaccacagccttctctggaattggaggcctgagcagccagctgcctgtgggcggcctgggcaccggcagcctgactggaattggaactggagccctgggcctgcctgctgtgaacaatgacccctttgtgcagaggaagctgggcaccagcggcctgaaccagcccaccttccagcagagcaagatgaagcccagcgacctgagccaggtgtggccagaggccaaccagcacttcagcaaggagattgatgatgaggccaacagctacttccagaggatctacaaccaccccccccaccccaccatgtctgtggatgaggtgctggagatgctgcagcgcttcaaggacagcaccatcaagcgggagcgggaggtgttcaactgcatgctgaggaacctgtttgaggagtaccgcttcttcccccagtacccagacaaggagctgcacatcacagcctgcctgtttggaggcatcatcgagaagggcctggtgacctacatggccctgggcctggccctgcgctacgtgctggaggccctgaggaagcccttcggcagcaagatgtactactttggaattgctgccctggaccgcttcaagaaccggctgaaggactacccccagtactgccagcacctggccagcatcagccacttcatgcagttcccccaccacctgcaggagtacatcgagtatggccagcagagccgggacccccctgtgaagatgcagggcagcatcaccaccccaggcagcatcgccctggcccaggcccaggcccaggcccaggtgcctgccaaggcccccctggccggccaggtgtccaccatggtgaccaccagcaccaccaccaccgtggccaagacagtgacagtgacccggcccaccggggtgtccttcaagaaggatgtgcccccatccatcaacaccaccaacatcgacaccctgctggtggccacagaccagacagagcgcatcgtggagcccccagagaacatccaggagaagatcgccttcatcttcaacaacctgagccagagcaacatgacccagaaggtggaggagctgaaggagaccgtgaaggaggagttcatgccctgggtgtcccagtacctggtgatgaagagggtgtccattgagcccaacttccacagcctgtacagcaacttcctggacaccctgaagaaccctgagttcaacaagatggtgctgaatgagacctacagaaacatcaaggtgctgctgaccagtgacaaggctgctgccaacttcagtgacaggagcctgctgaagaacctgggccactggctgggcatgatcaccctggccaagaacaagcccatcctgcacacagacctggatgtgaagagcctgctgctggaggcctacgtgaagggccagcaggagctgctgtatgtggtgccctttgtggccaaggtgctggagagcagcatccgctctgtggtgttccggccccccaacccctggaccatggccatcatgaatgtgctggccgagctgcaccaggagcatgacctgaagctgaacctgaagtttgaaattgaggtgctgtgcaagaacctggccctggacatcaatgagctgaagccaggcaacctgctgaaggacaaggaccggctgaagaacctggatgagcagctgagcgcccccaagaaggatgtgaagcagcctgaggagctgccccccatcaccaccaccaccaccagcaccaccccagccaccaacaccacctgcacagccaccgtgcccccccagccccagtacagctaccatgacatcaacgtgtacagcctggccggcctggccccccacatcaccctgaaccccaccatccccctcttccaggcccacccccagctgaagcagtgtgtgcggcaggccatcgagagagctgtgcaggagctggtgcaccctgtggtggacaggagcatcaagatcgccatgaccacctgtgagcagatcgtgaggaaggactttgccctggacagcgaggagagcaggatgagaattgctgcccaccacatgatgaggaacctgacagctggcatggccatgatcacctgccgggagcccctgctgatgagcatcagcaccaacctgaagaacagctttgccagcgccctgcgggtgtcctggctgttcccctggtaccgctacaagacctactactgcctgagcgtcatcatcttcttctttgtgtacatctggcactgggccctgcccctcatcctgaacaaccaccacatctgcctgatgagcagcatcatcctggactgcaacagcgtgcggcagagcatcatgtctgtgtgcttcttcttcttcctgctgtacagccagcatgatgtgtag

SEQ ID NO: 146584 - DNA, 951 bp, Artificial Sequence
  Description of Artificial Sequence: Synthetic coding sequence
atgctgctgctggagctgaatgcccctgagcacgtgctggagaccatcaacttccagaccctgacagccttctgcaacaccttccacatcctgcggcccaccaaggcccctggctttgtgtatgcctggctggagctgatcagccaccgcatcttcatcgccaggatgctggcccacaccccccagcagaagggctggcccatgtatgcccagctgctgattgacctcttcaagtacctggcccccttcctgagaaatgtggagctgaccaagcccatgcagatcctgtacaagggcaccctgcgggtgctgctggtgctgctgcatgacttccctgagttcctgtgtgactaccactacggcttctgtgatgtgattcctcccaactgcatccagctgaggaacctgatcctgagcgccttccccaggaacatgaggctgcctgaccccttcacccccaacctgaaggtggacatgctgtctgagatcaacatcgccccccgcatcctgaccaacttcaccggggtgatgccaccccagttcaagaaggacctggacagctacctgaagaccaggagccctgtgaccttcctgagtgacctgcggagcaacctgcaggtgtccaatgaacctggcaaccgctacaacctgcagctgatcaatgccctggtgctgtatgtgggcacccaggccatcgcccacatccacaacaagggcagcacccccagcatgagcaccatcacccacagcgcccacatggacatcttccagaacctggccgtggacctggacacagagggccgctacctgttcctgaatgccatcgccaaccagagcggcacccagatcgccaccctgaccacctctgtggccccctgctgcaccttcctgcagaggcccatcaggaagcccagcaagaacagaagccaggagttctcctggaatggatag

SEQ ID NO: 146585 - DNA, 2778 bp, Artificial Sequence
  Description of Artificial Sequence: Synthetic coding sequence
atggacaggagcggctttggagagatcagcagccctgtgatccgggaggccgaggtgaccaggacagccaggaagcagagcgcccagaagagggtgctgctgcaggccagccaggatgagaactttggaaacaccacccccaggaaccaggtgatccccaggacccccagcagcttccggcagcccttcacccccaccagccgcagcctgctgcggcagcctgacatcagctgcatcctgggcaccggcggcaagagcccccggctgacccagagcagcggcttcttcggcaacctgtccatggtgaccaacctggatgacagcaactgggccgccgccttcagcagccagaggagcggcctcttcaccaacacagagccccacagcatcacagaagatgtgaccatctctgctgtgatgctgagagaagatgaccccggggaggccgcctccatgtccatgttcagtgacttcctgcagagcttcctgaagcacagcagcagcacagtgtttgacctggtggaggagtatgagaacatctgtggcagccaggtgaacatcctgagcaagatcgtgtcccgggccaccccaggcctgcagaagttcagcaagacagcctccatgctgtggctgctgcagcaggagatggtgacctggaggctgctggccagcctgtacagagaccgcatccagagcgccctggaggaggagagcgtgtttgctgtgacagctgtgaatgccagcgagaagacagtggtggaggccctcttccagagggacagcctggtgcggcagagccagctggtggtggactggctggagagcatcgccaaggatgaaattggagagttcagtgacaacatcgagttctacgccaagtctgtgtactgggagaacaccctgcacaccctgaagcagaggcagctgaccagctatgtgggctctgtgcggcccctggtgacagagctggaccctgatgcccccatccggcagaagatgcccctggatgacctggacagagaagatgaggtgcggctgctgaagtacctgttcaccctcatccgggccggcatgacagaggaggcccagaggctgtgcaagagatgtggccaggcctggagggctgccaccctggagggctggaagctgtaccatgaccccaacgtgaatggaggaacagagctggagcctgtggagggcaacccctaccgccgcatctggaagatcagctgctggaggatggccgaggatgagctgttcaacagatatgagcgggccatctatgctgccctgagcggcaacctgaagcagctgctgcctgtgtgtgacacctgggaggacacagtgtgggcctacttccgggtgatggtggacagcctggtggagcaggagatccagacctctgtggccaccctggatgaaacagaggagctgccccgggagtacctgggcgccaactggaccctggagaaggtgtttgaggagctgcaggccacagacaagaagagggtgctggaggagaaccaggagcactaccacatcgtgcagaagttcctgatcctgggggacattgatggcctgatggatgagttcagcaagtggctgagcaagagcaggaacaacctgcccggccacctgctgcgcttcatgacccacctgatcctcttcttccgcaccctgggcctgcagaccaaggaggaggtgtccattgaggtgctgaagacctacatccagctgctgatccgggagaagcacaccaacctgattgccttctacacctgccacctgccccaggacctggccgtggcccagtatgccctcttcctggagagcgtgacagaatttgagcagaggcaccactgcctggagctggccaaggaggccgacctggatgtggccaccatcaccaagacagtggtggagaacatcaggaagaaggacaacggggagttcagccaccacgacctggccccagccctggacaccggcaccacagaagaagatcggctgaagattgatgtgattgactggctggtgtttgatcctgcccagagagctgaggccctgaagcagggcaatgccatcatgaggaagttcctggccagcaagaagcatgaagctgccaaggaggtgtttgtgaagatcccccaggacagcattgctgagatctacaaccagtgtgaggagcagggcatggagagccccctgcctgcagaagatgacaatgccatccgggagcacctgtgcatccgggcctacctggaggcccacgagaccttcaatgagtggttcaagcacatgaacagcgtgccccagaagccagccctgatcccccagcccaccttcacagagaaggtggcccacgagcacaaggagaagaagtatgagatggactttggcatctggaagggccacctggatgccctgacagcagatgtgaaggagaagatgtacaacgtgctgctgtttgtggatggcggctggatggtggatgtgcgggaggatgccaaggaggaccacgagaggacccaccagatggtgctgctgaggaagctgtgcctgcccatgctgtgcttcctgctgcacaccatcctgcacagcacaggccagtaccaggagtgcctgcagctggccgacatggtgtcctctgagcggcacaagctgtacctggtgttcagcaaggaggagctgaggaagctgctgcagaagctgcgggagagcagcctgatgctgctggaccagggcctggaccccctgggctatgagatccagctgtag

SEQ ID NO: 146586 - DNA, 1623 bp, Artificial Sequence
  Description of Artificial Sequence: Synthetic coding sequence
atggtgaggacagatggccacaccctgtctgagaagaggaactaccaggtgaccaacagcatgtttggagccagcaggaagaagtttgtggagggcgtggacagcgactaccatgatgagaacatgtactacagccagagctccatgttcccccacaggtctgagaaggacatgctggccagccccagcaccagcggccagctgagccagtttggagccagcctgtatggccagcagagcgccctgggcctgcccatgaggggcatgagcaacaacaccccccagctgaacagaagcctgagccagggcacccagctgcccagccacgtgacccccaccaccggggtgcccaccatgagcctgcacaccccacccagccccagccggggcatcctgcccatgaaccccaggaacatgatgaaccacagccaggtgggccagggcatcggcatccccagcaggaccaacagcatgagcagcagcggcctgggcagccccaacagaagcagccccagcatcatctgcatgcccaagcagcagcccagccggcagcccttcaccgtgaacagcatgagcggcttcggcatgaacagaaaccaggccttcggcatgaacaacagcctgagcagcaacatcttcaacggcacagatggctctgaaaatgtgacaggcctggacctgagtgacttccctgccctggccgacaggaacagaagagagggcagcggcaaccccacccccctcatcaaccccctggccggccgggccccctacgtgggcatggtgaccaagccagccaatgagcagagccaggacttcagcatccacaatgaagacttccctgccctgcccggcagcagctacaaggaccccaccagcagcaatgatgacagcaagagcaacctgaacaccagcggcaagaccaccagcagcacagatggccccaagtttcctggggacaagagcagcaccacccagaacaacaaccagcagaagaagggcatccaggtgctgcctgatggccgggtgaccaacatcccccagggcatggtgacagaccagtttggcatgattggcctgctgaccttcatccgggctgctgagacagatcctggcatggtgcacctggccctgggcagtgacctgaccaccctgggcctgaacctgaacagcccagaaaatctctaccccaagtttgccagcccctgggccagcagcccctgccggccccaggacatcgacttccacgtgcccagcgagtacctgaccaacatccacatccgggacaagctggccgccatcaagctgggccgctatggagaggacctgctcttctacctgtactacatgaatggaggagatgtgctgcagctgctggccgctgtggagctgttcaacagagactggagataccacaaggaggagcgggtgtggatcacccgggcccctggcatggagcccaccatgaagaccaacacctatgaaagaggcacctactacttctttgactgcctgaactggaggaaggtggccaaggagttccacctggagtatgacaagctggaggagcggccccacctgcccagcaccttcaactacaacccagcccagcaggccttctag

SEQ ID NO: 146587 - DNA, 78 bp, Artificial Sequence
  Description of Artificial Sequence: Synthetic coding sequence
atggtgaggacagatggccacaccctgtctgagaagaggaactaccaggtgaccaacagcatgtttggagccagctag

SEQ ID NO: 146588 - DNA, 552 bp, Artificial Sequence
  Description of Artificial Sequence: Synthetic coding sequence
atggtgaggacagatggccacaccctgtctgagaagaggaactaccaggtgaccaacagcatgtttggagccagcaggaagaagtttgtggagggcgtggacagcgactaccatgatgagaacatgtactacagccagagctccatgttcccccacaggtctgagaaggacatgctggccagccccagcaccagcggccagctgagccagtttggagccagcctgtatggccagcagagcgccctgggcctgcccatgaggggcatgagcaacaacaccccccagctgaacagaagcctgagccagggcacccagctgcccagccacgtgacccccaccaccggggtgcccaccatgagcctgcacaccccacccagccccagccggggcatcctgcccatgaaccccaggaacatgatgaaccacagccaggtgggccagggcatcggcatccccagcaggaccaacagcatgagcagcagcggcctgggcagccccaacagaagcagccccagcatcatctgcatgcccaagcagcagcccagcaggtag

SEQ ID NO: 146589 - DNA, 1623 bp, Artificial Sequence; identical to SEQ ID NO: 146586
  Description of Artificial Sequence: Synthetic coding sequence

SEQ ID NO: 146590 - DNA, 576 bp, Artificial Sequence
  Description of Artificial Sequence: Synthetic coding sequence
atggtgacagaccagtttggcatgattggcctgctgaccttcatccgggctgctgagacagaccccggcatggtgcacctggccctgggcagtgacctgaccaccctgggcctgaacctgaacagccctgagaacctgtaccccaagtttgccagcccctgggccagcagcccctgccggccccaggacatcgacttccacgtgcccagcgagtacctgaccaacatccacatccgggacaagctggccgccatcaagctgggccgctacggggaggacctgctcttctacctgtactacatgaatggaggagatgtgctgcagctgctggccgctgtggagctgttcaacagagactggagataccacaaggaggagcgggtgtggatcacccgggcccctggcatggagcccaccatgaagaccaacacctatgagcggggcacctactacttctttgactgcctgaactggaggaaggtggccaaggagttccacctggagtatgacaagctggaggagcggccccacctgcccagcaccttcaactacaacccagcccagcaggccttctag

SEQ ID NO: 146591 - DNA, 966 bp, Artificial Sequence
  Description of Artificial Sequence: Synthetic coding sequence
atggtgaggacagatggccacaccctgtctgagaagaggaactaccaggtgaccaacagcatgtttggagccagcaggaagaagtttgtggagggcgtggacagcgactaccatgatgagaacatgtactacagccagagctccatgttcccccacaggtctgagaaggacatgctggccagccccagcaccagcggccagctgagccagtttggagccagcctgtatggccagcagagcgccctgggcctgcccatgaggggcatgagcaacaacaccccccagctgaacagaagcctgagccagggcacccagctgcccagccacgtgacccccaccaccggggtgcccaccatgagcctgcacaccccacccagccccagccggggcatcctgcccatgaaccccaggaacatgatgaaccacagccaggtgggccagggcatcggcatccccagcaggaccaacagcatgagcagcagcggcctgggcagccccaacagaagcagccccagcatcatctgcatgcccaagcagcagcccagccggcagcccttcaccgtgaacagcatgagcggcttcggcatgaacagaaaccaggccttcggcatgaacaacagcctgagcagcaacatcttcaacggcacagatggctctgaaaatgtgacaggcctggacctgagtgacttccctgccctggccgacaggaacagaagagagggcagcggcaaccccacccccctcatcaaccccctggccggccgggccccctacgtgggcatggtgaccaagccagccaatgagcagagccaggacttcagcatccacaatgaagacttccctgccctgcccggcagcagctacaaggaccccaccagcagcaatgatgacagcaagagcaacctgaacaccagcggcaagaccaccagcagcacagatggccccaagtttcctggggacaagtag

SEQ ID NO: 146592 - DNA, 978 bp, Artificial Sequence
  Description of Artificial Sequence: Synthetic coding sequence
atgagcacagcccgggagcagcccatcttcagcacccgggcccacgtgttccagattgatcctgccaccaagaggaactggatcccagctgggaagcacgccctgactgtgtcctacttctatgatgccaccagaaatgtgtaccgcatcatcagcattggaggagccaaggccatcatcaacagcacagtgacccccaacatgaccttcaccaagaccagccagaagtttggccagtgggccgacagccgggccaacacagtgtatggcctgggctttgccagcgagcagcacctgacccaggtgccccccagccccctggtgtctgccaatggacctggagaggagaagctgttccgcagccagagcgcagatgcccctggccccacagagcgggagcggctgaagaagatgctgtctgagggctctgtgggggaggtgcagtgggaggccgagttctttgccctgcaggacagcaacaacaagctggccggggccctgcgggaggccaatgctgctgctgcccagtggaggcagcagctggaggcccagagagctgaggccgagcggctgcggcagagggtggccgagctggaggcccaggccgccagcgaggtgacccccactggagagaaggagggcctgggccagggccagagcctggagcagctggaggccctggtgcagaccaaggaccaggagatccagaccctgaagagccagacaggaggcccccgggaggccctggaggccgctgagcgggaggagacccagcagaaggtgcaggacctggagaccagaaatgctgagctggagcaccagctgcgggccatggagaggagcctggaggaggcccgggcagagcgggagcgggcccgggcagaggtgggccgggccgcccagctgctggatgtgtccctgtttgagctgtctgagctgcgggagggcctggcccggctggccgaggccgccccctag

SEQ ID NO: 146593 - DNA, 1716 bp, Artificial Sequence
  Description of Artificial Sequence: Synthetic coding sequence
atgctggagaccatcctgaggatgctggacaatgacagcatcctggtggatgccatcaggaagatcaaggatgatgtggagtactacgtggacagcagccaggaccctgactttgaggagaatgagttcctgtatgatgacctggacctggaggacatcccccaggccctggtggccaccagcccccccagccacagccacatggaggatgagatcttcaaccagagcagcagcacccccaccagcaccaccagcagcagccccatcccccccagccctgccaactgcaccacagaaaattctgaagatgacaagaagaggggccgcagcacagattctgaggtgtcccagagccctgccaagaatggcagcaagcctgtgcacagcaaccagcacccccagagccctgctgtgccccccacctaccccagcggccccccacctgctgccagcgccctgagcaccaccccaggcaacaacggggtgcctgccccagctgccccacccagcgccctgggccccaaggccagccctgcccccagccacaacagcggcaccccagccccctatgcccaggccgtggcccccccagcccccagcggccccagcaccacccagcccaggcctccttctgtgcagcccagcggcggcggcggcggcggcagcggcggcggcggcagcagcagcagcagcaacagcagcgctgggggcggggccggcaagcagaatggagccaccagctacagctctgtggtggccgacagccctgctgaggtggccctgagcagcagcggcggcaacaatgccagcagccaggccctgggcccccccagcggcccccacaaccccccacccagcaccagcaaggagcccagcgctgctgcccccactggagctggaggagtggcccctggcagcggcaacaacagcggcggccccagcctgctggtgcccctgcctgtgaacccccccagcagccccacccccagcttcagtgatgccaaggctgctggggccctgctgaatggccccccccagttcagcacagcccctgagatcaaggcccctgagcccctgagcagcctgaagtccatggccgagagagctgccatcagcagcggcatcgaggaccctgtgcccaccctgcacctgacagagcgggacatcatcctgagcagcaccagcgcccccccagccagcgcccagccccccctgcagctgtctgaggtgaacatccccctgagcctgggcgtgtgccccctgggccctgtgcccctgaccaaggagcagctgtaccagcaggccatggaggaggccgcctggcaccacatgccccaccccagcgacagcgagcgcatccggcagtacctgcccaggaacccctgccccaccccaccctaccaccaccagatgcccccaccccacagcgacacagtggagttctaccagaggctgagcacagagaccctcttcttcatcttctactacctggagcccagagatgtgaggacagcctgggtggacagcgaggccggccccctgcggcacaccagcgcccccctgcctgtggcccactggctgacccggggccccagccctgccctgctgcagcagccccagagccggcccacccccctgtgcagcagcgcccacagccaggccagcctggagaccactggagagctgagcagccccctgcccacccccctgctgtag

SEQ ID NO: 146594 - DNA, 2262 bp, Artificial Sequence
  Description of Artificial Sequence: Synthetic coding sequence
atggctgacaagaggaagctgcagggcgagattgaccgctgcctgaagaaggtgtctgaaggagtggagcagtttgaggacatctggcagaagctgcacaatgctgccaatgccaaccagaaggagaagtatgaggccgacctgaagaaggagatcaagaagctgcagaggctgcgggaccagatcaagacctgggtggccagcaatgagatcaaggacaagaggcagctgattgacaacaggaagctgattgagacccagatggagcgcttcaaggtggtggagcgggagaccaagaccaaggcctacagcaaggagggcctgggcctggcccagaaggtggaccctgcccagaaggagaaggaggaggtgggccagtggctgaccaacaccatcgacaccctgaacatgcaggtggaccagtttgagagcgaggtggagagcctgtctgtgcagaccaggaagaagaagggggacaaggacaagcaggaccgcatcgagggcctgaagaggcacatcgagaagcaccgctaccacgtgaggatgctggagaccatcctgaggatgctggacaatgacagcatcctggtggatgccatcaggaagatcaaggatgatgtggagtactacgtggacagcagccaggaccctgactttgaagaaaatgagttcctgtatgatgacctggacctggaggacatcccccaggccctggtggccaccagcccccccagccacagccacatggaggatgagatcttcaaccagagcagcagcacccccaccagcaccaccagcagcagccccatcccccccagccctgccaactgcaccacagagaacagtgaagatgacaagaagaggggccgcagcacagacagcgaggtgtcccagagccctgccaagaatggcagcaagcctgtgcacagcaaccagcacccccagagccctgctgtgccccccacctaccccagcggccccccacctgctgccagcgccctgagcaccaccccaggcaacaatggagtgcctgccccagctgcccctccttctgccctgggccccaaggccagccctgcccccagccacaacagcggcaccccagccccctatgcccaggccgtggcccccccagcccccagcggccccagcaccacccagccccggccccccagcgtgcagcccagcggcggcggcggcggcggcagcggcggcggcggcagcagcagcagcagcaacagcagcgctgggggcggggccggcaagcagaatggagccaccagctacagctctgtggtggccgacagccctgctgaggtggccctgagcagcagcggcggcaacaatgccagcagccaggccctgggccccccatctggcccccacaaccccccacccagcaccagcaaggagcccagcgctgctgcccccaccggggccggcggcgtggcccctggcagcggcaacaacagcggcggccccagcctgctggtgcccctgcctgtgaacccccccagcagccccacccccagcttcagtgatgccaaggccgccggggccctgctgaatggaccaccccagttcagcacagcccctgagatcaaggcccctgagcccctgagcagcctgaagtccatggccgagcgggccgccatcagcagcggcattgaagatcctgtgcccaccctgcacctgacagagcgggacatcatcctgagcagcaccagcgcccccccagccagcgcccagccccccctgcagctgtctgaggtgaacatccccctgagcctgggcgtgtgccccctgggccctgtgcccctgaccaaggagcagctgtaccagcaggccatggaggaggccgcctggcaccacatgccccaccccagcgacagcgagcgcatccggcagtacctgcccaggaacccctgccccaccccaccctaccaccaccagatgcccccaccccacagcgacacagtggagttctaccagaggctgagcacagagaccctcttcttcatcttctactacctggagggcaccaaggcccagtacctggccgccaaggccctgaagaagcagagctggaggttccacaccaagtacatgatgtggttccagagacatgaggagcccaagaccatcacagatgaatttgagcagggcacctacatctactttgattatgagaagtggggccagaggaagaaggagggcttcacctttgagtaccgctacctggaggaccgggacctgcagtag

SEQ ID NO: 146595 - DNA, 867 bp, Artificial Sequence
  Description of Artificial Sequence: Synthetic coding sequence
tgaaaggagcccagcgctgctgcccccaccggggccggcggcgtggcccctggcagcggcaacaacagcggcggccccagcctgctggtgcccctgcctgtgaacccccccagcagccccacccccagcttcagtgatgccaaggccgccggggccctgctgaatggaccaccccagttcagcacagcccctgagatcaaggcccctgagcccctgagcagcctgaagtccatggccgagcgggccgccatcagcagcggcattgaagatcctgtgcccaccctgcacctgacagagcgggacatcatcctgagcagcaccagcgcccccccagccagcgcccagccccccctgcagctgtctgaggtgaacatccccctgagcctgggcgtgtgccccctgggccctgtgcccctgaccaaggagcagctgtaccagcaggccatggaggaggccgcctggcaccacatgccccaccccagcgacagcgagcgcatccggcagtacctgcccaggaacccctgccccaccccaccctaccaccaccagatgcccccaccccacagcgacacagtggagttctaccagaggctgagcacagagaccctcttcttcatcttctactacctggagggcaccaaggcccagtacctggccgccaaggccctgaagaagcagagctggaggttccacaccaagtacatgatgtggttccagagacatgaggagcccaagaccatcacagatgaatttgagcagctggcccagagcctgagcctgaccaagtacagcagcctgtggctgagcgcccagcccggcaccccacccagccacccccccctgggccagctgctgggcctgctgtag

SEQ ID NO: 146596 - DNA, 2304 bp, Artificial Sequence
  Description of Artificial Sequence: Synthetic coding sequence
atgagccgcagcccagatgccaaggaggaccctgtggagtgccccctgtgcatggagcccctggagattgatgacatcaacttcttcccctgcacctgtggctaccagatctgccgcttctgctggcaccgcatcagaacagatgaaaatggcctgtgcccagcctgcaggaagccctacccagaggaccctgctgtgtacaagcccctgagccaggaggagctgcagaggatcaagaatgagaagaagcagaagcagaatgaaaggaagcagaagatcagtgaaaataggaagcacctggcctctgtgcgggtggtgcagaagaacctggtgtttgtggtgggcctgagccagaggctggccgaccctgaggtgctgaagaggcctgagtactttgggaagtttgggaagatccacaaggtggtgatcaacaacagcaccagctatgccggcagccagggccccagcgccagcgcctacgtgacctacatccgctcagaagatgccctgcgggccatccagtgtgtgaacaacgtggtggtggatggccgcaccctgaaggccagcctgggcaccaccaagtactgcagctacttcctgaagaacatgcagtgccccaagccagactgcatgtacctgcacgagctgggagatgaggccgccagcttcaccaaggaggagatgcaggccggcaagcaccaggagtatgagcagaagctgctgcaggagctgtacaagctgaaccccaacttcctgcagctgagcacaggctctgtggacaagaacaagaacaaggtgacccccctgcagagatatgacacccccatcgacaagcccagcgacagcctgagcattggaaatggagacaacagccagcagatcagcaacagcgacacccccagccccccacctggcctgagcaagagcaaccctgtgatccccatcagcagcagcaaccacagcgcccggagcccctttgagggcgctgtgacagagagccagagcctcttcagtgacaacttccgccaccccaaccccatccccagcggcctgccccccttccccagcagcccccagaccagcagtgactggcccacagcccctgagccccagagcctcttcaccagcgagaccatccctgtgagcagcagcacagactggcaggccgcctttggatttggcagcagcaagcagccagaagatgacctgggctttgacccctttgatgtgaccaggaaggccctggccgacctgattgagaaggagctgtctgtgcaggaccagcccagcctgagccccaccagcctgcagaacagcagcagccacaccaccacagccaagggccctggcagcggcttcctgcaccctgctgctgccaccaatgccaacagcctgaacagcaccttctctgtgctgccccagcgcttcccccagttccagcagcacagagctgtgtacaacagcttctccttccctggccaggccgcccgctacccctggatggccttccccagaaattccatcatgcacctgaaccacacagccaaccccaccagcaacagcaacttcctggacctgaacctgcccccccagcacaacacaggcctgggcggcatccctgtggccgacaacagcagctctgtggagagcctgaacatgaaggagtggcaggacggcctgcgggccctgctgcccaacatcaacatcaactttggaggcctgcccaacagcagcagccccagcaatgccaaccacagcgcccccaccagcaacacagccaccacagacagcctgtcctgggacagccctggctcctggacagatcctgccatcatcaccggcatcccagccagcagcggcaacagcctggacagcctgcaggatgacaaccccccccactggctgaagagcctgcaggccctgacagagatggatggccccagcgctgcccccagccagacccaccacagcgcccccttcagcacccagatccccctgcaccgggcctcctggaacccctaccccccacccagcaaccccagcagcttccacagccccccacctggcatctactacagagtgcagcactggacagccatccggcagagaggagccaccatcagaaaatgtcgcatctgccccaccctcttcagccccagccagcccaccacccacagcagcctgctgatctcctatgtgctgaagaaccctgtgcctgaccagttcttcttcagcctgaccccagatgccatgaggagccagggccactaccacctgttcatcaactgcaagaacttctgctag

SEQ ID NO: 146597 - DNA, 1728 bp, Artificial Sequence
  Description of Artificial Sequence: Synthetic coding sequence
atgagccgcagcccagatgccaaggaggaccctgtggagtgccccctgtgcatggagcccctggagattgatgacatcaacttcttcccctgcacctgtggctaccagatctgccgcttctgctggcaccgcatcagaacagatgaaaatggcctgtgcccagcctgcaggaagccctacccagaggaccctgctgtgtacaagcccctgagccaggaggagctgcagaggatcaagaatgagaagaagcagaagcagaatgaaaggaagcagaagatcagtgaaaataggaagcacctggcctctgtgcgggtggtgcagaagaacctggtgtttgtggtgggcctgagccagaggctggccgaccctgaggtgctgaagaggcctgagtactttgggaagtttgggaagatccacaaggtggtgatcaacaacagcaccagctatgccggcagccagggccccagcgccagcgcctacgtgacctacatccgctcagaagatgccctgcgggccatccagtgtgtgaacaacgtggtggtggatggccgcaccctgaaggccagcctgggcaccaccaagtactgcagctacttcctgaagaacatgcagtgccccaagccagactgcatgtacctgcacgagctgggagatgaggccgccagcttcaccaaggaggagatgcaggccggcaagcaccaggagtatgagcagaagctgctgcaggagctgtacaagctgaaccccaacttcctgcagctgagcacaggctctgtggacaagaacaagaacaaggtgacccccctgcagagatatgacacccccatcgacaagcccagcgacagcctgagcattggaaatggagacaacagccagcagatcagcaacagcgacacccccagccccccacctggcctgagcaagagcaaccctgtgatccccatcagcagcagcaaccacagcgcccggagcccctttgagggcgctgtgacagagagccagagcctcttcagtgacaacttccgccaccccaaccccatccccagcggcctgccccccttccccagcagcccccagaccagcagtgactggcccacagcccctgagccccagagcctcttcaccagcgagaccatccctgtgagcagcagcacagactggcaggccgcctttggatttggcagcagcaagcagccagaagatgacctgggctttgacccctttgatgtgaccaggaaggccctggccgacctgattgagaaggagctgtctgtgcaggaccagcccagcctgagccccaccagcctgcagaacagcagcagccacaccaccacagccaagggccctggcagcggcttcctgcaccctgctgctgccaccaatgccaacagcctgaacagcaccttctctgtgctgccccagcgcttcccccagttccagcagcacagagctgtgtacaacagcttctccttccctggccaggccgcccgctacccctggatggccttccccagaaattccatcatgcacctgaaccacacagccaaccccaccagcaacagcaacttcctggacctgaacctgcccccccagcacaacacaggcctgggcggcatccctgtggccggggaggaggaggtgaaggtgtccaccatgcccctgagcaccagcagccacagcctgcagcagggccagcagcccaccagcctgcacaccaccgtggcctag

SEQ ID NO: 146598 - DNA, 1302 bp, Artificial Sequence
  Description of Artificial Sequence: Synthetic coding sequence
atgagccgcagcccagatgccaaggaggaccctgtggagtgccccctgtgcatggagcccctggagattgatgacatcaacttcttcccctgcacctgtggctaccagatctgccgcttctgctggcaccgcatcagaacagatgaaaatggcctgtgcccagcctgcaggaagccctacccagaggaccctgctgtgtacaagcccctgagccaggaggagctgcagaggatcaagaatgagaagaagcagaagcagaatgaaaggaagcagaagatcagtgaaaataggaagcacctggcctctgtgcgggtggtgcagaagaacctggtgtttgtggtgggcctgagccagaggctggccgaccctgaggtgctgaagaggcctgagtactttgggaagtttgggaagatccacaaggtggtgatcaacaacagcaccagctatgccggcagccagggccccagcgccagcgcctacgtgacctacatccgctcagaagatgccctgcgggccatccagtgtgtgaacaacgtggtggtggatggccgcaccctgaaggccagcctgggcaccaccaagtactgcagctacttcctgaagaacatgcagtgccccaagccagactgcatgtacctgcacgagctgggagatgaggccgccagcttcaccaaggaggagatgcaggccggcaagcaccaggagtatgagcagaagctgctgcaggagctgtacaagctgaaccccaacttcctgcagctgagcacaggctctgtggacaagaacaagaacaaggtgacccccctgcagagatatgacacccccatcgacaagcccagcgacagcctgagcattggaaatggagacaacagccagcagatcagcaacagcgacacccccagccccccacctggcctgagcaagagcaaccctgtgatccccatcagcagcagcaaccacagcgcccggagcccctttgagggcgctgtgacagagagccagagcctcttcagtgacaacttccgccaccccaaccccatccccagcggcctgccccccttccccagcagcccccagaccagcagtgactggcccacagcccctgagccccagagcctcttcaccagcgagaccatccctgtgagcagcagcacagactggcaggccgcctttggatttggcagcagcaagcagccagaagatgacctgggctttgacccctttgatgtgaccaggaaggccctggccgacctgacagagcccatcgagaggaagaggctggccgtgctgaagagaagatag

SEQ ID NO: 146599 - DNA, 1920 bp, Artificial Sequence
  Description of Artificial Sequence: Synthetic coding sequence
atgagccgcagcccagatgccaaggaggaccctgtggagtgccccctgtgcatggagcccctggagattgatgacatcaacttcttcccctgcacctgtggctaccagatctgccgcttctgctggcaccgcatcagaacagatgaaaatggcctgtgcccagcctgcaggaagccctacccagaggaccctgctgtgtacaagcccctgagccaggaggagctgcagaggatcaagaatgagaagaagcagaagcagaatgaaaggaagcagaagatcagtgaaaataggaagcacctggcctctgtgcgggtggtgcagaagaacctggtgtttgtggtgggcctgagccagaggctggccgaccctgaggtgctgaagaggcctgagtactttgggaagtttgggaagatccacaaggtggtgatcaacaacagcaccagctatgccggcagccagggccccagcgccagcgcctacgtgacctacatccgctcagaagatgccctgcgggccatccagtgtgtgaacaacgtggtggtggatggccgcaccctgaaggccagcctgggcaccaccaagtactgcagctacttcctgaagaacatgcagtgccccaagccagactgcatgtacctgcacgagctgggagatgaggccgccagcttcaccaaggaggagatgcaggccggcaagcaccaggagtatgagcagaagctgctgcaggagctgtacaagctgaaccccaacttcctgcagctgagcacaggctctgtggacaagaacaagaacaaggtgacccccctgcagagccccatcgacaagcccagcgacagcctgagcattggaaatggagacaacagccagcagatcagcaacagcgacacccccagccccccacctggcctgagcaagagcaaccctgtgatccccatcagcagcagcaaccacagcgcccggagcccctttgaaggagctgtgacagagagccagagcctcttcagtgacaacttccgccaccccaaccccatccccagcggcctgccccccttccccagcagcccccagaccagcagtgactggcccacagcccctgagccccagagcctcttcaccagcgagaccatccctgtgagcagcagcacagactggcaggccgccttcggcttcggcagcagcaagcagccagaagatgacctgggctttgacccctttgatgtgaccaggaaggccctggccgacctgattgagaaggagctgtctgtgcaggaccagcccagcctgagccccaccagcctgcagaacagcagcagccacaccaccacagccaagggccctggcagcggcttcctgcaccctgctgctgccaccaatgccaacagcctgaacagcaccttctctgtgctgccccagcgcttcccccagttccagcagcacagagctgtgtacaacagcttctccttccctggccaggccgcccgctacccctggatggccttccccaggaacagcatcatgcacctgaaccacacagccaaccccaccagcaacagcaacttcctggacctgaacctgcccccccagcacaacacaggcctgggcggcatccctgtggccggcatcccagccagcagcggcaacagcctggacagcctgcaggatgacaaccccccccactggctgaagagcctgcaggccctgacagagatggatggccccagcgctgcccccagccagacccaccacagcgcccccttcagcacccagatccccctgcaccgggcctcctggaacccctaccccccacccagcaaccccagcagcttccacagccccccacctggcttccagacagccttccggccccccagcaagacccccacagacctgctgcagagcagcaccctggacagacactag

SEQ ID NO: 146600 - DNA, 1302 bp, Artificial Sequence; identical to SEQ ID NO: 146598
  Description of Artificial Sequence: Synthetic coding sequence

SEQ ID NO: 146601 - DNA, 1929 bp, Artificial Sequence
  Description of Artificial Sequence: Synthetic coding sequence
atgagccgcagcccagatgccaaggaggaccctgtggagtgccccctgtgcatggagcccctggagattgatgacatcaacttcttcccctgcacctgtggctaccagatctgccgcttctgctggcaccgcatcagaacagatgaaaatggcctgtgcccagcctgcaggaagccctacccagaggaccctgctgtgtacaagcccctgagccaggaggagctgcagaggatcaagaatgagaagaagcagaagcagaatgaaaggaagcagaagatcagtgaaaataggaagcacctggcctctgtgcgggtggtgcagaagaacctggtgtttgtggtgggcctgagccagaggctggccgaccctgaggtgctgaagaggcctgagtactttgggaagtttgggaagatccacaaggtggtgatcaacaacagcaccagctatgccggcagccagggccccagcgccagcgcctacgtgacctacatccgctcagaagatgccctgcgggccatccagtgtgtgaacaacgtggtggtggatggccgcaccctgaaggccagcctgggcaccaccaagtactgcagctacttcctgaagaacatgcagtgccccaagccagactgcatgtacctgcacgagctgggagatgaggccgccagcttcaccaaggaggagatgcaggccggcaagcaccaggagtatgagcagaagctgctgcaggagctgtacaagctgaaccccaacttcctgcagctgagcacaggctctgtggacaagaacaagaacaaggtgacccccctgcagagatatgacacccccatcgacaagcccagcgacagcctgagcattggaaatggagacaacagccagcagatcagcaacagcgacacccccagccccccacctggcctgagcaagagcaaccctgtgatccccatcagcagcagcaaccacagcgcccggagcccctttgagggcgctgtgacagagagccagagcctcttcagtgacaacttccgccaccccaaccccatccccagcggcctgccccccttccccagcagcccccagaccagcagtgactggcccacagcccctgagccccagagcctcttcaccagcgagaccatccctgtgagcagcagcacagactggcaggccgcctttggatttggcagcagcaagcagccagaagatgacctgggctttgacccctttgatgtgaccaggaaggccctggccgacctgattgagaaggagctgtctgtgcaggaccagcccagcctgagccccaccagcctgcagaacagcagcagccacaccaccacagccaagggccctggcagcggcttcctgcaccctgctgctgccaccaatgccaacagcctgaacagcaccttctctgtgctgccccagcgcttcccccagttccagcagcacagagctgtgtacaacagcttctccttccctggccaggccgcccgctacccctggatggccttccccagaaattccatcatgcacctgaaccacacagccaaccccaccagcaacagcaacttcctggacctgaacctgcccccccagcacaacacaggcctgggcggcatccctgtggccggcatcccagccagcagcggcaacagcctggacagcctgcaggatgacaaccccccccactggctgaagagcctgcaggccctgacagagatggatggccccagcgctgcccccagccagacccaccacagcgcccccttcagcacccagatccccctgcaccgggcctcctggaacccctaccccccacccagcaaccccagcagcttccacagccccccacctggcttccagacagccttccggccccccagcaagacccccacagacctgctgcagagcagcaccctggacagacactag

SEQ ID NO: 146602 - DNA, 1719 bp, Artificial Sequence
  Description of Artificial Sequence: Synthetic coding sequence
atgagccgcagcccagatgccaaggaggaccctgtggagtgccccctgtgcatggagcccctggagattgatgacatcaacttcttcccctgcacctgtggctaccagatctgccgcttctgctggcaccgcatcagaacagatgaaaatggcctgtgcccagcctgcaggaagccctacccagaggaccctgctgtgtacaagcccctgagccaggaggagctgcagaggatcaagaatgagaagaagcagaagcagaatgaaaggaagcagaagatcagtgaaaataggaagcacctggcctctgtgcgggtggtgcagaagaacctggtgtttgtggtgggcctgagccagaggctggccgaccctgaggtgctgaagaggcctgagtactttgggaagtttgggaagatccacaaggtggtgatcaacaacagcaccagctatgccggcagccagggccccagcgccagcgcctacgtgacctacatccgctcagaagatgccctgcgggccatccagtgtgtgaacaacgtggtggtggatggccgcaccctgaaggccagcctgggcaccaccaagtactgcagctacttcctgaagaacatgcagtgccccaagccagactgcatgtacctgcacgagctgggagatgaggccgccagcttcaccaaggaggagatgcaggccggcaagcaccaggagtatgagcagaagctgctgcaggagctgtacaagctgaaccccaacttcctgcagctgagcacaggctctgtggacaagaacaagaacaaggtgacccccctgcagagccccatcgacaagcccagcgacagcctgagcattggaaatggagacaacagccagcagatcagcaacagcgacacccccagccccccacctggcctgagcaagagcaaccctgtgatccccatcagcagcagcaaccacagcgcccggagcccctttgaaggagctgtgacagagagccagagcctcttcagtgacaacttccgccaccccaaccccatccccagcggcctgccccccttccccagcagcccccagaccagcagtgactggcccacagcccctgagccccagagcctcttcaccagcgagaccatccctgtgagcagcagcacagactggcaggccgccttcggcttcggcagcagcaagcagccagaagatgacctgggctttgacccctttgatgtgaccaggaaggccctggccgacctgattgagaaggagctgtctgtgcaggaccagcccagcctgagccccaccagcctgcagaacagcagcagccacaccaccacagccaagggccctggcagcggcttcctgcaccctgctgctgccaccaatgccaacagcctgaacagcaccttctctgtgctgccccagcgcttcccccagttccagcagcacagagctgtgtacaacagcttctccttccctggccaggccgcccgctacccctggatggccttccccaggaacagcatcatgcacctgaaccacacagccaaccccaccagcaacagcaacttcctggacctgaacctgcccccccagcacaacacaggcctgggcggcatccctgtggccggggaggaggaggtgaaggtgtccaccatgcccctgagcaccagcagccacagcctgcagcagggccagcagcccaccagcctgcacaccaccgtggcctag

SEQ ID NO: 146603 - DNA, 2142 bp, Artificial Sequence
  Description of Artificial Sequence: Synthetic coding sequence
atgagccgcagcccagatgccaaggaggaccctgtggagtgccccctgtgcatggagcccctggagattgatgacatcaacttcttcccctgcacctgtggctaccagatctgccgcttctgctggcaccgcatcagaacagatgaaaatggcctgtgcccagcctgcaggaagccctacccagaggaccctgctgtgtacaagcccctgagccaggaggagctgcagaggatcaagaatgagaagaagcagaagcagaatgaaaggaagcagaagatcagtgaaaataggaagcacctggcctctgtgcgggtggtgcagaagaacctggtgtttgtggtgggcctgagccagaggctggccgaccctgaggtgctgaagaggcctgagtactttgggaagtttgggaagatccacaaggtggtgatcaacaacagcaccagctatgccggcagccagggccccagcgccagcgcctacgtgacctacatccgctcagaagatgccctgcgggccatccagtgtgtgaacaacgtggtggtggatggccgcaccctgaaggccagcctgggcaccaccaagtactgcagctacttcctgaagaacatgcagtgccccaagccagactgcatgtacctgcacgagctgggagatgaggccgccagcttcaccaaggaggagatgcaggccggcaagcaccaggagtatgagcagaagctgctgcaggagctgtacaagctgaaccccaacttcctgcagctgagcacaggctctgtggacaagaacaagaacaaggtgacccccctgcagagatatgacacccccatcgacaagcccagcgacagcctgagcattggaaatggagacaacagccagcagatcagcaacagcgacacccccagccccccacctggcctgagcaagagcaaccctgtgatccccatcagcagcagcaaccacagcgcccggagcccctttgagggcgctgtgacagagagccagagcctcttcagtgacaacttccgccaccccaaccccatccccagcggcctgccccccttccccagcagcccccagaccagcagtgactggcccacagcccctgagccccagagcctcttcaccagcgagaccatccctgtgagcagcagcacagactggcaggccgcctttggatttggcagcagcaagcagccagaagatgacctgggctttgacccctttgatgtgaccaggaaggccctggccgacctgattgagaaggagctgtctgtgcaggaccagcccagcctgagccccaccagcctgcagaacagcagcagccacaccaccacagccaagggccctggcagcggcttcctgcaccctgctgctgccaccaatgccaacagcctgaacagcaccttctctgtgctgccccagcgcttcccccagttccagcagcacagagctgtgtacaacagcttctccttccctggccaggccgcccgctacccctggatggccttccccagaaattccatcatgcacctgaaccacacagccaaccccaccagcaacagcaacttcctggacctgaacctgcccccccagcacaacacaggcctgggcggcatccctgtggccgacaacagcagctctgtggagagcctgaacatgaaggagtggcaggacggcctgcgggccctgctgcccaacatcaacatcaactttggaggcctgcccaacagcagcagccccagcaatgccaaccacagcgcccccaccagcaacacagccaccacagacagcctgtcctgggacagccctggctcctggacagatcctgccatcatcaccggcatcccagccagcagcggcaacagcctggacagcctgcaggatgacaaccccccccactggctgaagagcctgcaggccctgacagagatggatggccccagcgctgcccccagccagacccaccacagcgcccccttcagcacccagatccccctgcaccgggcctcctggaacccctaccccccacccagcaaccccagcagcttccacagccccccacctggcttccagacagccttccggccccccagcaagacccccacagacctgctgcagagcagcaccctggacagacactag

SEQ ID NO: 146604 - DNA, 1674 bp, Artificial Sequence
  Description of Artificial Sequence: Synthetic coding sequence
atgcccaaggagaagtatgagcccccagaccccaggaggatgtacaccatcatgagcagcgaggaggccgccaacgggaagaagagccactgggccgagctggagatcagcggcaaggtgcgcagcctgagcgccagcctgtggagcctgacccacctgacagccctgcacctgagtgacaacagcctgagccgcatccccagcgacatcgccaagctgcacaacctggtgtacctggacctgagcagcaacaagatccgcagcctgcctgctgagctgggcaacatggtgtccctgcgggagctgcacctgaacaacaacctgctgcgggtgctgccctttgagctgggcaagctgttccagctgcagaccctgggcctgaagggcaaccccctgacccaggacatcctgaacctgtaccaggagccagatggcacccggcggctgctgaactacctgctggacaacctgagcggcacagccaagaggatcaccacagagcagcccccacccaggtcctggatcatgctgcaggagccagacaggacccggcccacagccctcttctctgtgatgtgctacaacgtgctgtgtgacaagtatgccacccggcagctgtatggctactgccccagctgggccctgaactgggactacaggaagaaggccatcatccaggagatcctgagctgcaatgctgacatcgtgtccctgcaggaggtggagacagagcagtactacagcttcttcctggtggagctgaaggagcggggctacaacggcttcttcagccccaagagccgggcccggaccatgtctgagcaggagaggaagcacgtggatggctgtgccatcttcttcaagacagagaagttcaccctggtgcagaagcacacagtggagttcaaccagctggccatggccaacagcgagggcagcgaggccatgctgaacagagtgatgaccaaggacaacatcggcgtggccgtgctgctggagctgaggaaggagagcattgagatgcccagcggcaagccccacctgggcacagagaagcagctgatcctggtggccaatgcccacatgcactgggaccctgagtacagtgatgtgaagctggtgcagaccatgatgttcctgtctgaggtgaagaacatcatcgacaaggccagcaggaacctgaagagctctgtgctgggggagtttggcaccatccccctggtgctgtgtgccgacctgaacagcctgcctgattctggagtggtggagtacctgagcactggaggagtggagaccaaccacaaggacttcaaggagctgcgctacaatgaaagcctgaccaacttcagctgccacggcaagaatggcaccaccaacggccgcatcacccacggcttcaagctgcagagcgcctatgagagcggcctgatgccctacaccaactacacctttgacttcaagggcatcatcgactacatcttctacagcaagccccagctgaacaccctgggcatcctgggccccctggaccaccactggctggtggagaacaacatcagcggctgcccccaccccctcatccccagcgaccacttcagcctgtttgcccagctggagctgctgctgcccttcctgccccaggtgaatggcatccacctgcccggcagaagatag

SEQ ID NO: 146605 - DNA, 1674 bp, Artificial Sequence; identical to SEQ ID NO: 146604
  Description of Artificial Sequence: Synthetic coding sequence

SEQ ID NO: 146606 - DNA, 858 bp, Artificial Sequence
  Description of Artificial Sequence: Synthetic coding sequence
atgcctgctgccaccgtggaccacagccagaggatctgtgaggtgtgggcctgcaacctggatgaggagatgaagaagatccggcaggtgatcaggaagtacaactacgtggccatggacacagagttccctggggtggtggcccggcccatcggggagttccgcagcaatgctgactaccagtaccagctgctgcgctgcaatgtggacctgctgaagatcatccagctgggcctgaccttcatgaatgagcagggcgagtacccacctggcaccagcacctggcagttcaacttcaagttcaacctgacagaggacatgtatgcccaggacagcattgagctgctgaccaccagcggcatccagttcaagaagcatgaggaggagggcatcgagacccagtactttgctgagctgctgatgaccagcggcgtggtgctgtgtgagggcgtgaagtggctgtccttccacagcggctatgactttggctacctgatcaagatcctgaccaacagcaacctgcctgaggaggagctggacttctttgagatcctgcggctcttcttccctgtgatctatgatgtgaagtacctgatgaagagctgcaagaacctgaagggcggcctgcaggaggtggccgagcagctggagctggagagaattggcccccagcaccaggccggcagtgacagcctgctgaccggcatggccttcttcaagatgagggagatgttctttgaggaccacattgatgatgccaagtactgcggccacctgtatggcctgggcagcggcagcagctatgtgcagaatggaactggaaatgcctatgaggaggaggccaacaagcagagctag

SEQ ID NO: 146607 - DNA, 126 bp, Artificial Sequence
  Description of Artificial Sequence: Synthetic coding sequence
atgcctgctgccaccgtggaccacagccagaggatctgtgaggtgtgggcctgcaacctggatgaggagatgaagaagatccggcaggtgatcaggaagtacaactacgtggccatggacacctag

SEQ ID NO: 146608 - DNA, 735 bp, Artificial Sequence
  Description of Artificial Sequence: Synthetic coding sequence
atgcctgctgccaccgtggaccacagccagaggatctgtgaggtgtgggcctgcaacctggatgaggagatgaagaagatccggcaggtgatcaggaagtacaactacgtggccatggacacagagttccctggggtggtggcccggcccatcggggagttccgcagcaatgctgactaccagtaccagctgctgcgctgcaatgtggacctgctgaagatcatccagctgggcctgaccttcatgaatgagcagggcgagtacccacctggcaccagcacctggcagttcaacttcaagttcaacctgacagaggacatgtatgcccaggacagcattgagctgctgaccaccagcggcatccagttcaagaagcatgaggaggagggcatcgagacccagtactttgctgagctgctgatgaccagcggcgtggtgctgtgtgagggcgtgaagtggctgtccttccacagcggctatgactttggctacctgatcaagatcctgaccaacagcaacctgcctgaggaggagctggacttctttgagatcctgcggctcttcttccctgtgatctatgatgtgaagtacctgatgaagagctgcaagaacctgaagggcggcctgcaggaggtggccgagcagctggagctggagagaattggcccccagcaccaggccggcagtgacagcctgctgaccggcatggccttcttcaagatgagggaggtgtag

SEQ ID NO: 146609 - DNA, 444 bp, Artificial Sequence
  Description of Artificial Sequence: Synthetic coding sequence
atgcctgctgccaccgtggaccacagccagaggatctgtgaggtgtgggcctgcaacctggatgaggagatgaagaagatccggcaggtgatcaggaagtacaactacgtggccatggacacagagttccctggggtggtggcccggcccatcggggagttccgcagcaatgctgactaccagtaccagctgctgcgctgcaatgtggacctgctgaagatcatccagctgggcctgaccttcatgaatgagcagggcgagtacccacctggcaccagcacctggcagttcaacttcaagttcaacctgacagaggacatgtatgcccaggacagcattgagctgctgaccaccagcggcatccagttcaagaagcatgaggaggagggcatcgagacccagtactttgctgagctgctgatgaccagcggcgtggtgctgtag

SEQ ID NO: 146610 - DNA, 879 bp, Artificial Sequence
  Description of Artificial Sequence: Synthetic coding sequence
atgcctgctgccctggtggagaacagccaggtgatctgtgaggtgtgggccagcaacctggaggaggagatgaggaagatccgggagatcgtgctgagctacagctacatcgccatggacacagagttccctggggtggtggtgcggcccatcggggagttccgcagcagcattgactaccagtaccagctgctgcgctgcaatgtggacctgctgaagatcatccagctgggcctgaccttcaccaatgaaaaaggagagtaccccagcggcatcaacacctggcagttcaacttcaagttcaacctgacagaggacatgtacagccaggacagcattgacctgctggccaacagcggcctgcagttccagaagcatgaggaggagggcatcgacaccctgcactttgctgagctgctgatgaccagcggcgtggtgctgtgtgacaacgtgaagtggctgtccttccacagcggctatgactttggctacatggtgaagctgctgacagacagccggctgcctgaggaggagcacgagttcttccacatcctgaacctcttcttccccagcatctatgatgtgaagtacctgatgaagagctgcaagaacctgaagggcggcctgcaggaggtggccgaccagctggacctgcagagaattggccggcagcaccaggccggcagtgacagcctgctgaccggcatggccttcttcaggatgaaggagctgttctttgaagattccattgatgatgccaagtactgcggccgcctgtatggcctgggcaccggggtggcccagaagcagaatgaagatgtggacagcgcccaggagaagatgagcatcctggccatcatcaacaacatgcagcagtag

SEQ ID NO: 146611 - DNA, 879 bp, Artificial Sequence; identical to SEQ ID NO: 146610
  Description of Artificial Sequence: Synthetic coding sequence

SEQ ID NO: 146612 - DNA, 357 bp, Artificial Sequence
  Description of Artificial Sequence: Synthetic coding sequence
atgcctgctgccctggtggagaacagccaggtgatctgtgaggtgtgggccagcaacctggaggaggagatgaggaagatccgggagatcgtgctgagctacagctacatcgccatggacacagagttccctggggtggtggtgcggcccatcggggagttccgcagcagcattgactaccagtaccagctgctgcgctgcaatgtggacctgctgaagatcatccagctgggcctgaccttcaccaatgaaaaaggagagtaccccagcggcatcaacacctggcagttcaacttcaagttcaacctgacagaggacatgtacagccaggacagcattgacctgctggccaactag

SEQ ID NO: 146613 - DNA, 879 bp, Artificial Sequence; identical to SEQ ID NO: 146610
  Description of Artificial Sequence: Synthetic coding sequence

SEQ ID NO: 146614 - DNA, 168 bp, Artificial Sequence
  Description of Artificial Sequence: Synthetic coding sequence
atgcctgctgccctggtggagaacagccaggtgatctgtgaggtgtgggccagcaacctggaggaggagatgaggaagatccgggagatcgtgctgagctacagctacatcgccatggacacagagttccctggggtggtggtgcggcccatcggggagttcagatag

SEQ ID NO: 146615 - DNA, 678 bp, Artificial Sequence
  Description of Artificial Sequence: Synthetic coding sequence
atgcctgctgccctggtggagaacagccaggtgatctgtgaggtgtgggccagcaacctggaggaggagatgaggaagatccgggagatcgtgctgagctacagctacatcgccatggacacagagttccctggggtggtggtgcggcccatcggggagttccgcagcagcattgactaccagtaccagctgctgcgctgcaatgtggacctgctgaagatcatccagctgggcctgaccttcaccaatgaaaaaggagagtaccccagcggcatcaacacctggcagttcaacttcaagttcaacctgaccggctatgactttggctacatggtgaagctgctgacagacagccggctgcctgaggaggagcacgagttcttccacatcctgaacctcttcttccccagcatctatgatgtgaagtacctgatgaagagctgcaagaacctgaagggcggcctgcaggaggtggccgaccagctggacctgcagagaattggccggcagcaccaggccggcagtgacagcctgctgaccggcatggccttcttcaggatgaaggagctgttctttgaagattccattgatgatgccaagtactgcggccgcctgtatggcctgggcaccggggtggcccagaagcagaatgaagatgtggacagcgcccaggagtag

SEQ ID NO: 146616 - DNA, 360 bp, Artificial Sequence
  Description of Artificial Sequence: Synthetic coding sequence
atgcctgctgccctggtggagaacagccaggtgatctgtgaggtgtgggccagcaacctggaggaggagatgaggaagatccgggagatcgtgctgagctacagctacatcgccatggacacagagttccctggggtggtggtgcggcccatcggggagttccgcagcagcattgactaccagtaccagctgctgcgctgcaatgtggacctgctgaagatcatccagctgggcctgaccttcaccaatgaaaaaggagagtaccccagcggcatcaacacctggcagttcaacttcaagttcaacctgacagaggacatgtacagccaggacagcattgacctgctggccaacagctag

SEQ ID NO: 146617 - DNA, 717 bp, Artificial Sequence
  Description of Artificial Sequence: Synthetic coding sequence
atgcctgctgccctggtggagaacagccaggtgatctgtgaggtgtgggccagcaacctggaggaggagatgaggaagatccgggagatcgtgctgagctacagctacatcgccatggacacagagttccctggggtggtggtgcggcccatcggggagttccgcagcagcattgactaccagtaccagctgctgcgctgcaatgtggacctgctgaagatcatccagctgggcctgaccttcaccaatgaaaaaggagagtaccccagcggcatcaacacctggcagttcaacttcaagttcaacctgaccggctatgactttggctacatggtgaagctgctgacagacagccggctgcctgaggaggagcacgagttcttccacatcctgaacctcttcttccccagcatctatgatgtgaagtacctgatgaagagctgcaagaacctgaagggcggcctgcaggaggtggccgaccagctggacctgcagagaattggccggcagcaccaggccggcagtgacagcctgctgaccggcatggccttcttcaggatgaaggagctgttctttgaagattccattgatgatgccaagtactgcggccgcctgtatggcctgggcaccggggtggcccagaagcagaatgaagatgtggacagcgcccaggagaagatgagcatcctggccatcatcaacaacatgcagcagtag

SEQ ID NO: 146618 - DNA, 168 bp, Artificial Sequence; identical to SEQ ID NO: 146614
  Description of Artificial Sequence: Synthetic coding sequence

SEQ ID NO: 146619 - DNA, 258 bp, Artificial Sequence
  Description of Artificial Sequence: Synthetic coding sequence
atgtacagccaggacagcattgacctgctggccaacagcggcctgcagttccagaagcatgaggaggagggcatcgacaccctgcactttgctgagctgctgatgaccagcggcgtggtgctgtgtgacaacgtgaagtggctgtccttccacagcggctatgactttggctacatggtgaagctgctgacagacagccggctgcctgaggaggagcacgagttcttccacatcctgaacctcttcttccccagctag

SEQ ID NO: 146620 - DNA, 402 bp, Artificial Sequence
  Description of Artificial Sequence: Synthetic coding sequence
atgcctgctgccctggtggagaacagccaggtgatctgtgaggtgtgggccagcaacctggaggaggagatgaggaagatccgggagatcgtgctgagctacagctacatcgccatggacacagagttccctggggtggtggtgcggcccatcggggagttccgcagcagcattgactaccagtaccagctgctgcgctgcaatgtggacctgctgaagatcatccagctgggcctgaccttcaccaatgaaaaaggagagtaccccagcggcatcaacacctggcagttcaacttcaagttcaacctgacagaggacatgtacagccaggacagcattgacctgctggccaacagcggcctgcagttccagaagcatgaggaggagggcatcgacacctag

SEQ ID NO: 146621 - DNA, 561 bp, Artificial Sequence
  Description of Artificial Sequence: Synthetic coding sequence
atgtacagccaggacagcattgacctgctggccaacagcggcctgcagttccagaagcatgaggaggagggcatcgacaccctgcactttgctgagctgctgatgaccagcggcgtggtgctgtgtgacaacgtgaagtggctgtccttccacagcggctatgactttggctacatggtgaagctgctgacagacagccggctgcctgaggaggagcacgagttcttccacatcctgaacctcttcttccccagcatctatgatgtgaagtacctgatgaagagctgcaagaacctgaagggcggcctgcaggaggtggccgaccagctggacctgcagagaattggccggcagcaccaggccggcagtgacagcctgctgaccggcatggccttcttcaggatgaaggagctgttctttgaagattccattgatgatgccaagtactgcggccgcctgtatggcctgggcaccggggtggcccagaagcagaatgaagatgtggacagcgcccaggagaagatgagcatcctggccatcatcaacaacatgcagcagtag

SEQ ID NO: 146622 - DNA, 561 bp, Artificial Sequence; identical to SEQ ID NO: 146621
  Description of Artificial Sequence: Synthetic coding sequence

SEQ ID NO: 146623 - DNA, 561 bp, Artificial Sequence; identical to SEQ ID NO: 146621
  Description of Artificial Sequence: Synthetic coding sequence

SEQ ID NO: 146624 - DNA, 366 bp, Artificial Sequence
  Description of Artificial Sequence: Synthetic coding sequence
atgcctgctgccctggtggagaacagccaggtgatctgtgaggtgtgggccagcaacctggaggaggagatgaggaagatccgggagatcgtgctgagctacagctacatcgccatggacacagagttccctggggtggtggtgcggcccatcggggagttccgcagcagcattgactaccagtaccagctgctgcgctgcaatgtggacctgctgaagatcatccagctgggcctgaccttcaccaatgaaaaaggagagtaccccagcggcatcaacacctggcagttcaacttcaagttcaacctgaccggctatgactttggctacatggtgaagctgctgacagacagccggctgccctag

SEQ ID NO: 146625 - DNA, 561 bp, Artificial Sequence; identical to SEQ ID NO: 146621
  Description of Artificial Sequence: Synthetic coding sequence

SEQ ID NO: 146626 - DNA, 387 bp, Artificial Sequence
  Description of Artificial Sequence: Synthetic coding sequence
atggtgaagctgctgacagacagccggctgcctgaggaggagcacgagttcttccacatcctgaacctcttcttccccagcatctatgatgtgaagtacctgatgaagagctgcaagaacctgaagggcggcctgcaggaggtggccgaccagctggacctgcagagaattggccggcagcaccaggccggcagtgacagcctgctgaccggcatggccttcttcaggatgaaggagctgttctttgaagattccattgatgatgccaagtactgcggccgcctgtatggcctgggcaccggggtggcccagaagcagaatgaagatgtggacagcgcccaggagaagatgagcatcctggccatcatcaacaacatgcagcagtag

SEQ ID NO: 146627 - DNA, 810 bp, Artificial Sequence
  Description of Artificial Sequence: Synthetic coding sequence
atgaggaagatccgggagatcgtgctgagctacagctacatcgccatggacacagagttccctggggtggtggtgcggcccatcggggagttccgcagcagcattgactaccagtaccagctgctgcgctgcaatgtggacctgctgaagatcatccagctgggcctgaccttcaccaatgagaagggggagtaccccagcggcatcaacacctggcagttcaacttcaagttcaacctgacagaggacatgtacagccaggacagcattgacctgctggccaacagcggcctgcagttccagaagcatgaggaggagggcatcgacaccctgcactttgctgagctgctgatgaccagcggcgtggtgctgtgtgacaacgtgaagtggctgtccttccacagcggctatgactttggctacatggtgaagctgctgacagacagccggctgcctgaggaggagcacgagttcttccacatcctgaacctcttcttccccagcatctatgatgtgaagtacctgatgaagagctgcaagaacctgaagggcggcctgcaggaggtggccgaccagctggacctgcagagaattggccggcagcaccaggccggcagtgacagcctgctgaccggcatggccttcttcaggatgaaggagctgttctttgaggacagcattgatgatgccaagtactgcggccgcctgtatggcctgggcactggagtggcccagaagcagaatgaagatgtggacagcgcccaggagaagatgagcatcctggccatcatcaacaacatgcagcagtag

SEQ ID NO: 146628 - DNA, 4338 bp, Artificial Sequence
  Description of Artificial Sequence: Synthetic coding sequence
atgcagggcccccccctgctgacagctgcccacctgctgtgtgtgtgcacagctgccctggccgtggcccctggcccccgcttcctggtgacagcccctggcatcatccggcctggaggaaatgtgaccatcggcgtggagctgctggagcactgccccagccaggtgacagtgaaggccgagctgctgaagacagccagcaacctgactgtgtctgtgctggaggccgagggcgtgtttgagaagggcagcttcaagaccctgaccctgcccagcctgcccctgaacagcgcagatgagatctatgagctgcgggtgactggaagaacccaggatgagatcctcttcagcaacagcacccggctgagctttgagaccaagaggatcagcgtcttcatccagacagacaaggccctgtacaagcccaagcaggaggtgaagttccgcatcgtgaccctcttcagtgacttcaagccctacaagaccagcctgaacatcctgatcaaggaccccaagagcaacctgatccagcagtggctgagccagcagagcgacctgggcgtcatcagcaagaccttccagctgagcagccaccccatcctgggggactggagcatccaggtgcaggtgaatgaccagacctactaccagagcttccaggtgtctgaatatgtgctgcccaagtttgaggtgaccctgcagacccccctgtactgcagcatgaacagcaagcacctgaatggcaccatcacagccaagtacacctacggcaagcctgtgaagggagatgtgaccctgaccttcctgcccctgtccttctggggcaagaagaagaacatcaccaagaccttcaagatcaatggaagtgccaacttctccttcaatgatgaggagatgaagaatgtgatggacagcagcaatggcctgtctgagtacctggacctgagcagccctggccctgtggagatcctgaccaccgtgacagagagcgtgacaggcatcagcagaaatgtgtccaccaacgtgttcttcaagcagcacgactacatcatcgagttctttgactacaccaccgtgctgaagcccagcctgaacttcaccgccaccgtgaaggtgaccagggcagatggcaaccagctgaccctggaggagaggaggaacaacgtggtgatcaccgtgacccagaggaactacacagagtactggagcggcagcaacagcggcaaccagaagatggaggccgtgcagaagatcaactacacagtgccccagagcggcaccttcaagattgagttccccatcctggaggacagcagcgagctgcagctgaaggcctacttcctgggcagcaagagctccatggctgtgcacagcctcttcaagagccccagcaagacctacatccagctgaagaccagagatgagaacatcaaggtgggcagcccctttgagctggtggtgtctggcaacaagaggctgaaggagctgagctacatggtggtgtcccggggccagctggtggccgtgggcaagcagaacagcaccatgttcagcctgaccccagagaacagctggacccccaaggcctgcgtcatcgtgtactacattgaagatgatggagagatcatcagtgatgtgctgaagatccctgtgcagctggtgttcaagaacaagatcaagctgtactggagcaaggtgaaggccgagcccagcgagaaggtgtccctgcgcatctctgtgacccagcctgacagcatcgtgggcatcgtggccgtggacaagtctgtgaacctgatgaatgccagcaatgacatcaccatggagaatgtggtgcatgagctggagctgtacaacacaggctactacctgggcatgttcatgaacagctttgctgtgttccaggagtgtggcctgtgggtgctgacagatgccaacctgaccaaggactacattgatggagtgtatgacaatgcagaatatgcagagcgcttcatggaggagaatgaaggccacatcgtggacatccatgacttcagcctgggcagcagcccccacgtgaggaagcacttccctgagacctggatctggctggacaccaacatgggctaccgcatctaccaggagtttgaggtgacagtgcctgacagcatcacctcctgggtggccactggatttgtgatcagcgaggacctgggcctgggcctgaccaccacccctgtggagctgcaggccttccagcccttcttcatcttcctgaacctgccctacagcgtcatccggggggaggagtttgccctggagatcaccatcttcaactacctgaaggatgccacagaggtgaaggtgatcatcgagaagagtgacaagtttgacatcctgatgaccagcaatgagatcaatgccaccggccaccagcagaccctgctggtgcccagtgaagatggagccaccgtgctcttccccatccggcccacccacctgggggagatccccatcaccgtgacagccctgagccccacagccagtgatgctgtgacccagatgatcctggtgaaggccgagggcatcgagaagagctacagccagagcatcctgctggacctgacagacaaccggctgcagagcaccctgaagaccctgtccttctccttcccccccaacacagtgacaggcagcgagcgggtgcagatcacagccatcggagatgtgctgggccccagcatcaatggcctggccagcctcatccgcatgccctacggctgtggggagcagaacatgatcaactttgcccccaacatctacatcctggactacctgaccaagaagaagcagctgacagacaacctgaaggagaaggccctgtccttcatgaggcagggctaccagcgggagctgctgtaccagcgggaggatggcagcttcagcgcctttggaaattatgaccccagcggcagcacctggctgagcgcctttgtgctgcgctgcttcctggaggccgacccctacattgatattgaccagaatgtgctgcacaggacctacacctggctgaagggccaccagaagagcaatggagagttctgggaccccggccgggtcatccacagcgagctgcagggcggcaacaagagccctgtgaccctgacagcctacatcgtgaccagcctgctgggctacaggaagtaccagcccaacattgatgtgcaggagagcatccacttcctggagagcgagttcagccggggcatcagtgacaactacaccctggccctgatcacctacgccctgagctctgtgggcagccccaaggccaaggaggccctgaacatgctgacctggagggctgagcaggagggcggcatgcagttctgggtgtcctctgagagcaagctgagtgacagctggcagcccaggagcctggacatcgaggtggccgcctatgccctgctgagccacttcctgcagttccagaccagcgagggcatccccatcatgcgctggctgagccggcagaggaacagcctgggcggctttgccagcacccaggacaccaccgtggccctgaaggccctgtctgaatttgctgccctgatgaacacagagaggaccaacatccaggtgacagtgacaggccccagcagccccagccctgtgaagttcctgattgacacccacaaccggctgctgctgcagacagctgagctggccgtggtgcagcccacagctgtgaacatcagcgccaacggcttcggctttgccatctgccagctgaatgtggtgtacaacgtgaaggccagcggcagcagcagaagaagaagaagcatccagaaccaggaggcctttgacctggatgtggccgtgaaggagaacaaggatgacctgaaccacgtggacctgaatgtgtgcaccagcttcagcggccctggccgcagcggcatggccctgatggaggtgaacctgctgagcggcttcatggtgcccagcgaggccatcagcctgtctgagaccgtgaagaaggtggagtatgaccacggcaagctgaacctgtacctggacagcgtgaatgagacccagttctgtgtgaacatcccagctgtgaggaacttcaaggtgagcaacacccaggatgcctctgtgtccatcgtggactactatgagccccggcggcaggccgtgcgcagctacaacagcgaggtgaagctgagcagctgtgacctgtgcagtgatgtgcagggctgccggccctgtgaagatggagccagcggcagccaccaccacagcagcgtcatcttcatcttctgcttcaagctgctgtacttcatggagctgtggctgtag

SEQ ID NO: 146629 - DNA, 4107 bp, Artificial Sequence
  Description of Artificial Sequence: Synthetic coding sequence
atgcagggcccccccctgctgacagctgcccacctgctgtgtgtgtgcacagctgccctggccgtggcccctggcccccgcttcctggtgacagcccctggcatcatccggcctggaggaaatgtgaccatcggcgtggagctgctggagcactgccccagccaggtgacagtgaaggccgagctgctgaagacagccagcaacctgactgtgtctgtgctggaggccgagggcgtgtttgagaagggcagcttcaagaccctgaccctgcccagcgaccccaagagcaacctgatccagcagtggctgagccagcagagcgacctgggcgtcatcagcaagaccttccagctgagcagccaccccatcctgggggactggagcatccaggtgcaggtgaatgaccagacctactaccagagcttccaggtgtctgaatatgtgctgcccaagtttgaggtgaccctgcagacccccctgtactgcagcatgaacagcaagcacctgaatggcaccatcacagccaagtacacctacggcaagcctgtgaagggagatgtgaccctgaccttcctgcccctgtccttctggggcaagaagaagaacatcaccaagaccttcaagatcaatggcagcgccaacttctccttcaatgatgaggagatgaagaatgtgatggacagcagcaatggcctgtctgagtacctggacctgagcagccctggccctgtggagatcctgaccaccgtgacagaatctgtgacaggcatcagcagaaatgtgtccaccaacgtgttcttcaagcagcacgactacatcatcgagttctttgactacaccaccgtgctgaagcccagcctgaacttcaccgccaccgtgaaggtgaccagggcagatggcaaccagctgaccctggaggagaggagaaataatgtggtgatcaccgtgacccagaggaactacacagagtactggagcggcagcaacagcggcaaccagaagatggaggccgtgcagaagatcaactacacagtgccccagagcggcaccttcaagattgagttccccatcctggaggacagcagcgagctgcagctgaaggcctacttcctgggcagcaagagctccatggctgtgcacagcctcttcaagagccccagcaagacctacatccagctgaagaccagagatgagaacatcaaggtgggcagcccctttgagctggtggtgtctggcaacaagaggctgaaggagctgagctacatggtggtgtcccggggccagctggtggccgtgggcaagcagaacagcaccatgttcagcctgaccccagaaaattcctggacccccaaggcctgtgtgattgtgtactacattgaagatgatggagagatcatcagtgatgtgctgaagatccctgtgcagctggtgttcaagaacaagatcaagctgtactggagcaaggtgaaggccgagcccagcgagaaggtgtccctgcgcatctctgtgacccagcctgacagcatcgtgggcatcgtggccgtggacaagtctgtgaacctgatgaatgccagcaatgacatcaccatggagaatgtggtgcatgagctggagctgtacaacacaggctactacctgggcatgttcatgaacagctttgctgtgttccaggagtgtggcctgtgggtgctgacagatgccaacctgaccaaggactacattgatggagtgtatgacaatgcagaatatgcagagcgcttcatggaggagaatgaaggccacatcgtggacatccatgacttcagcctgggcagcagcccccacgtgaggaagcacttccctgagacctggatctggctggacaccaacatgggctaccgcatctaccaggagtttgaggtgacagtgcctgacagcatcacctcctgggtggccaccggcttcgtcatcagcgaggacctgggcctgggcctgaccaccacccctgtggagctgcaggccttccagcccttcttcatcttcctgaacctgccctacagcgtcatccggggggaggagtttgccctggagatcaccatcttcaactacctgaaggatgccacagaggtgaaggtgatcatcgagaagagtgacaagtttgacatcctgatgaccagcaatgagatcaatgccaccggccaccagcagaccctgctggtgcccagtgaagatggagccaccgtgctcttccccatccggcccacccacctgggggagatccccatcaccgtgacagccctgagccccacagccagtgatgctgtgacccagatgatcctggtgaaggccgagggcatcgagaagagctacagccagagcatcctgctggacctgacagacaaccggctgcagagcaccctgaagaccctgtccttctccttcccccccaacacagtgactggaagtgagcgggtgcagatcacagccatcggagatgtgctgggccccagcatcaatggcctggccagcctcatccgcatgccctacggctgtggggagcagaacatgatcaactttgcccccaacatctacatcctggactacctgaccaagaagaagcagctgacagacaacctgaaggagaaggccctgtccttcatgaggcagggctaccagcgggagctgctgtaccagagagaagatggcagcttcagcgccttcggcaactatgaccccagcggcagcacctggctgagcgcctttgtgctgcgctgcttcctggaggccgacccctacatcgacatcgaccagaatgtgctgcacaggacctacacctggctgaagggccaccagaagagcaatggagagttctgggaccccggccgggtcatccacagcgagctgcagggcggcaacaagagccctgtgaccctgacagcctacatcgtgaccagcctgctgggctacaggaagtaccagcccaacattgatgtgcaggagagcatccacttcctggagagcgagttcagccggggcatcagtgacaactacaccctggccctgatcacctacgccctgagctctgtgggcagccccaaggccaaggaggccctgaacatgctgacctggagggctgagcaggagggcggcatgcagttctgggtgagcagcgagagcaagctgagtgacagctggcagcccaggagcctggacatcgaggtggccgcctatgccctgctgagccacttcctgcagttccagaccagcgagggcatccccatcatgcgctggctgagccggcagaggaacagcctgggcggctttgccagcacccaggacaccaccgtggccctgaaggccctgtctgaatttgctgccctgatgaacacagagaggaccaacatccaggtgacagtgacaggccccagcagccccagccctgtgaagttcctgattgacacccacaaccggctgctgctgcagacagctgagctggccgtggtgcagcccacagctgtgaacatcagcgccaatggatttggatttgccatctgccagctgaatgtggtgtacaacgtgaaggccagcggcagcagcagaagaagaagaagcatccagaaccaggaggcctttgacctggatgtggccgtgaaggagaacaaggatgacctgaaccacgtggacctgaatgtgtgcaccagcttcagcggccctggccgcagcggcatggccctgatggaggtgaacctgctgagcggcttcatggtgcccagcgaggccatcagcctgtctgaaacagtgaagaaggtggagtatgaccacggcaagctgaacctgtacctggacagcgtgaatgagacccagttctgtgtgaacatcccagctgtgaggaacttcaaggtgagcaacacccaggatgcctctgtgtccatcgtggactactatgagccccggcggcaggccgtgcgcagctacaacagcgaggtgaagctgagcagctgtgacctgtgcagtgatgtgcagggctgccggccctgtgaagatggagccagcggcagccaccaccacagcagcgtcatcttcatcttctgcttcaagctgctgtacttcatggagctgtggctgtag

SEQ ID NO: 146630 - DNA, 4287 bp, Artificial Sequence
  Description of Artificial Sequence: Synthetic coding sequence
atgcagggcccccccctgctgacagctgcccacctgctgtgtgtgtgcacagctgccctggccgtggcccctggcccccgcttcctggtgacagcccctggcatcatccggcctggaggaaatgtgaccatcggcgtggagctgctggagcactgccccagccaggtgacagtgaaggccgagctgctgaagacagccagcaacctgactgtgtctgtgctggaggccgagggcgtgtttgagaagggcagcttcaagaccctgaccctgcccagcctgcccctgaacagcgcagatgagatctatgagctgcgggtgactggaagaacccaggatgagatcctcttcagcaacagcacccggctgagctttgagaccaagaggatcagcgtcttcatccagacagacaaggccctgtacaagcccaagcaggaggtgaagttccgcatcgtgaccctcttcagtgacttcaagccctacaagaccagcctgaacatcctgatcaaggaccccaagagcaacctgatccagcagtggctgagccagcagagcgacctgggcgtcatcagcaagaccttccagctgagcagccaccccatcctgggggactggagcatccaggtgcaggtgaatgaccagacctactaccagagcttccaggtgtctgaatatgtgctgcccaagtttgaggtgaccctgcagacccccctgtactgcagcatgaacagcaagcacctgaatggcaccatcacagccaagtacacctacggcaagcctgtgaagggagatgtgaccctgaccttcctgcccctgtccttctggggcaagaagaagaacatcaccaagaccttcaagatcaatggaagtgccaacttctccttcaatgatgaggagatgaagaatgtgatggacagcagcaatggcctgtctgagtacctggacctgagcagccctggccctgtggagatcctgaccaccgtgacagagagcgtgacaggcatcagcagaaatgtgtccaccaacgtgttcttcaagcagcacgactacatcatcgagttctttgactacaccaccgtgctgaagcccagcctgaacttcaccgccaccgtgaaggtgaccagggcagatggcaaccagctgaccctggaggagaggaggaacaacgtggtgatcaccgtgacccagaggaactacacagagtactggagcggcagcaacagcggcaaccagaagatggaggccgtgcagaagatcaactacacagtgccccagagcggcaccttcaagattgagttccccatcctggaggacagcagcgagctgcagctgaaggcctacttcctgggcagcaagagctccatggctgtgcacagcctcttcaagagccccagcaagacctacatccagctgaagaccagagatgagaacatcaaggtgggcagcccctttgagctggtggtgtctggcaacaagaggctgaaggagctgagctacatggtggtgtcccggggccagctggtggccgtgggcaagcagaacagcaccatgttcagcctgaccccagagaacagctggacccccaaggcctgcgtcatcgtgtactacattgaagatgatggagagatcatcagtgatgtgctgaagatccctgtgcagctggtgttcaagaacaagatcaagctgtactggagcaaggtgaaggccgagcccagcgagaaggtgtccctgcgcatctctgtgacccagcctgacagcatcgtgggcatcgtggccgtggacaagtctgtgaacctgatgaatgccagcaatgacatcaccatggagaatgtggtgcatgagctggagctgtacaacacaggctactacctgggcatgttcatgaacagctttgctgtgttccaggagtgtggcctgtgggtgctgacagatgccaacctgaccaaggactacattgatggagtgtatgacaatgcagaatatgcagagcgcttcatggaggagaatgaaggccacatcgtggacatccatgacttcagcctgggcagcagcccccacgtgaggaagcacttccctgagacctggatctggctggacaccaacatgggctaccgcatctaccaggagtttgaggtgacagtgcctgacagcatcacctcctgggtggccactggatttgtgatcagcgaggacctgggcctgggcctgaccaccacccctgtggagctgcaggccttccagcccttcttcatcttcctgaacctgccctacagcgtcatccggggggaggagtttgccctggagatcaccatcttcaactacctgaaggatgccacagaggtgaaggtgatcatcgagaagagtgacaagtttgacatcctgatgaccagcaatgagatcaatgccaccggccaccagcagaccctgctggtgcccagtgaagatggagccaccgtgctcttccccatccggcccacccacctgggggagatccccatcaccgtgacagccctgagccccacagccagtgatgctgtgacccagatgatcctggtgaaggccgagggcatcgagaagagctacagccagagcatcctgctggacctgacagacaaccggctgcagagcaccctgaagaccctgtccttctccttcccccccaacacagtgacaggcagcgagcgggtgcagatcacagccatcggagatgtgctgggccccagcatcaatggcctggccagcctcatccgcatgccctacggctgtggggagcagaacatgatcaactttgcccccaacatctacatcctggactacctgaccaagaagaagcagctgacagacaacctgaaggagaaggccctgtccttcatgaggcagggctaccagcgggagctgctgtaccagcgggaggatggcagcttcagcgcctttggaaattatgaccccagcggcagcacctggctgagcgcctttgtgctgcgctgcttcctggaggccgacccctacattgatattgaccagaatgtgctgcacaggacctacacctggctgaagggccaccagaagagcaatggagagttctgggaccccggccgggtcatccacagcgagctgcagggcggcaacaagagccctgtgaccctgacagcctacatcgtgaccagcctgctgggctacaggaagtaccagcccaacattgatgtgcaggagagcatccacttcctggagagcgagttcagccggggcatcagtgacaactacaccctggccctgatcacctacgccctgagctctgtgggcagccccaaggccaaggaggccctgaacatgctgacctggagggctgagcaggagggcggcatgcagttctgggtgtcctctgagagcaagctgagtgacagctggcagcccaggagcctggacatcgaggtggccgcctatgccctgctgagccacttcctgcagttccagaccagcgagggcatccccatcatgcgctggctgagccggcagaggaacagcctgggcggctttgccagcacccaggacaccaccgtggccctgaaggccctgtctgaatttgctgccctgatgaacacagagaggaccaacatccaggtgacagtgacaggccccagcagccccagccccctggccgtggtgcagcccacagctgtgaacatcagcgccaatggatttggatttgccatctgccagctgaatgtggtgtacaacgtgaaggccagcggcagcagcagaagaagaagaagcatccagaaccaggaggcctttgacctggatgtggccgtgaaggagaacaaggatgacctgaaccacgtggacctgaatgtgtgcaccagcttcagcggccctggccgcagcggcatggccctgatggaggtgaacctgctgagcggcttcatggtgcccagcgaggccatcagcctgtctgaaacagtgaagaaggtggagtatgaccacggcaagctgaacctgtacctggacagcgtgaatgagacccagttctgtgtgaacatcccagctgtgaggaacttcaaggtgagcaacacccaggatgcctctgtgtccatcgtggactactatgagccccggcggcaggccgtgcgcagctacaacagcgaggtgaagctgagcagctgtgacctgtgcagtgatgtgcagggctgccggccctgtgaagatggagccagcggcagccaccaccacagcagcgtcatcttcatcttctgcttcaagctgctgtacttcatggagctgtggctgtag

SEQ ID NO: 146631 - DNA, 762 bp, Artificial Sequence
  Description of Artificial Sequence: Synthetic coding sequence
atgggagagttcaatgagaagaagaccacctgtggcaccgtgtgcctgaagtacctgctcttcacctacaactgctgcttctggctggccggcctggccgtgatggctgtgggcatctggaccctggccctgaagagtgactacatcagcctgctggccagcggcacctacctggccacagcctacatcctggtggtggccggcaccgtggtgatggtgactggagtgctgggctgctgtgccaccttcaaggagaggaggaacctgctgcggctgtacttcatcctgctgctgatcatcttcctgctggagatcatcgccggcatcctggcctatgcctactaccagcagctgaacacagagctgaaggagaacctgaaggacaccatgaccaagcgctaccaccagcccggccatgaagctgtgaccagcgctgtggaccagctgcagcaggagttccactgctgcggcagcaacaacagccaggactggagggacagcgagtggatccgcagccaggaggccggcggccgggtggtgcctgacagctgctgcaagacagtggtggccctgtgtggccagagggaccacgccagcaacatctacaaggtggagggcggctgcatcaccaagctggagaccttcatccaggagcacctgcgggtgattggagctgtgggcatcggcatcgcctgtgtgcaggtgtttggcatgatcttcacctgctgcctgtaccgcagcctgaagctggagcactactag

SEQ ID NO: 146632 - DNA, 762 bp, Artificial Sequence; identical to SEQ ID NO: 146631
  Description of Artificial Sequence: Synthetic coding sequence

SEQ ID NO: 146633 - DNA, 762 bp, Artificial Sequence; identical to SEQ ID NO: 146631
  Description of Artificial Sequence: Synthetic coding sequence

SEQ ID NO: 146634 - DNA, 543 bp, Artificial Sequence
  Description of Artificial Sequence: Synthetic coding sequence
atgggagagttcaatgagaagaagaccacctgtggcaccgtgtgcctgaagtacctgctcttcacctacaactgctgcttctggctggccggcctggccgtgatggctgtgggcatctggaccctggccctgaagagtgactacatcagcctgctggccagcggcacctacctggccacagcctacatcctggtggtggccggcaccgtggtgatggtgactggagtgctgggctgctgtgccaccttcaaggagaggaggaacctgctgcggctgtacttcatcctgctgctgatcatcttcctgctggagatcatcgccggcatcctggcctatgcctactaccagcagctgaacacagagctgaaggagaacctgaaggacaccatgaccaagcgctaccaccagcccggccatgaagctgtgaccagcgctgtggaccagctgcagcaggagttccactgctgcggcagcaacaacagccaggactggagggacagcgagtggatccgcagccaggaggccggcggccgggtggtgtag

SEQ ID NO: 146635 - DNA, 240 bp, Artificial Sequence
  Description of Artificial Sequence: Synthetic coding sequence
atgggagagttcaatgagaagaagaccacctgtggcaccgtgtgcctgaagtacctgctcttcacctacaactgctgcttctggctggccggcctggccgtgatggctgtgggcatctggaccctggccctgaagagtgactacatcagcctgctggccagcggcacctacctggccacagcctacatcctggtggtggccggcaccgtggtgatggtgactggagtgctgggctgctag

SEQ ID NO: 146636 - DNA, 279 bp, Artificial Sequence
  Description of Artificial Sequence: Synthetic coding sequence
atgggagagttcaatgagaagaagaccacctgtggcaccgtgtgcctgaagtacctgctcttcacctacaactgctgcttctggctggccggcctggccgtgatggctgtgggcatctggaccctggccctgaagagtgactacatcagcctgctggccagcggcacctacctggccacagcctacatcctggtggtggccggcaccgtggtgatggtgactggagtgctgggctgctgtgccaccttcaaggagaggaggaacctgctgcggctgtag

SEQ ID NO: 146637 - DNA, 198 bp, Artificial Sequence
  Description of Artificial Sequence: Synthetic coding sequence
atgggagagttcaatgagaagaagaccacctgtggcaccgtgtgcctgaagtacctgctcttcacctacaactgctgcttctggctggccggcctggccgtgatggctgtgggcatctggaccctggccctgaagagtgactacatcagcctgctggccagcggcacctacctggccacagcctacatcctggtgtag

SEQ ID NO: 146638 - DNA, 531 bp, Artificial Sequence
  Description of Artificial Sequence: Synthetic coding sequence
atgggagagttcaatgagaagaagaccacctgtggcaccgtgtgcctgaagtacctgctcttcacctacaactgctgcttctggctggccggcctggccgtgatggctgtgggcatctggaccctggccctgaagagtgactacatcagcctgctggccagcggcacctacctggccacagcctacatcctggtggtggccggcaccgtggtgatggtgactggagtgctgggctgctgtgccaccttcaaggagaggaggaacctgctgcggctgtacttcatcctgctgctgatcatcttcctgctggagatcatcgccggcatcctggcctatgcctactaccagcagctgaacacagagctgaaggagaacctgaaggacaccatgaccaagcgctaccaccagcccggccatgaagctgtgaccagcgctgtggaccagctgcagcaggagttccactgctgcggcagcaacaacagccaggactggagggacagcgagtggatccgcagccaggaggccggctag

SEQ ID NO: 146639 - DNA, 543 bp, Artificial Sequence; identical to SEQ ID NO: 146634
  Description of Artificial Sequence: Synthetic coding sequence

SEQ ID NO: 146640 - DNA, 273 bp, Artificial Sequence
  Description of Artificial Sequence: Synthetic coding sequence
atgggagagttcaatgagaagaagaccacctgtggcaccgtgtgcctgaagtacctgctcttcacctacaactgctgcttctggctggccggcctggccgtgatggctgtgggcatctggaccctggccctgaagagtgactacatcagcctgctggccagcggcacctacctggccacagcctacatcctggtggtggccggcaccgtggtgatggtgactggagtgctgggctgctgtgccaccttcaaggagaggaggaacctgctgtag

SEQ ID NO: 146641 - DNA, 513 bp, Artificial Sequence
  Description of Artificial Sequence: Synthetic coding sequence
atgggagagttcaatgagaagaagaccacctgtggcaccgtgtgcctgaagtacctgctcttcacctacaactgctgcttctggctggccggcctggccgtgatggctgtgggcatctggaccctggccctgaagagtgactacatcagcctgctggccagcggcacctacctggccacagcctacatcctggtggtggccggcaccgtggtgatggtgactggagtgctgggctgctgtgccaccttcaaggagaggaggaacctgctgcggctgtacttcatcctgctgctgatcatcttcctgctggagatcatcgccggcatcctggcctatgcctactaccagcagctgaacacagagctgaaggagaacctgaaggacaccatgaccaagcgctaccaccagcccggccatgaagctgtgaccagcgctgtggaccagctgcagcaggagttccactgctgcggcagcaacaacagccaggactggagggacagcgagtggatctag

SEQ ID NO: 146642 - DNA, 762 bp, Artificial Sequence; identical to SEQ ID NO: 146631
  Description of Artificial Sequence: Synthetic coding sequence

SEQ ID NO: 146643 - DNA, 3471 bp, Artificial Sequence
  Description of Artificial Sequence: Synthetic coding sequence
atgagcaagctgaggatggtgctgctggaggacagcggcagcgctgacttccgccgccactttgtgaacctgagccccttcaccatcaccgtggtgctgctgctgagcgcctgctttgtgaccagcagcctgggcggcacagacaaggagctgcggctggtggatggagaaaataaatgttctggccgggtggaggtgaaggtgcaggaggagtggggcaccgtgtgcaacaacggctggagcatggaggccgtgtctgtcatctgcaaccagctgggctgccccacagccatcaaggcccctggctgggccaacagcagcgctggcagcggccgcatctggatggaccacgtgtcctgcagaggaaatgaaagtgccctgtgggactgcaagcatgatggctggggcaagcacagcaactgcacccaccagcaggatgctggggtgacctgcagtgatggcagcaacctggagatgaggctgacccggggcggcaacatgtgcagcggccgcatcgagatcaagttccagggccgctggggcaccgtgtgtgatgacaacttcaacatcgaccacgccagcgtcatctgccggcagctggagtgtggcagcgctgtgtccttcagcggcagcagcaactttggagagggcagcggccccatctggtttgatgacctgatctgcaatggaaatgaaagtgccctgtggaactgcaagcaccagggctggggcaagcacaactgtgaccatgctgaagatgctggggtcatctgcagcaaaggagctgacctgagcctgcggctggtggatggagtgacagagtgcagcggccgcctggaggtgcgcttccagggcgagtggggcaccatctgtgatgatggctgggacagctatgatgctgctgtggcctgcaagcagctgggctgccccacagctgtgacagccatcggccgggtgaatgccagcaaaggatttggccacatctggctggacagcgtgtcctgccagggccacgagcccgccatctggcagtgcaagcaccacgagtggggcaagcactactgcaaccacaatgaagatgctggggtgacctgcagtgatggcagtgacctggagctgcggctgcggggcggcggcagccgctgtgccggcaccgtggaggtggagatccagaggctgctgggcaaggtgtgtgaccggggctggggcctgaaggaggctgatgtggtgtgccggcagctgggctgcggcagcgccctgaagaccagctaccaggtgtacagcaagatccaggccaccaacacctggctgttcctgagcagctgcaatggaaatgagaccagcctgtgggactgcaagaactggcagtggggcggcctgacctgtgaccactatgaggaggccaagatcacctgcagcgcccaccgggagccccggctggtgggcggggacatcccctgcagcggccgggtggaggtgaagcatggagacacctggggcagcatctgtgacagcgacttcagcctggaggccgcctctgtgctgtgccgggagctgcagtgtggcaccgtggtgtccatcctgggcggggcccactttggagagggcaatggccagatctgggccgaggagttccagtgtgagggccacgagagccacctgagcctgtgccctgtggcccccaggcctgagggcacctgcagccacagcagagatgtgggcgtggtgtgcagccgctacacagagatccggctggtgaatggcaagaccccctgtgagggccgggtggagctgaagaccctgggcgcctggggcagcctgtgcaacagccactgggacattgaagatgcccacgtgctgtgccagcagctgaagtgtggggtggccctgagcaccccaggaggagccaggtttggaaaaggaaatggccagatctggaggcacatgttccactgcacaggaacagagcagcacatgggagactgccctgtgacagccctgggcgccagcctgtgccccagcgagcaggtggccagcgtcatctgcagcggcaaccagagccagaccctgagcagctgcaacagcagcagcctgggccccacccggcccaccatccctgaggagagcgctgtggcctgcatcgagagcggccagctgcggctggtgaatggaggcggccgctgtgccggccgggtggagatctaccacgagggctcctggggcaccatctgtgatgacagctgggacctgagtgatgcccacgtggtgtgccggcagctgggctgtggggaggccatcaatgccactggaagtgcccactttggagagggcaccggccccatctggctggatgagatgaagtgcaatggcaaggagagccgcatctggcagtgccacagccacggctggggccagcagaactgccgccacaaggaggatgctggggtcatctgcagcgagttcatgagcctgcggctgaccagcgaggccagccgggaggcctgtgccggccgcctggaggtgttctacaacggggcctggggcaccgtgggcaagagctccatgtctgagaccaccgtgggcgtggtgtgccggcagctgggctgtgccgacaagggcaagatcaacccagccagcctggacaaggccatgagcatccccatgtgggtggacaacgtgcagtgccccaagggccctgacaccctgtggcagtgccccagcagcccctgggagaagaggctggccagccccagcgaggagacctggatcacctgtgacaacaagatccggctgcaggagggccccaccagctgcagcggccgggtggagatctggcacggcggctcctggggcaccgtgtgtgatgacagctgggacctggatgatgcccaggtggtgtgccagcagctgggctgcggccctgccctgaaggccttcaaggaggccgagtttggccagggcaccggccccatctggctgaatgaggtgaagtgcaagggaaatgaaagcagcctgtgggactgcccagcccggcgctggggccacagtgaatgtggccacaaggaggatgctgctgtgaactgcacagacatctctgtgcagaagaccccccagaaggccaccaccggccgcagcagccggcagagcagcttcatcgctgtgggcatcctgggcgtggtgctgctggccatctttgtggccctcttcttcctgaccaagaagaggcggcagaggcagaggctggccgtgagcagcagaggagagaacctggtgcaccagatccagtaccgggagatgaacagctgcctgaatgctgatgacctggacctgatgaacagcagcgagaacagccatgagagcgctgacttctctgctgctgagctgatctctgtgtccaagttcctgcccatcagcggcatggagaaggaggccatcctgagccacacagagaaggaaaatggaaacctgtag

SEQ ID NO: 146644 - DNA, 3465 bp, Artificial Sequence
  Description of Artificial Sequence: Synthetic coding sequence
atgagcaagctgaggatggtgctgctggaggacagcggcagcgctgacttccgccgccactttgtgaacctgagccccttcaccatcaccgtggtgctgctgctgagcgcctgctttgtgaccagcagcctgggcggcacagacaaggagctgcggctggtggatggagaaaataaatgttctggccgggtggaggtgaaggtgcaggaggagtggggcaccgtgtgcaacaacggctggagcatggaggccgtgtctgtcatctgcaaccagctgggctgccccacagccatcaaggcccctggctgggccaacagcagcgctggcagcggccgcatctggatggaccacgtgtcctgcagaggaaatgaaagtgccctgtgggactgcaagcatgatggctggggcaagcacagcaactgcacccaccagcaggatgctggggtgacctgcagtgatggcagcaacctggagatgaggctgacccggggcggcaacatgtgcagcggccgcatcgagatcaagttccagggccgctggggcaccgtgtgtgatgacaacttcaacatcgaccacgccagcgtcatctgccggcagctggagtgtggcagcgctgtgtccttcagcggcagcagcaactttggagagggcagcggccccatctggtttgatgacctgatctgcaatggaaatgaaagtgccctgtggaactgcaagcaccagggctggggcaagcacaactgtgaccatgctgaagatgctggggtcatctgcagcaaaggagctgacctgagcctgcggctggtggatggagtgacagagtgcagcggccgcctggaggtgcgcttccagggcgagtggggcaccatctgtgatgatggctgggacagctatgatgctgctgtggcctgcaagcagctgggctgccccacagctgtgacagccatcggccgggtgaatgccagcaaaggatttggccacatctggctggacagcgtgtcctgccagggccacgagcccgccatctggcagtgcaagcaccacgagtggggcaagcactactgcaaccacaatgaagatgctggggtgacctgcagtgatggcagtgacctggagctgcggctgcggggcggcggcagccgctgtgccggcaccgtggaggtggagatccagaggctgctgggcaaggtgtgtgaccggggctggggcctgaaggaggctgatgtggtgtgccggcagctgggctgcggcagcgccctgaagaccagctaccaggtgtacagcaagatccaggccaccaacacctggctgttcctgagcagctgcaatggaaatgagaccagcctgtgggactgcaagaactggcagtggggcggcctgacctgtgaccactatgaggaggccaagatcacctgcagcgcccaccgggagccccggctggtgggcggggacatcccctgcagcggccgggtggaggtgaagcatggagacacctggggcagcatctgtgacagcgacttcagcctggaggccgcctctgtgctgtgccgggagctgcagtgtggcaccgtggtgtccatcctgggcggggcccactttggagagggcaatggccagatctgggccgaggagttccagtgtgagggccacgagagccacctgagcctgtgccctgtggcccccaggcctgagggcacctgcagccacagcagagatgtgggcgtggtgtgcagcagcaagacccagaagaccagcctgattggcagccacacagtgaagggcaccggcctgggcagccacagctgcctcttcctgaagccctgcctgctgcccggctacacagagatccggctggtgaatggcaagaccccctgtgagggccgggtggagctgaagaccctgggcgcctggggcagcctgtgcaacagccactgggacattgaagatgcccacgtgctgtgccagcagctgaagtgtggggtggccctgagcacccctgggggcgccaggtttggaaaaggaaatggccagatctggaggcacatgttccactgcaccggcacagagcagcacatgggagactgccctgtgacagccctgggcgccagcctgtgccccagcgagcaggtggccagcgtcatctgcagcggcaaccagagccagaccctgagcagctgcaacagcagcagcctgggccccacccggcccaccatccctgaggagagcgctgtggcctgcattgaaagtggccagctgcggctggtgaatggaggcggccgctgtgccggccgggtggagatctaccacgagggctcctggggcaccatctgtgatgacagctgggacctgagtgatgcccacgtggtgtgccggcagctgggctgtggggaggccatcaatgccaccggcagcgcccactttggagagggcaccggccccatctggctggatgagatgaagtgcaatggcaaggagagccgcatctggcagtgccacagccacggctggggccagcagaactgccgccacaaggaggatgctggggtcatctgcagcgagttcatgagcctgcggctgaccagcgaggccagccgggaggcctgtgccggccgcctggaggtgttctacaatggagcctggggcaccgtgggcaagagctccatgtctgagaccaccgtgggcgtggtgtgccggcagctgggctgtgccgacaagggcaagatcaacccagccagcctggacaaggccatgagcatccccatgtgggtggacaacgtgcagtgccccaagggccctgacaccctgtggcagtgccccagcagcccctgggagaagaggctggccagccccagcgaggagacctggatcacctgtgacaacaagatccggctgcaggagggccccaccagctgcagcggccgggtggagatctggcatggaggctcctggggcaccgtgtgtgatgacagctgggacctggatgatgcccaggtggtgtgccagcagctgggctgcggccctgccctgaaggccttcaaggaggccgagtttggccagggcaccggccccatctggctgaatgaggtgaagtgcaagggaaatgaaagcagcctgtgggactgcccagcccggcgctggggccacagtgaatgtggccacaaggaggatgctgctgtgaactgcacagacatctctgtgcagaagaccccccagaaggccaccaccggccgcagcagccggcagagcagcttcatcgctgtgggcatcctgggcgtggtgctgctggccatctttgtggccctcttcttcctgaccaagaagaggcggcagaggcagaggctggccgtgagcagcagaggagagaacctggtgcaccagatccagtaccgggagatgaacagctgcctgaatgctgatgacctggacctgatgaacagcagcggcggccacagcgagccccactag

SEQ ID NO: 146645 - DNA, 3366 bp, Artificial Sequence
  Description of Artificial Sequence: Synthetic coding sequence
atgagcaagctgaggatggtgctgctggaggacagcggcagcgctgacttccgccgccactttgtgaacctgagccccttcaccatcaccgtggtgctgctgctgagcgcctgctttgtgaccagcagcctgggcggcacagacaaggagctgcggctggtggatggagaaaataaatgttctggccgggtggaggtgaaggtgcaggaggagtggggcaccgtgtgcaacaacggctggagcatggaggccgtgtctgtcatctgcaaccagctgggctgccccacagccatcaaggcccctggctgggccaacagcagcgctggcagcggccgcatctggatggaccacgtgtcctgcagaggaaatgaaagtgccctgtgggactgcaagcatgatggctggggcaagcacagcaactgcacccaccagcaggatgctggggtgacctgcagtgatggcagcaacctggagatgaggctgacccggggcggcaacatgtgcagcggccgcatcgagatcaagttccagggccgctggggcaccgtgtgtgatgacaacttcaacatcgaccacgccagcgtcatctgccggcagctggagtgtggcagcgctgtgtccttcagcggcagcagcaactttggagagggcagcggccccatctggtttgatgacctgatctgcaatggaaatgaaagtgccctgtggaactgcaagcaccagggctggggcaagcacaactgtgaccatgctgaagatgctggggtcatctgcagcaaaggagctgacctgagcctgcggctggtggatggagtgacagagtgcagcggccgcctggaggtgcgcttccagggcgagtggggcaccatctgtgatgatggctgggacagctatgatgctgctgtggcctgcaagcagctgggctgccccacagctgtgacagccatcggccgggtgaatgccagcaaaggatttggccacatctggctggacagcgtgtcctgccagggccacgagcccgccatctggcagtgcaagcaccacgagtggggcaagcactactgcaaccacaatgaagatgctggggtgacctgcagtgatggcagtgacctggagctgcggctgcggggcggcggcagccgctgtgccggcaccgtggaggtggagatccagaggctgctgggcaaggtgtgtgaccggggctggggcctgaaggaggctgatgtggtgtgccggcagctgggctgcggcagcgccctgaagaccagctaccaggtgtacagcaagatccaggccaccaacacctggctgttcctgagcagctgcaatggaaatgagaccagcctgtgggactgcaagaactggcagtggggcggcctgacctgtgaccactatgaggaggccaagatcacctgcagcgcccaccgggagccccggctggtgggcggggacatcccctgcagcggccgggtggaggtgaagcatggagacacctggggcagcatctgtgacagcgacttcagcctggaggccgcctctgtgctgtgccgggagctgcagtgtggcaccgtggtgtccatcctgggcggggcccactttggagagggcaatggccagatctgggccgaggagttccagtgtgagggccacgagagccacctgagcctgtgccctgtggcccccaggcctgagggcacctgcagccacagcagagatgtgggcgtggtgtgcagccgctacacagagatccggctggtgaatggcaagaccccctgtgagggccgggtggagctgaagaccctgggcgcctggggcagcctgtgcaacagccactgggacattgaagatgcccacgtgctgtgccagcagctgaagtgtggggtggccctgagcaccccaggaggagccaggtttggaaaaggaaatggccagatctggaggcacatgttccactgcacaggaacagagcagcacatgggagactgccctgtgacagccctgggcgccagcctgtgccccagcgagcaggtggccagcgtcatctgcagcggcaaccagagccagaccctgagcagctgcaacagcagcagcctgggccccacccggcccaccatccctgaggagagcgctgtggcctgcatcgagagcggccagctgcggctggtgaatggaggcggccgctgtgccggccgggtggagatctaccacgagggctcctggggcaccatctgtgatgacagctgggacctgagtgatgcccacgtggtgtgccggcagctgggctgtggggaggccatcaatgccactggaagtgcccactttggagagggcaccggccccatctggctggatgagatgaagtgcaatggcaaggagagccgcatctggcagtgccacagccacggctggggccagcagaactgccgccacaaggaggatgctggggtcatctgcagcgagttcatgagcctgcggctgaccagcgaggccagccgggaggcctgtgccggccgcctggaggtgttctacaacggggcctggggcaccgtgggcaagagctccatgtctgagaccaccgtgggcgtggtgtgccggcagctgggctgtgccgacaagggcaagatcaacccagccagcctggacaaggccatgagcatccccatgtgggtggacaacgtgcagtgccccaagggccctgacaccctgtggcagtgccccagcagcccctgggagaagaggctggccagccccagcgaggagacctggatcacctgtgacaacaagatccggctgcaggagggccccaccagctgcagcggccgggtggagatctggcacggcggctcctggggcaccgtgtgtgatgacagctgggacctggatgatgcccaggtggtgtgccagcagctgggctgcggccctgccctgaaggccttcaaggaggccgagtttggccagggcaccggccccatctggctgaatgaggtgaagtgcaagggaaatgaaagcagcctgtgggactgcccagcccggcgctggggccacagtgaatgtggccacaaggaggatgctgctgtgaactgcacagacatctctgtgcagaagaccccccagaaggccaccaccggccgcagcagccggcagagcagcttcatcgctgtgggcatcctgggcgtggtgctgctggccatctttgtggccctcttcttcctgaccaagaagaggcggcagaggcagaggctggccgtgagcagcagaggagagaacctggtgcaccagatccagtaccgggagatgaacagctgcctgaatgctgatgacctggacctgatgaacagcagcggcggccacagcgagccccactag

SEQ ID NO: 146646 - DNA, 555 bp, Artificial Sequence
  Description of Artificial Sequence: Synthetic coding sequence
atgagccggctgagccgcagcctgctgtgggccgccacctgcctgggcgtgctgtgtgtgctgtctgctgacaagaacaccacccagcaccccaacgtgaccaccctggcccccatcagcaatgtgaccagcgcccctgtgaccagcctgcccctggtgaccaccccagcccctgagacctgtgagggcaggaacagctgtgtgtcctgcttcaacgtgtctgtggtgaacaccacctgcttctggattgagtgcaaggatgagagctactgcagccacaacagcacagtgtctgactgccaggtgggcaacaccacagacttctgcagcgccaagcccaccgtgcagcccagccccagcaccaccagcaagacagtgaccaccagcggcaccaccaacaacacagtgacccccaccagccagcctgtgaggaagagcacctttgatgctgccagcttcatcggcggcatcgtgctggtgctgggcgtgcaggccgtcatcttcttcctgtacaagttctgcaagagcaaggagaggaactaccacaccctgtag

SEQ ID NO: 146647 - DNA, 594 bp, Artificial Sequence
  Description of Artificial Sequence: Synthetic coding sequence
atgagccggctgagccgcagcctgctgtgggccgccacctgcctgggcgtgctgtgtgtgctgtctgctgacaagaacaccacccagcaccccaacgtgaccaccctggcccccatcagcaatgtgaccagcgcccctgtgaccagcctgcccctggtgaccaccccagcccctgagacctgtgagggcaggaacagctgtgtgtcctgcttcaacgtgtctgtggtgaacaccacctgcttctggattgagtgcaaggatgagagctactgcagccacaacagcacagtgtctgactgccaggtgggcaacaccacagacttctgcagcgtgtccacagccacccctgtgcccacagccaacagcacagccaagcccaccgtgcagcccagccccagcaccaccagcaagacagtgaccaccagcggcaccaccaacaacacagtgacccccaccagccagcctgtgaggaagagcacctttgatgctgccagcttcatcggcggcatcgtgctggtgctgggcgtgcaggccgtcatcttcttcctgtacaagttctgcaagagcaaggagaggaactaccacaccctgtag

SEQ ID NO: 146648 - DNA, 537 bp, Artificial Sequence
  Description of Artificial Sequence: Synthetic coding sequence
atgagccggctgagccgcagcctgctgtgggccgccacctgcctgggcgtgctgtgtgtgctgtctgctgacaagaacaccacccagcaccccaacgtgaccaccctggcccccatcagcaatgtgaccagcgcccctgtgaccagcctgcccctggtgaccaccccagcccctgagacctgtgagggcaggaacagctgtgtgtcctgcttcaacgtgtctgtggtgaacaccacctgcttctggattgagtgcaaggatgagagctactgcagccacaacagcacagtgtctgactgccaggtgggcaacaccacagacttctgcagcgtgtccacagccacccctgtgcccacagccaacagcacaggcaccaccaacaacacagtgacccccaccagccagcctgtgaggaagagcacctttgatgctgccagcttcatcggcggcatcgtgctggtgctgggcgtgcaggccgtcatcttcttcctgtacaagttctgcaagagcaaggagaggaactaccacaccctgtag

SEQ ID NO: 146649 - DNA, 498 bp, Artificial Sequence
  Description of Artificial Sequence: Synthetic coding sequence
atgagccggctgagccgcagcctgctgtgggccgccacctgcctgggcgtgctgtgtgtgctgtctgctgacaagaacaccacccagcaccccaacgtgaccaccctggcccccatcagcaatgtgaccagcgcccctgtgaccagcctgcccctggtgaccaccccagcccctgagacctgtgagggcaggaacagctgtgtgtcctgcttcaacgtgtctgtggtgaacaccacctgcttctggattgagtgcaaggatgagagctactgcagccacaacagcacagtgtctgactgccaggtgggcaacaccacagacttctgcagcggcaccaccaacaacacagtgacccccaccagccagcctgtgaggaagagcacctttgatgctgccagcttcatcggcggcatcgtgctggtgctgggcgtgcaggccgtcatcttcttcctgtacaagttctgcaagagcaaggagaggaactaccacaccctgtag

SEQ ID NO: 146650 - DNA, 570 bp, Artificial Sequence
  Description of Artificial Sequence: Synthetic coding sequence
atgagccggctgagccgcagcctgctgtgggccgccacctgcctgggcgtgctgtgtgtgctgtctgctgacaagaacaccacccagcaccccaacgtgaccaccctggcccccatcagcaatgtgaccagcgcccctgtgaccagcctgcccctggtgaccaccccagcccctgagacctgtgagggcaggaacagctgtgtgtcctgcttcaacgtgtctgtggtgaacaccacctgcttctggattgagtgcaaggatgagagctactgcagccacaacagcacagtgtctgactgccaggtgggcaacaccacagacttctgcagcgtgtccacagccacccctgtgcccacagccaacagcacagccaagcccaccgtgcagcccagccccagcaccaccagcaagacagtgaccaccagcggcaccaccaacaacacagtgacccccaccagccagcctgtgaggaagagcacctttgatgctgccagcttcatcggcggcatcgtgctggtgctggagatccgctgccacaccaggaactacatcccagacctgaagaagtag

SEQ ID NO: 146651 - DNA, 474 bp, Artificial Sequence
  Description of Artificial Sequence: Synthetic coding sequence
atgagccggctgagccgcagcctgctgtgggccgccacctgcctgggcgtgctgtgtgtgctgtctgctgacaagaacaccacccagcaccccaacgtgaccaccctggcccccatcagcaatgtgaccagcgcccctgtgaccagcctgcccctggtgaccaccccagcccctgagacctgtgagggcaggaacagctgtgtgtcctgcttcaacgtgtctgtggtgaacaccacctgcttctggattgagtgcaaggatgagagctactgcagccacaacagcacagtgtctgactgccaggtgggcaacaccacagacttctgcagcgtgtccacagccacccctgtgcccacagccaacagcacagccaagcccaccgtgcagcccagccccagcaccaccagcaagacagtgaccaccagcgagatccgctgccacaccaggaactacatcccagacctgaagaagtag

SEQ ID NO: 146652 - DNA, 747 bp, Artificial Sequence
  Description of Artificial Sequence: Synthetic coding sequence
atgtctgctgtgctgctgctggccctgctgggcttcatcctgcccctgcccggggtgcaggccctgctgtgccagtttggcaccgtgcagcacgtgtggaaggtgtctgacctgccccggcagtggacccccaagaacaccagctgtgacagcggcctgggctgccaggacaccctgatgctgattgagagcggcccccaggtgtccctggtgctgagcaagggctgcacagaggccaaggaccaggagccccgggtgacagagcacaggatgggccctggcctgagcctcatctcctacacctttgtgtgccggcaggaggacttctgcaacaacctggtgaacagcctgcccctgtgggccccccagcccccagctgaccccggcagcctgcgctgccctgtgtgcctgtccatggagggctgcctggagggcaccacagaggagatctgccccaagggcaccacccactgctatgatggcctgctgcggctgcggggcggcggcatcttcagcaacctgcgggtgcagggctgcatgccccagcctgtgtgcaacctgctgaatggcacccaggagatcggccctgtgggcatgacagagaactgtgacatgaaggacttcctgcagctgaagcctgtgggcctgctggaggagcacaacgtgggggagaaggagcggggccagggccagcaccagtgtgtgcagctggactggcagaagagagctgccaccggcatcttctag

SEQ ID NO: 146653 - DNA, 438 bp, Artificial Sequence
  Description of Artificial Sequence: Synthetic coding sequence
atgtctgctgtgctgctgctggccctgctgggcttcatcctgcccctgcccggggtgcaggccctgctgtgccagtttggcaccgtgcagcacgtgtggaaggtgtctgacctgccccggcagtggacccccaagaacaccagctgtgacagcggcctgggctgccaggacaccctgatgctgattgagagcggcccccaggtgtccctggtgctgagcaagggctgcacagaggccaaggaccaggagccccgggtgacagagcacaggatgggccctggcctgagcctcatctcctacacctttgtgtgccggcaggaggacttctgcaacaacctggtgaacagcctgcccctgtgggccccccagcccccagctgaccccatgatgggcgctgctgagggcccctttgggaaggccgagcaggtggacagctag

SEQ ID NO: 146654 - DNA, 438 bp, Artificial Sequence; identical to SEQ ID NO: 146653
  Description of Artificial Sequence: Synthetic coding sequence

SEQ ID NO: 146655 - DNA, 1671 bp, Artificial Sequence
  Description of Artificial Sequence: Synthetic coding sequence
atgcccccaccccggctgctcttcttcctgctcttcctgacccccatggaggtgcggcctgaggagcccctggtggtgaaggtggaggagggggacaatgctgtgctgcagtgcctgaagggcaccagtgatggccccacccagcagctgacctggagccgggagagccccctgaagcccttcctgaagctgagcctgggcctgcccggcctgggcatccacatgaggcccctggccatctggctgttcatcttcaacgtgtcccagcagatgggcggcttctacctgtgccagcccggccccccatctgagaaggcctggcagcccggctggacagtgaatgtggagggcagcggggagctgttccgctggaatgtgtctgacctgggcggcctgggctgcggcctgaagaacagaagcagcgagggccccagcagccccagcggcaagctgatgagccccaagctgtatgtgtgggccaaggacaggcctgagatctgggagggggagcccccctgcctgcccccccgggacagcctgaaccagagcctgagccaggacctgaccatggcccctggcagcaccctgtggctgagctgtggggtgcccccagacagcgtgtcccggggccccctgtcctggacccacgtgcaccccaagggccccaagagcctgctgagcctggagctgaaggatgacaggcctgcccgggacatgtgggtgatggagaccggcctgctgctgccccgggccacagcccaggatgctgggaagtactactgccaccggggcaacctgaccatgtccttccacctggagatcacagcccggcctgtgctgtggcactggctgctgaggactggaggctggaaggtgtctgctgtgaccctggcctacctgatcttctgcctgtgcagcctggtgggcatcctgcacctgcagagggccctggtgctgcggaggaagaggaagaggatgacagaccccacccggcgcttcttcaaggtgaccccacctcctggcagcggcccccagaaccagtatggaaatgtgctgagcctgcccacccccaccagcggcctgggccgggcccagcgctgggccgccggcctgggcggcacagcccccagctatggcaaccccagcagtgatgtgcaggctgatggagccctgggcagccgcagccccccaggagtgggccctgaggaggaggagggggagggctatgaggagccagacagcgaggaggacagcgagttctatgaaaatgacagcaacctgggccaggaccagctgagccaggacggcagcggctatgagaacccagaagatgagcccctgggcccagaagatgaggacagcttcagcaatgctgagagctatgaaaatgaagatgaggagctgacccagcctgtggcccggaccatggacttcctgagcccccacggcagcgcctgggaccccagccgggaggccaccagcctgggcagccagagctatgaggacatgaggggcatcctgtatgctgccccccagctgcggagcatccggggccagcccggccccaaccacgaggaggatgctgacagctatgagaacatggacaacccagatggccctgaccctgcctggggcggcggcggccgcatgggcacctggagcaccaggtag

SEQ ID NO: 146656 - DNA, 1092 bp, Artificial Sequence
  Description of Artificial Sequence: Synthetic coding sequence
atggaggtgcggcctgaggagcccctggtggtgaaggtggaggagggggacaatgctgtgctgcagtgcctgaagggcaccagtgatggccccacccagcagctgacctggagccgggagagccccctgaagcccttcctgaagctgagcctgggcctgcccggcctgggcatccacatgaggcccctgggcaagtactactgccaccggggcaacctgaccatgtccttccacctggagatcacagcccggcctgtgctgtggcactggctgctgaggactggaggctggaaggtgtctgctgtgaccctggcctacctgatcttctgcctgtgcagcctggtgggcatcctgcacctgcagagggccctggtgctgcggaggaagaggaagaggatgacagaccccacccggcgcttcttcaaggtgaccccacctcctggcagcggcccccagaaccagtatggaaatgtgctgagcctgcccacccccaccagcggcctgggccgggcccagcgctgggccgccggcctgggcggcacagcccccagctatggcaaccccagcagtgatgtgcaggctgatggagccctgggcagccgcagccccccaggagtgggccctgaggaggaggagggggagggctatgaggagccagattctgaagaagattctgagttctatgaaaatgacagcaacctgggccaggaccagctgagccaggacggcagcggctatgaaaatccagaagatgagcccctgggcccagaagatgaagattccttcagcaatgctgagagctatgaaaatgaagatgaggagctgacccagcctgtggcccggaccatggacttcctgagcccccacggcagcgcctgggaccccagccgggaggccaccagcctgggcagccagagctatgaggacatgaggggcatcctgtatgctgccccccagctgcggagcatccggggccagcccggccccaaccatgaagaagatgctgacagctatgagaacatggacaacccagatggccctgaccctgcctggggcggcggcggccgcatgggcacctggagcaccaggtag

SEQ ID NO: 146657 - DNA, 1218 bp, Artificial Sequence
  Description of Artificial Sequence: Synthetic coding sequence
atgagccccaagctgtatgtgtgggccaaggacaggcctgagatctgggagggggagcccccctgcctgcccccccgggacagcctgaaccagagcctgagccaggacctgaccatggcccctggcagcaccctgtggctgagctgtggggtgcccccagattctgtgtcccggggccccctgtcctggacccacgtgcaccccaagggccccaagagcctgctgagcctggagctgaaggatgacaggcctgcccgggacatgtgggtgatggagaccggcctgctgctgccccgggccacagcccaggatgctgggaagtactactgccaccggggcaacctgaccatgtccttccacctggagatcacagcccggcctgtgctgtggcactggctgctgaggactggaggctggaaggtgtctgctgtgaccctggcctacctgatcttctgcctgtgcagcctggtgggcatcctgcacctgcagagggccctggtgctgcggaggaagaggaagaggatgacagaccccacccggcgcttcttcaaggtgaccccacctcctggcagcggcccccagaaccagtatggaaatgtgctgagcctgcccacccccaccagcggcctgggccgggcccagcgctgggccgccggcctgggcggcacagcccccagctatggcaaccccagcagtgatgtgcaggctgatggagccctgggcagccgcagccccccaggagtgggccctgaggaggaggagggggagggctatgaggagccagattctgaagaagattctgagttctatgaaaatgacagcaacctgggccaggaccagctgagccaggacggcagcggctatgaaaatccagaagatgagcccctgggcccagaagatgaagattccttcagcaatgctgagagctatgaaaatgaagatgaggagctgacccagcctgtggcccggaccatggacttcctgagcccccacggcagcgcctgggaccccagccgggaggccaccagcctgggcagccagagctatgaggacatgaggggcatcctgtatgctgccccccagctgcggagcatccggggccagcccggccccaaccatgaagaagatgctgacagctatgagaacatggacaacccagatggccctgaccctgcctggggcggcggcggccgcatgggcacctggagcaccaggtag

SEQ ID NO: 146658 - DNA, 1674 bp, Artificial Sequence
  Description of Artificial Sequence: Synthetic coding sequence
atgcccccaccccggctgctcttcttcctgctcttcctgacccccatggaggtgcggcctgaggagcccctggtggtgaaggtggaggagggggacaatgctgtgctgcagtgcctgaagggcaccagtgatggccccacccagcagctgacctggagccgggagagccccctgaagcccttcctgaagctgagcctgggcctgcccggcctgggcatccacatgaggcccctggccatctggctgttcatcttcaacgtgtcccagcagatgggcggcttctacctgtgccagcccggccccccatctgagaaggcctggcagcccggctggacagtgaatgtggagggcagcggggagctgttccgctggaatgtgtctgacctgggcggcctgggctgcggcctgaagaacagaagcagcgagggccccagcagccccagcggcaagctgatgagccccaagctgtatgtgtgggccaaggacaggcctgagatctgggagggggagcccccctgcctgcccccccgggacagcctgaaccagagcctgagccaggacctgaccatggcccctggcagcaccctgtggctgagctgtggggtgcccccagacagcgtgtcccggggccccctgtcctggacccacgtgcaccccaagggccccaagagcctgctgagcctggagctgaaggatgacaggcctgcccgggacatgtgggtgatggagaccggcctgctgctgccccgggccacagcccaggatgctgggaagtactactgccaccggggcaacctgaccatgtccttccacctggagatcacagcccggcctgtgctgtggcactggctgctgaggactggaggctggaaggtgtctgctgtgaccctggcctacctgatcttctgcctgtgcagcctggtgggcatcctgcacctgcagagggccctggtgctgcggaggaagaggaagaggatgacagaccccacccggcgcttcttcaaggtgaccccacctcctggcagcggcccccagaaccagtatggaaatgtgctgagcctgcccacccccaccagcggcctgggccgggcccagcgctgggccgccggcctgggcggcacagcccccagctatggcaaccccagcagtgatgtgcaggctgatggagccctgggcagccgcagccccccaggagtgggccctgaggaggaggagggggagggctatgaggagccagacagcgaggaggacagcgagttctatgaaaatgacagcaacctgggccaggaccagctgagccaggacggcagcggctatgagaacccagaagatgagcccctgggcccagaagatgaggacagcttcagcaatgctgagagctatgaaaatgaagatgaggagctgacccagcctgtggcccggaccatggacttcctgagcccccacggcagcgcctgggaccccagccgggaggccaccagcctggccggcagccagagctatgaggacatgaggggcatcctgtatgctgccccccagctgcggagcatccggggccagcccggccccaaccatgaagaagatgctgacagctatgagaacatggacaacccagatggccctgaccctgcctggggcggcggcggccgcatgggcacctggagcaccaggtag

SEQ ID NO: 146659 - DNA, 984 bp, Artificial Sequence
  Description of Artificial Sequence: Synthetic coding sequence
atgctgttcctgctgctgcccctgctggccgtgctgcctggagatggaaatgctgatggcctgaaggagcccctgtccttccacgtgacctggatcgccagcttctacaaccacagctggaagcagaacctggtgtctggctggctgagtgacctgcagacccacacctgggacagcaacagcagcaccatcgtgttcctgtgcccctggagccggggcaacttcagcaatgaggagtggaaggagctggagaccctcttccgcatccgcaccatccgcagctttgagggcatcagaagatatgcccacgagctgcagtttgagtacccctttgagatccaggtgactggaggctgtgagctgcacagcggcaaggtgtctggcagcttcctgcagctggcctaccagggcagtgactttgtgtccttccagaacaacagctggctgccctaccctgtggccggcaacatggccaagcacttctgcaaggtgctgaaccagaaccagcatgaaaatgacatcacccacaacctgctgagtgacacctgcccccgcttcatcctgggcctgctggatgctgggaaggcccacctgcagaggcaggtgaagccagaggcctggctgagccacggccccagccctggccctggccacctgcagctggtgtgccacgtgtctggcttctaccccaagcctgtgtgggtgatgtggatgagaggagagcaggagcagcagggcacccagagaggagacatcctgcccagcgcagatggcacctggtacctgcgggccaccctggaggtggccgccggggaggccgctgacctgagctgccgggtgaagcacagcagcctggagggccaggacatcgtgctgtactgggagcaccacagctctgtgggcttcatcatcctggccgtcatcgtgcccctgctgctgctgattggcctggccctgtggttcaggaagcgctgcttctgctag

SEQ ID NO: 146660 - DNA, 1002 bp, Artificial Sequence
  Description of Artificial Sequence: Synthetic coding sequence
atgctgctgctgcccttccagctgctggccgtgctcttccctgggggcaacagcgagcacgccttccagggccccaccagcttccacgtgatccagaccagcagcttcaccaacagcacctgggcccagacccagggcagcggctggctggatgacctgcagatccacggctgggacagcgacagcggcacagccatcttcctgaagccctggagcaaaggaaacttcagtgacaaggaggtggccgagctggaggagatcttccgggtgtacatctttggatttgcccgggaggtgcaggactttgctggggacttccagatgaagtacccctttgagatccagggcattgctggctgtgagctgcacagcggcggggccatcgtgtccttcctgcggggggccctgggcggcctggacttcctgtctgtgaagaatgccagctgtgtgcccagccctgagggcggcagccgggcccagaagttctgtgccctgatcatccagtaccagggcatcatggagaccgtgcgcatcctgctgtatgagacctgcccccgctacctgctgggcgtgctgaatgctgggaaggctgacctgcagaggcaggtgaagccagaggcctggctgagcagcggccccagccctggccctggccgcctgcagctggtgtgccacgtgtctggcttctaccccaagcctgtgtgggtgatgtggatgagaggagagcaggagcagcagggcacccagctgggggacatcctgcccaatgccaactggacctggtacctgcgggccaccctggatgtggctgatggagaggccgccggcctgagctgccgggtgaagcacagcagcctggagggccaggacatcatcctgtactggaggaaccccaccagcatcggcagcatcgtgctggccatcatcgtgcccagcctgctgctgctgctgtgcctggccctgtggtacatgagaagaagaagctaccagaacatcccctag

SEQ ID NO: 146661 - DNA, 741 bp, Artificial Sequence
  Description of Artificial Sequence: Synthetic coding sequence
tgaagcagcttcaccaacagcacctgggcccagacccagggcagcggctggctggatgacctgcagatccacggctgggacagcgacagcggcacagccatcttcctgaagccctggagcaaaggaaacttcagtgacaaggaggtggccgagctggaggagatcttccgggtgtacatctttggatttgcccgggaggtgcaggactttgctggggacttccagatgaagtacccctttgagatccagggcattgctggctgtgagctgcacagcggcggggccatcgtgtccttcctgcggggggccctgggcggcctggacttcctgtctgtgaagaatgccagctgtgtgcccagccctgagggcggcagccgggcccagaagttctgtgccctgatcatccagtaccagggcatcatggagaccgtgcgcatcctgctgtatgagacctgcccccgctacctgctgggcgtgctgaatgctgggaaggctgacctgcagaggcaggtgaagccagaggcctggctgagcagcggccccagccctggccctggccgcctgcagctggtgtgccacgtgtctggcttctaccccaagcctgtgtgggtgatgtggatgaggggcaaccccaccagcatcggcagcatcgtgctggccatcatcgtgcccagcctgctgctgctgctgtgcctggccctgtggtacatgagaagaagaagctaccagaacatcccctag

SEQ ID NO: 146662 - DNA, 1041 bp, Artificial Sequence
  Description of Artificial Sequence: Synthetic coding sequence
atgctgttcctgcagttcctgctgctggccctgctgctgcccggcggggacaatgctgatgccagccaggagcacgtgtccttccacgtgatccagatcttctcctttgtgaaccagagctgggcccggggccagggcagcggctggctggatgagctgcagacccacggctgggacagcgagagcggcaccatcatcttcctgcacaactggagcaaaggaaacttcagcaatgaggagctgagtgacctggagctgctcttccgcttctacctgtttggcctgacccgggagatccaggaccacgccagccaggactacagcaagtacccctttgaggtgcaggtgaaggccggctgtgagctgcacagcggcaagagccctgagggcttcttccaggtggccttcaacggcctggacctgctgtccttccagaacaccacctgggtgcccagccctggctgcggcagcctggcccagagcgtgtgccacctgctgaaccaccagtatgagggcgtgacagagaccgtgtacaacctgatccgcagcacctgcccccgcttcctgctgggcctgctggatgctgggaagatgtatgtgcaccggcaggtgcggcctgaggcctggctgagcagccggcccagcctgggcagcggccagctgctgctggtgtgccacgccagcggcttctaccccaagcctgtgtgggtgacctggatgagaaatgagcaggagcagctgggcaccaagcatggagacatcctgcccaatgctgatggcacctggtacctgcaggtgatcctggaggtggccagcgaggagcccgccggcctgagctgccgggtgcgccacagcagcctgggcggccaggacatcatcctgtactgggcccacatccgcaccagctgtgagaccctgcccccagacagccccatcgtgctgcggacccagcagcccaggagcctggtgcagtacagtgatgccatccccagcaccctgcacctgaactgcttctccttctgcatcatcaacatctgctag

SEQ ID NO: 146663 - DNA, 1002 bp, Artificial Sequence
  Description of Artificial Sequence: Synthetic coding sequence
atgctgttcctgcagttcctgctgctggccctgctgctgcccggcggggacaatgctgatgccagccaggagcacgtgtccttccacgtgatccagatcttctcctttgtgaaccagagctgggcccggggccagggcagcggctggctggatgagctgcagacccacggctgggacagcgagagcggcaccatcatcttcctgcacaactggagcaaaggaaacttcagcaatgaggagctgagtgacctggagctgctcttccgcttctacctgtttggcctgacccgggagatccaggaccacgccagccaggactacagcaagtacccctttgaggtgcaggtgaaggccggctgtgagctgcacagcggcaagagccctgagggcttcttccaggtggccttcaacggcctggacctgctgtccttccagaacaccacctgggtgcccagccctggctgcggcagcctggcccagagcgtgtgccacctgctgaaccaccagtatgagggcgtgacagagaccgtgtacaacctgatccgcagcacctgcccccgcttcctgctgggcctgctggatgctgggaagatgtatgtgcaccggcaggtgcggcctgaggcctggctgagcagccggcccagcctgggcagcggccagctgctgctggtgtgccacgccagcggcttctaccccaagcctgtgtgggtgacctggatgagaaatgagcaggagcagctgggcaccaagcatggagacatcctgcccaatgctgatggcacctggtacctgcaggtgatcctggaggtggccagcgaggagcccgccggcctgagctgccgggtgcgccacagcagcctgggcggccaggacatcatcctgtactggggccaccacttctccatgaactggatcgccctggtggtgattgtgcccctggtgatcctgattgtgctggtgctgtggttcaagaagcactgcagctaccaggacatcctgtag

SEQ ID NO: 146664 - DNA, 846 bp, Artificial Sequence
  Description of Artificial Sequence: Synthetic coding sequence
tgattcctgcacaactggagcaagggcaacttcagcaatgaggagctgagtgacctggagctgctcttccgcttctacctgtttggcctgacccgggagatccaggaccacgccagccaggactacagcaagtacccctttgaggtgcaggtgaaggccggctgtgagctgcacagcggcaagagccctgagggcttcttccaggtggccttcaacggcctggacctgctgtccttccagaacaccacctgggtgcccagccctggctgcggcagcctggcccagagcgtgtgccacctgctgaaccaccagtatgaaggagtgacagaaacagtgtacaacctgatccgcagcacctgcccccgcttcctgctgggcctgctggatgctgggaagatgtatgtgcaccggcaggtgcggcctgaggcctggctgagcagccggcccagcctgggcagcggccagctgctgctggtgtgccacgccagcggcttctaccccaagcctgtgtgggtgacctggatgagaaatgagcaggagcagctgggcaccaagcacggggacatcctgcccaatgctgatggcacctggtacctgcaggtgatcctggaggtggccagcgaggagcctgctggcctgagctgccgggtgcgccacagcagcctgggcggccaggacatcatcctgtactgggcccacatccgcaccagctgtgagaccctgcccccagacagccccatcgtgctgcggacccagcagcccaggagcctggtgcagtacagtgatgccatccccagcaccctgcacctgaactgcttctccttctgcatcatcaacatctgctag

SEQ ID NO: 146665 - DNA, 411 bp, Artificial Sequence
  Description of Artificial Sequence: Synthetic coding sequence
atgtatgtgcaccggcaggtgcggcctgaggcctggctgagcagccggcccagcctgggcagcggccagctgctgctggtgtgccacgccagcggcttctaccccaagcctgtgtgggtgacctggatgagaaatgagcaggagcagctgggcaccaagcacggggacatcctgcccaatgctgatggcacctggtacctgcaggtgatcctggaggtggccagcgaggagcctgctggcctgagctgccgggtgcgccacagcagcctgggcggccaggacatcatcctgtactggggccaccacttctccatgaactggatcgccctggtggtgattgtgcccctggtgatcctgattgtgctggtgctgtggttcaagaagcactgcagctaccaggacatcctgtag

SEQ ID NO: 146666 - DNA, 1008 bp, Artificial Sequence
  Description of Artificial Sequence: Synthetic coding sequence
atgggctgcctgctcttcctgctgctgtgggccctgctgcaggcctggggcagcgctgaggtgccccagaggctcttccccctgcgctgcctgcagatcagcagctttgccaacagctcctggaccaggacagatggcctggcctggctgggggagctgcagacccacagctggagcaatgacagcgacacagtgcgcagcctgaagccctggagccagggcaccttcagtgaccagcagtgggagaccctgcagcacatcttccgggtgtaccgcagcagcttcaccagagatgtgaaggagtttgccaagatgctgcggctgagctaccccctggagctgcaggtgtctgctggctgtgaggtgcaccctggaaatgccagcaacaacttcttccacgtggccttccagggcaaggacatcctgtccttccagggcacctcctgggagcccacccaggaggcccccctgtgggtgaacctggccatccaggtgctgaaccaggacaagtggacccgggagaccgtgcagtggctgctgaatggcacctgcccccagtttgtgtctggcctgctggagagcggcaagtctgagctgaagaagcaggtgaagcccaaggcctggctgagccggggccccagccctggccctggccgcctgctgctggtgtgccacgtgtctggcttctaccccaagcctgtgtgggtgaagtggatgagaggagagcaggagcagcagggcacccagcccggggacatcctgcccaatgctgatgagacctggtacctgcgggccaccctggatgtggtggccggggaggccgccggcctgagctgccgggtgaagcacagcagcctggagggccaggacatcgtgctgtactggggcggcagctacacctccatgggcctgattgccctggccgtgctggcctgcctgctcttcctgctgattgtgggcttcaccagccgcttcaagaggcagaccagctaccagggcgtgctgtag

SEQ ID NO: 146667 - DNA, 435 bp, Artificial Sequence
  Description of Artificial Sequence: Synthetic coding sequence
atgctgctgctcttcctgctgtttgagggcctgtgctgccctggagagaacacagctgtgaagccagaggcctggctgagctgtggccccagccctggccctggccgcctgcagctggtgtgccacgtgtctggcttctaccccaagcctgtgtgggtgatgtggatgaggggcggctacagcatcttcctgatcctgatctgcctgaccgtcatcgtgaccctggtgatcctggtggtggtggacagccggctgaagaagcagagcagcaacaagaacatcctgagcccccacacccccagccctgtgttcctgatgggcgccaacacccaggacaccaagaacagccgccaccagttctgcctggcccaggtgtcctggatcaagaacagagtgctgaagaagtggaagacccggctgaaccagctgtggtag

SEQ ID NO: 146668 - DNA, 696 bp, Artificial Sequence
  Description of Artificial Sequence: Synthetic coding sequence
atgctgctgctcttcctgctgtttgagggcctgtgctgccctggagagaacacagctgccccccaggccctgcagagctaccacctggccgctgaggagcagctgtccttcaggatgctgcagaccagcagctttgccaaccacagctgggcccacagcgagggcagcggctggctgggggacctgcagacccacggctgggacacagtgctgggcaccatccgcttcctgaagccctggagccacggcaacttcagcaagcaggagctgaagaacctgcagagcctcttccagctgtacttccacagcttcatccagatcgtgcaggccagcgctggccagttccagctggagctgaagccagaggcctggctgagctgtggccccagccctggccctggccgcctgcagctggtgtgccacgtgtctggcttctaccccaagcctgtgtgggtgatgtggatgagaggaggctacagcatcttcctgatcctgatctgcctgactgtgattgtgaccctggtgatcctggtggtggtggacagccggctgaagaagcagagccctgtgttcctgatgggcgccaacacccaggacaccaagaacagccgccaccagttctgcctggcccaggtgtcctggatcaagaacagagtgctgaagaagtggaagacccggctgaaccagctgtggtag

SEQ ID NO: 146669 - DNA, 861 bp, Artificial Sequence
  Description of Artificial Sequence: Synthetic coding sequence
atgctgctgctcttcctgctgtttgagggcctgtgctgccctggagagaacacagctgccccccaggccctgcagagctaccacctggccgctgaggagcagctgtccttcaggatgctgcagaccagcagctttgccaaccacagctgggcccacagcgagggcagcggctggctgggggacctgcagacccacggctgggacacagtgctgggcaccatccgcttcctgaagccctggagccacggcaacttcagcaagcaggagctgaagaacctgcagagcctcttccagctgtacttccacagcttcatccagatcgtgcaggccagcgctggccagttccagctggagctgaagccagaggcctggctgagctgtggccccagccctggccctggccgcctgcagctggtgtgccacgtgtctggcttctaccccaagcctgtgtgggtgatgtggatgagaggagagcaggagcagaggggcacccagagaggagatgtgctgcccaatgctgatgagacctggtacctgcgggccaccctggatgtggccgccggggaggccgccggcctgagctgccgggtgaagcacagcagcctgggcggccatgacctgatcatccactggggcggctacagcatcttcctgatcctgatctgcctgaccgtcatcgtgaccctggtgatcctggtggtggtggacagccggctgaagaagcagagccctgtgttcctgatgggcgccaacacccaggacaccaagaacagccgccaccagttctgcctggcccaggtgtcctggatcaagaacagagtgctgaagaagtggaagacccggctgaaccagctgtggtag

SEQ ID NO: 146670 - DNA, 399 bp, Artificial Sequence
  Description of Artificial Sequence: Synthetic coding sequence
atgctgctgctcttcctgctgtttgagggcctgtgctgccctggagagaacacagctgtgaagccagaggcctggctgagctgtggccccagccctggccctggccgcctgcagctggtgtgccacgtgtctggcttctaccccaagcctgtgtgggtgatgtggatgaggggcggctacagcatcttcctgatcctgatctgcctgaccgtcatcgtgaccctggtgatcctggtggtggtggacagccggctgaagaagcagagccctgtgttcctgatgggcgccaacacccaggacaccaagaacagccgccaccagttctgcctggcccaggtgtcctggatcaagaacagagtgctgaagaagtggaagacccggctgaaccagctgtggtag

SEQ ID NO: 146671 - DNA, 1131 bp, Artificial Sequence
  Description of Artificial Sequence: Synthetic coding sequence
atgctgctgctcttcctgctgtttgagggcctgtgctgccctggagagaacacagctgccccccaggccctgcagagctaccacctggccgctgaggagcagctgtccttcaggatgctgcagaccagcagctttgccaaccacagctgggcccacagcgagggcagcggctggctgggggacctgcagacccacggctgggacacagtgctgggcaccatccgcttcctgaagccctggagccacggcaacttcagcaagcaggagctgaagaacctgcagagcctcttccagctgtacttccacagcttcatccagatcgtgcaggccagcgctggccagttccagctggagtacccctttgagatccagatcctggccggctgcaggatgaatgccccccagatcttcctgaacatggcctaccagggcagtgacttcctgtccttccagggcatctcctgggagcccagccctggagctggcatccgggcccagaacatctgcaaggtgctgaaccgctacctggacatcaaggagatcctgcagagcctgctgggccacacctgcccccgcttcctggccggcctgatggaggccggggagagcgagctgaagaggaaggtgaagccagaggcctggctgagctgtggccccagccctggccctggccgcctgcagctggtgtgccacgtgtctggcttctaccccaagcctgtgtgggtgatgtggatgagaggagagcaggagcagaggggcacccagagaggagatgtgctgcccaatgctgatgagacctggtacctgcgggccaccctggatgtggccgccggggaggccgccggcctgagctgccgggtgaagcacagcagcctgggcggccatgacctgatcatccactggggcggctacagcatcttcctgatcctgatctgcctgaccgtcatcgtgaccctggtgatcctggtggtggtggacagccggctgaagaagcagagccctgtgttcctgatgggcgccaacacccaggacaccaagaacagccgccaccagttctgcctggcccaggtgtcctggatcaagaacagagtgctgaagaagtggaagacccggctgaaccagctgtggtag

SEQ ID NO: 146672 - DNA, 873 bp, Artificial Sequence
  Description of Artificial Sequence: Synthetic coding sequence
atgctgctgctcttcctgctgtttgagggcctgtgctgccctggagagaacacagctgccccccaggccctgcagagctaccacctggccgctgaggagcagctgtccttcaggatgctgcagaccagcagctttgccaaccacagctgggcccacagcgagggcagcggctggctgggggacctgcagacccacggctgggacacagtgctgggcaccatccgcttcctgaagccctggagccacggcaacttcagcaagcaggagctgaagaacctgcagagcctcttccagctgtacttccacagcttcatccagatcgtgcaggccagcgctggccagttccagctggagtacccctttgagatccagatcctggccggctgcaggatgaatgccccccagatcttcctgaacatggcctaccagggcagtgacttcctgtccttccagggcatctcctgggagcccagccctggagctggcatccgggcccagaacatctgcaaggtgctgaaccgctacctggacatcaaggagatcctgcagagcctgctgggccacacctgcccccgcttcctggccggcctgatggaggccggggagagcgagctgaagaggaaggtgaagccagaggcctggctgagctgtggccccagccctggccctggccgcctgcagctggtgtgccacgtgtctggcttctaccccaagcctgtgtgggtgatgtggatgagaggagagcaggagcagaggggcacccagagaggagatgtgctgcccaatgctgatgagacctggtggatcttccacctgagccacccagacctgtttgactgtgacagctacccaggccacatcggctgcagctag

SEQ ID NO: 146673 - DNA, 183 bp, Artificial Sequence
  Description of Artificial Sequence: Synthetic coding sequence
tgagtgtctggcttctaccccaagcctgtgtgggtgatgtggatgagaggagagcaggagcagaggggcacccagagaggagatgtgctgcccaatgctgatgagacctggtggatcttccacctgagccacccagacctgtttgactgtgacagctacccaggccacatcggctgcagctag

SEQ ID NO: 146674 - DNA, 966 bp, Artificial Sequence
  Description of Artificial Sequence: Synthetic coding sequence
atgctgctgctcttcctgctgtttgagggcctgtgctgccctggagagaacacagctgccccccaggccctgcagagctaccacctggccgctgaggagcagctgtccttcaggatgctgcagaccagcagctttgccaaccacagctgggcccacagcgagggcagcggctggctgggggacctgcagacccacggctgggacacagtgctgggcaccatccgcttcctgaagccctggagccacggcaacttcagcaagcaggagctgaagaacctgcagagcctcttccagctgtacttccacagcttcatccagatcgtgcaggccagcgctggccagttccagctggagtacccctttgagatccagatcctggccggctgcaggatgaatgccccccagatcttcctgaacatggcctaccagggcagtgacttcctgtccttccagggcatctcctgggagcccagccctggagctggcatccgggcccagaacatctgcaaggtgctgaaccgctacctggacatcaaggagatcctgcagagcctgctgggccacacctgcccccgcttcctggccggcctgatggaggccggggagagcgagctgaagaggaaggtgaagccagaggcctggctgagctgtggccccagccctggccctggccgcctgcagctggtgtgccacgtgtctggcttctaccccaagcctgtgtgggtgatgtggatgagaggaggctacagcatcttcctgatcctgatctgcctgactgtgattgtgaccctggtgatcctggtggtggtggacagccggctgaagaagcagagccctgtgttcctgatgggcgccaacacccaggacaccaagaacagccgccaccagttctgcctggcccaggtgtcctggatcaagaacagagtgctgaagaagtggaagacccggctgaaccagctgtggtag

SEQ ID NO: 146675 - DNA, 306 bp, Artificial Sequence
  Description of Artificial Sequence: Synthetic coding sequence
atgctgctgctcttcctgctgtttgagggcctgtgctgccctggagagaacacagctgtgaagccagaggcctggctgagctgtggccccagccctggccctggccgcctgcagctggtgtgccacgtgtctggcttctaccccaagcctgtgtgggtgatgtggatgagaggagagcaggagcagaggggcacccagagaggagatgtgctgcccaatgctgatgagacctggtggatcttccacctgagccacccagacctgtttgactgtgacagctacccaggccacatcggctgcagctag

SEQ ID NO: 146676 - DNA, 897 bp, Artificial Sequence
  Description of Artificial Sequence: Synthetic coding sequence
atgctgctgctcttcctgctgtttgagggcctgtgctgccctggagagaacacagctgccccccaggccctgcagagctaccacctggccgctgaggagcagctgtccttcaggatgctgcagaccagcagctttgccaaccacagctgggcccacagcgagggcagcggctggctgggggacctgcagacccacggctgggacacagtgctgggcaccatccgcttcctgaagccctggagccacggcaacttcagcaagcaggagctgaagaacctgcagagcctcttccagctgtacttccacagcttcatccagatcgtgcaggccagcgctggccagttccagctggagctgaagccagaggcctggctgagctgtggccccagccctggccctggccgcctgcagctggtgtgccacgtgtctggcttctaccccaagcctgtgtgggtgatgtggatgagaggagagcaggagcagaggggcacccagagaggagatgtgctgcccaatgctgatgagacctggtacctgcgggccaccctggatgtggccgccggggaggccgccggcctgagctgccgggtgaagcacagcagcctgggcggccatgacctgatcatccactggggcggctacagcatcttcctgatcctgatctgcctgaccgtcatcgtgaccctggtgatcctggtggtggtggacagccggctgaagaagcagagcagcaacaagaacatcctgagcccccacacccccagccctgtgttcctgatgggcgccaacacccaggacaccaagaacagccgccaccagttctgcctggcccaggtgtcctggatcaagaacagagtgctgaagaagtggaagacccggctgaaccagctgtggtag

SEQ ID NO: 146677 - DNA, 564 bp, Artificial Sequence
  Description of Artificial Sequence: Synthetic coding sequence
atgctgctgctcttcctgctgtttgagggcctgtgctgccctggagagaacacagctgtgaagccagaggcctggctgagctgtggccccagccctggccctggccgcctgcagctggtgtgccacgtgtctggcttctaccccaagcctgtgtgggtgatgtggatgagaggagagcaggagcagaggggcacccagagaggagatgtgctgcccaatgctgatgagacctggtacctgcgggccaccctggatgtggccgccggggaggccgccggcctgagctgccgggtgaagcacagcagcctgggcggccatgacctgatcatccactggggcggctacagcatcttcctgatcctgatctgcctgactgtgattgtgaccctggtgatcctggtggtggtggacagccggctgaagaagcagagccctgtgttcctgatgggcgccaacacccaggacaccaagaacagccgccaccagttctgcctggcccaggtgtcctggatcaagaacagagtgctgaagaagtggaagacccggctgaaccagctgtggtag

SEQ ID NO: 146678 - DNA, 1167 bp, Artificial Sequence
  Description of Artificial Sequence: Synthetic coding sequence
atgctgctgctcttcctgctgtttgagggcctgtgctgccctggagagaacacagctgccccccaggccctgcagagctaccacctggccgctgaggagcagctgtccttcaggatgctgcagaccagcagctttgccaaccacagctgggcccacagcgagggcagcggctggctgggggacctgcagacccacggctgggacacagtgctgggcaccatccgcttcctgaagccctggagccacggcaacttcagcaagcaggagctgaagaacctgcagagcctcttccagctgtacttccacagcttcatccagatcgtgcaggccagcgctggccagttccagctggagtacccctttgagatccagatcctggccggctgcaggatgaatgccccccagatcttcctgaacatggcctaccagggcagtgacttcctgtccttccagggcatctcctgggagcccagccctggagctggcatccgggcccagaacatctgcaaggtgctgaaccgctacctggacatcaaggagatcctgcagagcctgctgggccacacctgcccccgcttcctggccggcctgatggaggccggggagagcgagctgaagaggaaggtgaagccagaggcctggctgagctgtggccccagccctggccctggccgcctgcagctggtgtgccacgtgtctggcttctaccccaagcctgtgtgggtgatgtggatgagaggagagcaggagcagaggggcacccagagaggagatgtgctgcccaatgctgatgagacctggtacctgcgggccaccctggatgtggccgccggggaggccgccggcctgagctgccgggtgaagcacagcagcctgggcggccatgacctgatcatccactggggcggctacagcatcttcctgatcctgatctgcctgaccgtcatcgtgaccctggtgatcctggtggtggtggacagccggctgaagaagcagagcagcaacaagaacatcctgagcccccacacccccagccctgtgttcctgatgggcgccaacacccaggacaccaagaacagccgccaccagttctgcctggcccaggtgtcctggatcaagaacagagtgctgaagaagtggaagacccggctgaaccagctgtggtag

SEQ ID NO: 146679 - DNA, 1023 bp, Artificial Sequence
  Description of Artificial Sequence: Synthetic coding sequence
atgatcaagagccgggtgaagcgctacagaagaagaagaggcagccagagggccccccaggccctgcagagctaccacctggccgctgaggagcagctgtccttcaggatgctgcagaccagcagctttgccaaccacagctgggcccacagcgagggcagcggctggctgggggacctgcagacccacggctgggacacagtgctgggcaccatccgcttcctgaagccctggagccacggcaacttcagcaagcaggagctgaagaacctgcagagcctcttccagctgtacttccacagcttcatccagatcgtgcaggccagcgctggccagttccagctggagtacccctttgagatccagatcctggccggctgcaggatgaatgccccccagatcttcctgaacatggcctaccagggcagtgacttcctgtccttccagggcatctcctgggagcccagccctggagctggcatccgggcccagaacatctgcaaggtgctgaaccgctacctggacatcaaggagatcctgcagagcctgctgggccacacctgcccccgcttcctggccggcctgatggaggccggggagagcgagctgaagaggaaggtgaagccagaggcctggctgagctgtggccccagccctggccctggccgcctgcagctggtgtgccacgtgtctggcttctaccccaagcctgtgtgggtgatgtggatgagaggagagcaggagcagaggggcacccagagaggagatgtgctgcccaatgctgatgagacctggtacctgcgggccaccctggatgtggccgccggggaggccgccggcctgagctgccgggtgaagcacagcagcctgggcggccatgacctgatcatccactggggcgagaagcagctgcggctgtgctgggagatcatgaagatcgccctgggcctgctgtctgtgggcctgaggaagtgggtgggcatgctgggcacccggcgggtgaagctgggccagagcaagtag

SEQ ID NO: 146680 - DNA, 870 bp, Artificial Sequence
  Description of Artificial Sequence: Synthetic coding sequence
atgctgctgctcttcctgctgtttgagggcctgtgctgccctggagagaacacagctgacccctttgagatccagatcctggccggctgcaggatgaatgccccccagatcttcctgaacatggcctaccagggcagtgacttcctgtccttccagggcatctcctgggagcccagccctggggccggcatccgggcccagaacatctgcaaggtgctgaaccgctacctggacatcaaggagatcctgcagagcctgctgggccacacctgcccccgcttcctggccggcctgatggaggccggggagagcgagctgaagaggaaggtgaagccagaggcctggctgagctgtggccccagccctggccctggccgcctgcagctggtgtgccacgtgtctggcttctaccccaagcctgtgtgggtgatgtggatgagaggagagcaggagcagaggggcacccagagaggagatgtgctgcccaatgctgatgagacctggtacctgcgggccaccctggatgtggccgccggggaggccgccggcctgagctgccgggtgaagcacagcagcctgggcggccatgacctgatcatccactggggcggctacagcatcttcctgatcctgatctgcctgactgtgattgtgaccctggtgatcctggtggtggtggacagccggctgaagaagcagagcagcaacaagaacatcctgagcccccacacccccagccctgtgttcctgatgggcgccaacacccaggacaccaagaacagccgccaccagttctgcctggcccaggtgtcctggatcaagaacagagtgctgaagaagtggaagacccggctgaaccagctgtggtag

SEQ ID NO: 146681 - DNA, 600 bp, Artificial Sequence
  Description of Artificial Sequence: Synthetic coding sequence
atgctgctgctcttcctgctgtttgagggcctgtgctgccctggagagaacacagctgtgaagccagaggcctggctgagctgtggccccagccctggccctggccgcctgcagctggtgtgccacgtgtctggcttctaccccaagcctgtgtgggtgatgtggatgagaggagagcaggagcagaggggcacccagagaggagatgtgctgcccaatgctgatgagacctggtacctgcgggccaccctggatgtggccgccggggaggccgccggcctgagctgccgggtgaagcacagcagcctgggcggccatgacctgatcatccactggggcggctacagcatcttcctgatcctgatctgcctgactgtgattgtgaccctggtgatcctggtggtggtggacagccggctgaagaagcagagcagcaacaagaacatcctgagcccccacacccccagccctgtgttcctgatgggcgccaacacccaggacaccaagaacagccgccaccagttctgcctggcccaggtgtcctggatcaagaacagagtgctgaagaagtggaagacccggctgaaccagctgtggtag

SEQ ID NO: 146682 - DNA, 1047 bp, Artificial Sequence
  Description of Artificial Sequence: Synthetic coding sequence
atgctgtgcccctggaggacagccaacctgggcctgctgctgatcctgaccatcttcctggtggccgaggccgagggcgccgcccagcccaacaacagcctgatgctgcagaccagcaaagaaaatcatgccctggccagcagcagcctgtgcatggatgagaagcagatcacccagaactacagcaaggtgctggccgaggtgaacacctcctggcctgtgaagatggccaccaatgctgtgctgtgctgcccccccatcgccctgaggaacctgatcatcatcacctgggagatcatcctgcggggccagcccagctgcaccaaggcctacaagaaggagaccaatgagaccaaggagaccaactgcacagatgagcgcatcacctgggtgtccaggccagaccagaacagcgacctgcagatcagaacagtggccatcacccatgatggctactaccgctgcatcatggtgaccccagatggcaacttccaccggggctaccacctgcaggtgctggtgaccccagaggtgaccctcttccagaacagaaacagaacagctgtgtgcaaggctgtggccggcaagccagctgcccacatctcctggatccctgagggggactgtgccaccaagcaggagtactggagcaatggcaccgtgacagtgaagagcacctgccactgggaggtgcacaacgtgtccacagtgacctgccacgtgagccacctgactggaaacaagagcctgtacatcgagctgctgcctgtgcctggggccaagaagagcgccaagctgtacatcccctacatcatcctgaccatcatcatcctgaccatcgtgggcttcatctggctgctgaaggtgaatggctgcaggaagtacaagctgaacaagacagagagcacccctgtggtggaggaggatgagatgcagccctatgccagctacacagagaagaacaaccccctgtatgacaccaccaacaaggtgaaggccagcgaggccctgcagagcgaggtggacacagacctgcacaccctgtag

SEQ ID NO: 146683 - DNA, 567 bp, Artificial Sequence
  Description of Artificial Sequence: Synthetic coding sequence
atgctgtgcccctggaggacagccaacctgggcctgctgctgatcctgaccatcttcctggtggccgaggccgagggcgccgcccagcccaacaacagcctgatgctgcagaccagcaaagaaaatcatgccctggccagcagcagcctgtgcatggatgagaagcagatcacccagaactacagcaaggtgctggccgaggtgaacacctcctggcctgtgaagatggccaccaatgctgtgctgtgctgcccccccatcgccctgaggaacctgatcatcatcacctgggagatcatcctgcggggccagcccagctgcaccaaggcctacaagaaggagaccaatgagaccaaggagaccaactgcacagatgagcgcatcacctgggtgtccaggccagaccagaacagcgacctgcagatcagaacagtggccatcacccatgatggctactaccgctgcatcatggtgaccccagatggcaacttccaccggggctaccacctgcaggtgctgggcaaggagcaccacatcctgcgctacttcaccagcccagacctgtag

SEQ ID NO: 146684 - DNA, 978 bp, Artificial Sequence
  Description of Artificial Sequence: Synthetic coding sequence
atgctgtgcccctggaggacagccaacctgggcctgctgctgatcctgaccatcttcctggtggccgccagcagcagcctgtgcatggatgagaagcagatcacccagaactacagcaaggtgctggccgaggtgaacacctcctggcctgtgaagatggccaccaatgctgtgctgtgctgcccccccatcgccctgaggaacctgatcatcatcacctgggagatcatcctgcggggccagcccagctgcaccaaggcctacaagaaggagaccaatgagaccaaggagaccaactgcacagatgagcgcatcacctgggtgtccaggccagaccagaacagcgacctgcagatcagaacagtggccatcacccatgatggctactaccgctgcatcatggtgaccccagatggcaacttccaccggggctaccacctgcaggtgctggtgaccccagaggtgaccctcttccagaacagaaacagaacagctgtgtgcaaggctgtggccggcaagccagctgcccacatctcctggatccctgagggggactgtgccaccaagcaggagtactggagcaatggaacagtgacagtgaagagcacctgccactgggaggtgcacaacgtgtccacagtgacctgccacgtgagccacctgaccggcaacaagagcctgtacatcgagctgctgcctgtgcctggggccaagaagagcgccaagctgtacatcccctacatcatcctgaccatcatcatcctgaccatcgtgggcttcatctggctgctgaaggtgaatggctgcaggaagtacaagctgaacaagacagagagcacccctgtggtggaggaggatgagatgcagccctatgccagctacacagagaagaacaaccccctgtatgacaccaccaacaaggtgaaggccagcgaggccctgcagagcgaggtggacacagacctgcacaccctgtag

SEQ ID NO: 146685 - DNA, 498 bp, Artificial Sequence
  Description of Artificial Sequence: Synthetic coding sequence
atgctgtgcccctggaggacagccaacctgggcctgctgctgatcctgaccatcttcctggtggccgccagcagcagcctgtgcatggatgagaagcagatcacccagaactacagcaaggtgctggccgaggtgaacacctcctggcctgtgaagatggccaccaatgctgtgctgtgctgcccccccatcgccctgaggaacctgatcatcatcacctgggagatcatcctgcggggccagcccagctgcaccaaggcctacaagaaggagaccaatgagaccaaggagaccaactgcacagatgagcgcatcacctgggtgtccaggccagaccagaacagcgacctgcagatcagaacagtggccatcacccatgatggctactaccgctgcatcatggtgaccccagatggcaacttccaccggggctaccacctgcaggtgctgggcaaggagcaccacatcctgcgctacttcaccagcccagacctgtag

SEQ ID NO: 146686 - DNA, 987 bp, Artificial Sequence
  Description of Artificial Sequence: Synthetic coding sequence
atgacagtggagaaggaggccccagatgcccacttcaccgtggacaagcagaacatcagcctgtggccccgggagcccccacccaagagcggccccagcctggtgcctgggaagacccccaccgtgcgggccgccctgatctgcctgaccctggtgctggtggcctctgtgctgctgcaggccgtgctgtacccccgcttcatgggcaccatcagtgatgtgaagaccaacgtgcagctgctgaagggccgggtggacaacatcagcaccctggacagcgagatcaagaagaacagtgatggcatggaggccgccggcgtgcagatccagatggtgaatgaaagcctgggctacgtgcgcagccagttcctgaagctgaagacctctgtggagaaggccaatgcccagatccagatcctgaccaggtcctgggaggaggtgtccaccctgaatgcccagatccctgagctgaagagtgacctggagaaggccagcgccctgaacaccaagatccgggccctgcagggcagcctggagaacatgagcaagctgctgaagaggcagaatgacatcctgcaggtggtgtcccagggctggaagtacttcaagggcaacttctactacttcagcctcatccccaagacctggtacagcgctgagcagttctgtgtgtccaggaacagccacctgacctctgtgaccagcgagagcgagcaggagttcctgtacaagacagctgggggcctcatctactggattggcctgaccaaggccggcatggagggggactggagctgggtggatgacacccccttcaacaaggtgcagagcgtgcgcttctggatccctggagagcccaacaatgccggcaacaatgagcactgcggcaacatcaaggcccccagcctgcaggcctggaatgatgccccctgtgacaagaccttcctgttcatctgcaagaggccctacgtgcccagcgagccctag

SEQ ID NO: 146687 - DNA, 4497 bp, Artificial Sequence
  Description of Artificial Sequence: Synthetic coding sequence
atggatggagccagcgctgagcaggacggcctgcaggaggacaggagccacagcggccccagcagcctgcctgaggcccccctgaagcccccaggccccctggtgcccccagaccagcaggacaaggtgcagtgtgccgaggtgaacagagccagcacagaaggagagagcccagatggccctggccagggcggcctgtgccagaatggccccaccccacccttcccagacccccccagcagcctggaccccaccaccagccctgtgggcccagatgccagccctggggtggccggcttccatgacaacctgaggaagagccagggcaccagcgctgagggctctgtgaggaaggaggccctgcagagcctgcggctgagcctgcccatgcaggagacccagctgtgcagcacagacagccccctgcccctggagaaggaggagcaggtgcggctgcaggccaggaagtggctggaggagcagctgaagcagtacagagtgaagaggcagcaggagaggagcagccagcctgccaccaagaccaggctcttcagcaccctggaccctgagctgatgctgaaccctgagaacctgccccgggccagcaccctggccatgaccaaggagtacagcttcctgcggacctctgtgccccggggccccaaggtgggcagcctgggcctgcctgcccacccccgggagaagaagaccagcaagagcagcaagatccgcagcctggccgactacagaacagaggacagcaatgccggcaacagcggcggcaatgtgcctgccccagacagcaccaagggcagcctgaagcagaacagaagcagcgctgcctctgtggtgtctgagatcagcctgagcccagacacagatgaccggctggagaacaccagcctggccggggacagcgtgtctgaggtggatggaaatgacagcgacagcagcagctacagcagcgccagcacccggggcacctacggcatcctgagcaagacagtgggcacccaggacaccccctacatggtgaatggccaggagatcccagctgacaccctgggccagttccccagcatcaaggatgtgctgcaggccgctgctgctgagcaccaggaccagggccaggaggtgaatggagaggtgcgcagccggcgggacagcatctgcagctctgtgtccctggagagcagcgctgctgagacccaggaggagatgctgcaggtgctgaaggagaagatgaggctggagggccagctggaggccctgagcctggaggccagccaggccctgaaggagaaggccgagctgcaggcccagctggccgccctgagcaccaagctgcaggcccaggtggagtgcagccacagcagccagcagaggcaggacagcctgagcagcgaggtggacaccctgaagcagagctgctgggacctggagcgggccatgacagacctgcagaacatgctggaggccaagaatgccagcctggccagcagcaacaatgacctgcaggtggccgaggagcagtaccagaggctgatggccaaggtggaggacatgcagaggtccatgctgagcaaggacaacacagtgcatgacctgcggcagcagatgacagccctgcagagccagctgcagcaggtgcagctggagaggaccaccctgaccagcaagctgaaggccagccaggccgagatcagcagcctgcagagcgtgcggcagtggtaccagcagcagctggccctggcccaggaggcccgggtgcggctgcagggcgagatggcccacatccaggtgggccagatgacccaggccggcctgctggagcacctgaagctggagaatgtgtccctgagccagcagctgacagagacccagcaccgctccatgaaggagaagggcagaattgctgcccagctgcagggcattgaagctgacatgctggaccaggaggccgccttcatgcagatccaggaggccaagaccatggtggaggaggacctgcagaggcggctggaggagtttgaaggagagcgggagcggctgcagaggatggctgacagcgctgccagcctggagcagcagctggagcaggtgaagctgaccctgctgcagagggaccagcagctggaggccctgcagcaggagcacctggacctgatgaagcagctgaccctgacccaggaggccctgcagagccgggagcagagcctggatgccctgcagacccactatgatgagctgcaggcccggctgggggagctgcagggcgaggccgccagccgggaggacaccatctgcctgctgcagaatgagaagatcatcctggaggccgccctgcaggccgccaagagcggcaaggaggagctggacagaggagcccggcggctggaggagggcacagaggagaccagcgagaccctggagaagctgcgggaggagctggccatcaagagcggccaggtggagcacctgcagcaggagacagctgccctgaagaagcagatgcagaagatcaaggagcagttcctgcagcagaaggtgatggtggaggcctacagaagagatgccaccagcaaggaccagctgatcagcgagctgaaggccaccaggaagaggctggacagcgagctgaaggagctgcggcaggagctgatgcaggtgcatggagagaagaggacagctgaggccgagctgagccggctgcaccgggaggtggcccaggtgcggcagcacatggctgacctggagggccacctgcagagcgcccagaaggagagagatgagatggagacccacctgcagagcctgcagtttgacaaggagcagatggtggccgtgacagaggccaatgaggccctgaagaagcagatcgaggagctgcagcaggaggccaggaaggccatcacagagcagaagcagaagatgaggcggctgggcagtgacctgaccagcgcccagaaggagatgaagaccaagcacaaggcctatgaaaatgctgtgggcatcctgagccggcggctgcaggaggccctggccgccaaggaggccgcagatgctgagctgggccagctgcgggcccagggcggcagcagtgacagcagcctggccctgcacgagcgcatccaggccctggaggccgagctgcaggccgtgagccacagcaagaccctgctggagaaggagctgcaggaggtgattgccctgaccagccaggagctggaggagagccgggagaaggtgctggagctggaggatgagctgcaggagagccggggcttcaggaagaagatcaagaggctggaggagagcaacaagaagctggccctggagctggagcacgagaagggcaagctgaccggcctgggccagagcaatgctgccctgcgggagcacaacagcatcctggagacagccctggccaagcgggaggccgacctggtgcagctgaacctgcaggtgcaggccgtgctgcagaggaaggaggaggaggaccggcagatgaagcacctggtgcaggccctgcaggccagcctggagaaggagaaggagaaggtgaacagcctgaaggagcaggtggccgccgccaaggtggaggccggccacaacagaagacacttcaaggccgccagcctggagctgtctgaggtgaagaaggagctgcaggccaaggagcacctggtgcagaagctgcaggccgaggctgatgacctgcagatccgggagggcaagcacagccaggagatcgcccagttccaggccgagctggccgaggcccgggcccagctgcagctgctgcagaagcagctggatgagcagctgagcaagcagcctgtgggcaaccaggagatggagaacctgaagtgggaggtggaccagaaggagcgggagatccagagcctgaagcagcagctggacctgacagagcagcagggcaggaaggagctggagggcctgcagcagctgctgcagaatgtgaagtctgagctggagatggcccaggaggacctgtccatgacccagaaggacaagttcatgctgcaggccaaggtgtctgagctgaagaacaacatgaagaccctgctgcagcagaaccagcagctgaagctggacctgcggcggggggccgccaagaccaggaaggagcccaagggggaggccagcagcagcaacccagccacccccatcaagatcccagactgccctgtgcctgccagcctgctggaggagctgctgcggcccccacctgctgtgtccaaggagcccctgaagaacctgaacagctgcctgcagcagctgaagcaggagatggacagcctgcagaggcagatggaggagcacgccctgactgtgcatgagagcctgagctcctggacccccctggagcccgccacagccagccctgtgcccccaggcggccatgctggccccaggggggacccccagaggcacagccagagccgggccagcaaggagggccctggagagtag

SEQ ID NO: 146688 - DNA, 807 bp, Artificial Sequence
  Description of Artificial Sequence: Synthetic coding sequence
atgtctgacagcaaggagccccggctgcagcagctgggcctgctggtgtccaaggtgcccagcagcatcagccaggagcagagccggcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagcagcaggagatctaccaggagctgacccagctgaaggctgctgtggagcggctgtgccacccctgcccctgggagtggaccttcttccagggcaactgctacttcatgagcaacagccagaggaactggcatgacagcatcacagcctgcaaggaggtgggcgcccagctggtggtgatcaagtctgctgaggagcagaacttcctgcagctgcagagcagccgcagcaaccgcttcacctggatgggcctgagtgacctgaaccaggagggcacctggcagtgggtggatggcagccccctgctgcccagcttcaagcagtactggaacagaggagagcccaacaacgtgggggaggaggactgtgccgagttctctggaaatggctggaatgatgacaagtgcaacctggccaagttctggatctgcaagaagtctgctgccagctgcagcagagatgaggagcagttcctgagccctgccccagccacccccaaccccccaccagcctag

SEQ ID NO: 146689 - DNA, 1143 bp, Artificial Sequence
  Description of Artificial Sequence: Synthetic coding sequence
atgtctgacagcaaggagccccggctgcagcagctgggcctgctggaggaggagcagctgcggggcctgggcttccggcagacccggggctacaagagcctggccgtgtccaaggtgcccagcagcatcagccaggagcagagccggcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagctgcaggagatctaccaggagctgacctggctgaaggctgctgtgggggagctgcctgagaagagcaagatgcaggagatctaccaggagctgacccggctgaaggctgctgtgggggagctgcctgagaagagcaagcagcaggagatctaccaggagctgacccggctgaaggctgctgtgggggagctgcctgagaagagcaagcagcaggagatctaccaggagctgacccggctgaaggctgctgtgggggagctgcctgagaagagcaagcagcaggagatctaccaggagctgacccagctgaaggctgctgtggagcggctgtgccacccctgcccctgggagtggaccttcttccagggcaactgctacttcatgagcaacagccagaggaactggcatgacagcatcacagcctgcaaggaggtgggcgcccagctggtggtgatcaagtctgctgaggagcagaacttcctgcagctgcagagcagccgcagcaaccgcttcacctggatgggcctgagtgacctgaaccaggagggcacctggcagtgggtggatggcagccccctgctgcccagcttcaagcagtactggaacagaggagagcccaacaacgtgggggaggaggactgtgccgagttctctggaaatggctggaatgatgacaagtgcaacctggccaagttctggatctgcaagaagtctgctgccagctgcagcagagatgaggagcagttcctgagccctgccccagccacccccaaccccccaccagcctag

SEQ ID NO: 146690 - DNA, 1215 bp, Artificial Sequence
  Description of Artificial Sequence: Synthetic coding sequence
atgtctgacagcaaggagccccggctgcagcagctgggcctgctggaggaggagcagctgcggggcctgggcttccggcagacccggggctacaagagcctggccggctgcctgggccacggccccctggtgctgcagctgctgtccttcaccctgctggccggcctgctggtgcaggtgtccaaggtgcccagcagcatcagccaggagcagagccggcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagctgcaggagatctaccaggagctgacctggctgaaggctgctgtgggggagctgcctgagaagagcaagatgcaggagatctaccaggagctgacccggctgaaggctgctgtgggggagctgcctgagaagagcaagcagcaggagatctaccaggagctgacccggctgaaggctgctgtgggggagctgcctgagaagagcaagcagcaggagatctaccaggagctgacccggctgaaggctgctgtgggggagctgcctgagaagagcaagcagcaggagatctaccaggagctgacccagctgaaggctgctgtggagcggctgtgccacccctgcccctgggagtggaccttcttccagggcaactgctacttcatgagcaacagccagaggaactggcatgacagcatcacagcctgcaaggaggtgggcgcccagctggtggtgatcaagtctgctgaggagcagaacttcctgcagctgcagagcagccgcagcaaccgcttcacctggatgggcctgagtgacctgaaccaggagggcacctggcagtgggtggatggcagccccctgctgcccagcttcaagcagtactggaacagaggagagcccaacaacgtgggggaggaggactgtgccgagttctctggaaatggctggaatgatgacaagtgcaacctggccaagttctggatctgcaagaagtctgctgccagctgcagcagagatgaggagcagttcctgagccctgccccagccacccccaaccccccaccagcctag

SEQ ID NO: 146691 - DNA, 1197 bp, Artificial Sequence
  Description of Artificial Sequence: Synthetic coding sequence
atgtctgacagcaaggagccccggctgcagcagctgggcctgctggaggaggagcagctgcggggcctgggcttccggcagacccggggctacaagagcctggccggctgcctgggccacggccccctggtgctgcagctgctgtccttcaccctgctggccggcctgctggtgcaggtgtccaaggtgcccagcagcatcagccaggagcagagccggcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagctgcaggagatctaccaggagctgacctggctgaaggctgctgtgggggagctgcctgagaagagcaagatgcaggagatctaccaggagctgacccggctgaaggctgctgtgggggagctgcctgagaagagcaagcagcaggagatctaccaggagctgacccggctgaaggctgctgtgggggagctgcctgagaagagcaagcagcaggagatctaccaggagctgacccggctgaaggctgctgtgggggagctgcctgagaagagcaagcagcaggagatctaccaggagctgacccagctgaaggctgctgtggagcggctgtgccacccctgcccctgggagtggaccttcttccagggcaactgctacttcatgagcaacagccagaggaactggcatgacagcatcacagcctgcaaggaggtgggcgcccagctggtggtgatcaagtctgctgaggagcagagcagccgcagcaaccgcttcacctggatgggcctgagtgacctgaaccaggagggcacctggcagtgggtggatggcagccccctgctgcccagcttcaagcagtactggaacagaggagagcccaacaacgtgggggaggaggactgtgccgagttctctggaaatggctggaatgatgacaagtgcaacctggccaagttctggatctgcaagaagtctgctgccagctgcagcagagatgaggagcagttcctgagccctgccccagccacccccaaccccccaccagcctag

SEQ ID NO: 146692 - DNA, 507 bp, Artificial Sequence
  Description of Artificial Sequence: Synthetic coding sequence
atgtctgacagcaaggagccccggctgcagcagctgggcctgctggaggaggagcagctgcggggcctgggcttccggcagacccggggctacaagagcctggccggctgcctgggccacggccccctggtgctgcagctgctgtccttcaccctgctggccggcctgctggtgcaggtgtccaaggtgcccagcagcatcagccaggagcagagccgcagcaaccgcttcacctggatgggcctgagtgacctgaaccaggagggcacctggcagtgggtggatggcagccccctgctgcccagcttcaagcagtactggaacagaggagagcccaacaacgtgggggaggaggactgtgccgagttctctggaaatggctggaatgatgacaagtgcaacctggccaagttctggatctgcaagaagtctgctgccagctgcagcagagatgaggagcagttcctgagccctgccccagccacccccaaccccccaccagcctag

SEQ ID NO: 146693 - DNA, 939 bp, Artificial Sequence
  Description of Artificial Sequence: Synthetic coding sequence
atgtctgacagcaaggagccccggctgcagcagctgggcctgctggaggaggagcagctgcggggcctgggcttccggcagacccggggctacaagagcctggccggctgcctgggccacggccccctggtgctgcagctgctgtccttcaccctgctggccggcctgctggtgcaggtgtccaaggtgcccagcagcatcagccaggagcagagccggcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagctgcaggagatctaccaggagctgacctggctgaaggctgctgtggagcggctgtgccacccctgcccctgggagtggaccttcttccagggcaactgctacttcatgagcaacagccagaggaactggcatgacagcatcacagcctgcaaggaggtgggcgcccagctggtggtgatcaagtctgctgaggagcagaacttcctgcagctgcagagcagccgcagcaaccgcttcacctggatgggcctgagtgacctgaaccaggagggcacctggcagtgggtggatggcagccccctgctgcccagcttcaagcagtactggaacagaggagagcccaacaacgtgggggaggaggactgtgccgagttctctggaaatggctggaatgatgacaagtgcaacctggccaagttctggatctgcaagaagtctgctgccagctgcagcagagatgaggagcagttcctgagccctgccccagccacccccaaccccccaccagcctag

SEQ ID NO: 146694 - DNA, 105 bp, Artificial Sequence
  Description of Artificial Sequence: Synthetic coding sequence
atgtctgacagcaaggagccccggctgcagcagctgggcctgctggaggaggagcagctgcggggcctgggcttccggcagaccaggaggaaccagaagtgctag

SEQ ID NO: 146695 - DNA, 855 bp, Artificial Sequence
  Description of Artificial Sequence: Synthetic coding sequence
atgtctgacagcaaggagccccggctgcagcagctgggcctgctgggctgcctgggccacggccccctggtgctgcagctgctgtccttcaccctgctggccggcctgctggtgcaggtgctgggccctgtgtccaaggtgcccagcagcatcagccaggagcagagccggcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagctgcaggagatctaccaggagctgacctggctgaaggctgctgtgggggagctgcctgagaagagcaagatgcaggagatctaccaggagctgacccggctgaaggctgctgtgggggagctgcctgagaagagcaagcagcaggagatctaccaggagctgacccggctgaaggctgctgtgggggagctgcctgagaagagcaagcagcaggagatctaccaggagctgacccggctgaaggctgctgtgggggagctgcctgagaagagcaagcagcaggagatctaccaggagctgacccagctgaaggctgctgtggagcggctgtgccacccctgcccctgggagtggaccttcttccagggcaactgctacttcatgagcaacagccagaggaactggcatgacagcatcacagcctgcaaggaggtgggcgcccagctggtggtgatcaagtctgctgaggagcagtag

SEQ ID NO: 146696 - DNA, 939 bp, Artificial Sequence; identical to SEQ ID NO: 146693
  Description of Artificial Sequence: Synthetic coding sequence

SEQ ID NO: 146697 - DNA, 1011 bp, Artificial Sequence
  Description of Artificial Sequence: Synthetic coding sequence
atggactaccccaccctgctgctggccctgctgcacgtgtaccgggccctgtgtgaggaggtgctgtggcacacctctgtgccctttgctgagaacatgagcctggagtgtgtgtaccccagcatgggcatcctgacccaggtggagtggttcaagattggcacccagcaggacagcatcgccatcttcagccccacccacggcatggtgatcaggaagccctatgcagagcgggtgtacttcctgaacagcaccatggccagcaacaacatgaccctcttcttcagaaatgcctctgaagatgatgtgggctactacagctgcagcctgtacacctacccccagggcacctggcagaaggtgatccaggtggtgcagagcgacagctttgaggccgctgtgcccagcaacagccacatcgtgtctgagcccgggaagaatgtgaccctgacctgccagccccagatgacctggcctgtgcaggccgtgcgctgggagaagatccagccccggcagattgacctgctgacctactgcaacctggtgcatggaagaaacttcaccagcaagttcccccggcagatcgtgagcaactgcagccacggccgctggagcgtgattgtcatcccagatgtgacagtgtctgattctggcctgtaccgctgctacctgcaggccagcgctggggagaatgagacctttgtgatgaggctgactgtggccgagggcaagacagacaaccagtacaccctgtttgtggccggcggcaccgtgctgctgctgctgtttgtgatcagcatcaccaccatcatcgtcatcttcctgaacagaagaagaagaagagaaagaagagacctcttcacagagagctgggacacccagaaggcccccaacaactaccgcagccccatcagcaccagccagcccaccaaccagagcatggatgacacccgggaggacatctacgtgaactaccccaccttcagccggcggcccaagaccagggtgtag

SEQ ID NO: 146698 - DNA, 822 bp, Artificial Sequence
  Description of Artificial Sequence: Synthetic coding sequence
atgctgggccaggtggtgaccctcatcctgctgctgctgctgaaggtgtaccagggcaagggctgccagggcagcgctgaccacgtggtgtccatctctggagtgcccctgcagctgcagcccaacagcatccagaccaaggtggacagcatcgcctggaagaagctgctgcccagccagaatggcttccaccacatcctgaagtgggagaatggcagcctgcccagcaacaccagcaatgaccgcttctccttcatcgtgaagaacctgagcctgctgatcaaggccgcccagcagcaggacagcggcctgtactgcctggaggtgaccagcatcagcggcaaggtgcagacagccaccttccaggtgtttgtgtttgagttccgcttctggcccttcctggtgatcatcgtcatcctgagcgccctcttcctgggcaccctggcctgcttctgtgtgtggaggaggaagaggaaggagaagcagagcgagaccagccccaaggagttcctgaccatctatgaagatgtgaaggacctgaagaccaggaggaaccacgagcaggagcagaccttccctgggggcggcagcaccatctacagcatgatccagagccagagcagcgcccccaccagccaggagcccgcctacaccctgtacagcctcatccagcccagcaggaagagcggcagcaggaagaggaaccacagccccagcttcaacagcaccatctatgaagtcatcggcaagagccagcccaaggcccagaacccagcccggctgagcaggaaggagctggagaactttgatgtgtacagctag

SEQ ID NO: 146699 - DNA, 990 bp, Artificial Sequence
  Description of Artificial Sequence: Synthetic coding sequence
atgctgggccaggtggtgaccctcatcctgctgctgctgctgaaggtgtaccagggcaagggctgccagggcagcgctgaccacgtggtgtccatctctggagtgcccctgcagctgcagcccaacagcatccagaccaaggtggacagcatcgcctggaagaagctgctgcccagccagaatggcttccaccacatcctgaagtgggagaatggcagcctgcccagcaacaccagcaatgaccgcttctccttcatcgtgaagaacctgagcctgctgatcaaggccgcccagcagcaggacagcggcctgtactgcctggaggtgaccagcatcagcggcaaggtgcagacagccaccttccaggtgtttgtgtttgacaaggtggagaagccccggctgcagggccagggcaagatcctggaccggggccgctgccaggtggccctgagctgcctggtgtccagagatggaaatgtgtcctatgcctggtaccggggcagcaagctgatccagacagctggcaacctgacctacctggatgaggaggtggacatcaatggcacccacacctacacctgcaatgtgagcaaccctgtgtcctgggagagccacaccctgaacctgacccaggactgccagaatgcccaccaggagttccgcttctggcccttcctggtgatcatcgtcatcctgagcgccctcttcctgggcaccctggcctgcttctgtgtgtggaggaggaagaggaaggagaagcagagcgagaccagccccaaggagttcctgaccatctatgaagatgtgaaggacctgaagaccaggaggaaccacgagcaggagcagaccttccctgggggcggcagcaccatctacagcatgatccagagccagagcagcgcccccaccagccaggagcccgcctacaccctgtacagcctcatccagcccagcaggaagggggaccgcttctacagcttcagcggctag

SEQ ID NO: 146700 - DNA, 1113 bp, Artificial Sequence
  Description of Artificial Sequence: Synthetic coding sequence
atgctgggccaggtggtgaccctcatcctgctgctgctgctgaaggtgtaccagggcaagggctgccagggcagcgctgaccacgtggtgtccatctctggagtgcccctgcagctgcagcccaacagcatccagaccaaggtggacagcatcgcctggaagaagctgctgcccagccagaatggcttccaccacatcctgaagtgggagaatggcagcctgcccagcaacaccagcaatgaccgcttctccttcatcgtgaagaacctgagcctgctgatcaaggccgcccagcagcaggacagcggcctgtactgcctggaggtgaccagcatcagcggcaaggtgcagacagccaccttccaggtgtttgtgtttgagagcctgctgcctgacaaggtggagaagccccggctgcagggccagggcaagatcctggaccggggccgctgccaggtggccctgagctgcctggtgtccagagatggaaatgtgtcctatgcctggtaccggggcagcaagctgatccagacagctggcaacctgacctacctggatgaggaggtggacatcaatggcacccacacctacacctgcaatgtgagcaaccctgtgtcctgggagagccacaccctgaacctgacccaggactgccagaatgcccaccaggagttccgcttctggcccttcctggtgatcatcgtcatcctgagcgccctcttcctgggcaccctggcctgcttctgtgtgtggaggaggaagaggaaggagaagcagagcgagaccagccccaaggagttcctgaccatctatgaagatgtgaaggacctgaagaccaggagaaatcatgagcaggagcagaccttccctgggggcggcagcaccatctacagcatgatccagagccagagcagcgcccccaccagccaggagcccgcctacaccctgtacagcctcatccagcccagcaggaagagcggcagcaggaagaggaaccacagccccagcttcaacagcaccatctatgaggtgattggcaagagccagcccaaggcccagaacccagcccggctgagcaggaaggagctggagaactttgatgtgtacagctag

SEQ ID NO: 146701 - DNA, 1098 bp, Artificial Sequence
  Description of Artificial Sequence: Synthetic coding sequence
atgctgggccaggtggtgaccctcatcctgctgctgctgctgaaggtgtaccagggcaagggctgccagggcagcgctgaccacgtggtgtccatctctggagtgcccctgcagctgcagcccaacagcatccagaccaaggtggacagcatcgcctggaagaagctgctgcccagccagaatggcttccaccacatcctgaagtgggagaatggcagcctgcccagcaacaccagcaatgaccgcttctccttcatcgtgaagaacctgagcctgctgatcaaggccgcccagcagcaggacagcggcctgtactgcctggaggtgaccagcatcagcggcaaggtgcagacagccaccttccaggtgtttgtgtttgacaaggtggagaagccccggctgcagggccagggcaagatcctggaccggggccgctgccaggtggccctgagctgcctggtgtccagagatggaaatgtgtcctatgcctggtaccggggcagcaagctgatccagacagctggcaacctgacctacctggatgaggaggtggacatcaatggcacccacacctacacctgcaatgtgagcaaccctgtgtcctgggagagccacaccctgaacctgacccaggactgccagaatgcccaccaggagttccgcttctggcccttcctggtgatcatcgtcatcctgagcgccctcttcctgggcaccctggcctgcttctgtgtgtggaggaggaagaggaaggagaagcagagcgagaccagccccaaggagttcctgaccatctatgaagatgtgaaggacctgaagaccaggaggaaccacgagcaggagcagaccttccctgggggcggcagcaccatctacagcatgatccagagccagagcagcgcccccaccagccaggagcccgcctacaccctgtacagcctcatccagcccagcaggaagagcggcagcaggaagaggaaccacagccccagcttcaacagcaccatctatgaagtcatcggcaagagccagcccaaggcccagaacccagcccggctgagcaggaaggagctggagaactttgatgtgtacagctag

SEQ ID NO: 146702 - DNA, 495 bp, Artificial Sequence
  Description of Artificial Sequence: Synthetic coding sequence
atgaagtggaaggccctcttcaccgctgccatcctgcaggcccagctgcccatcacagaggcccagagctttggcctgctggaccccaagctgtgctacctgctggatggcatcctcttcatctacggcgtcatcctgacagccctcttcctgcgggtgaagttcagccgctctgcagatgccccagcctaccagcagggccagaaccagctgtacaatgagctgaacctgggcagaagagaggagtatgatgtgctggacaagagaagaggccgggaccctgagatgggcggcaagccccagaggaggaagaacccccaggagggcctgtacaatgagctgcagaaggacaagatggccgaggcctacagcgagatcggcatgaagggggagaggagaagaggcaagggccatgatggcctgtaccagggcctgagcacagccaccaaggacacctatgatgccctgcacatgcaggccctgccccccaggtag

SEQ ID NO: 146703 - DNA, 492 bp, Artificial Sequence
  Description of Artificial Sequence: Synthetic coding sequence
atgaagtggaaggccctcttcaccgctgccatcctgcaggcccagctgcccatcacagaggcccagagctttggcctgctggaccccaagctgtgctacctgctggatggcatcctcttcatctacggcgtcatcctgacagccctcttcctgcgggtgaagttcagccgctctgcagatgccccagcctaccagcagggccagaaccagctgtacaatgagctgaacctgggcagaagagaggagtatgatgtgctggacaagagaagaggccgggaccctgagatgggcggcaagcccaggaggaagaacccccaggagggcctgtacaatgagctgcagaaggacaagatggccgaggcctacagcgagatcggcatgaagggggagcggcggcggggcaaaggacatgatggcctgtaccagggcctgagcacagccaccaaggacacctatgatgccctgcacatgcaggccctgcccccaagatag

SEQ ID NO: 146704 - DNA, 2274 bp, Artificial Sequence
  Description of Artificial Sequence: Synthetic coding sequence
atgctgctgcggctgctgctggcctgggccgccgccggccccaccctgggccaggacccctgggccgctgagcccagggctgcctgtggccccagcagctgctacgccctcttccccaggaggaggaccttcctggaggcctggagggcctgccgggagctgggcggggacctggccacccccaggaccccagaggaggcccagagggtggacagcctggtgggcgccggccctgccagccggctgctgtggattggcctgcagaggcaggcccggcagtgccagctgcagaggcccctgcggggcttcacctggaccactggagaccaggacacagccttcaccaactgggcccagcctgccagcggcggcccctgcccagcccagagatgtgtggccctggaggccagcggggagcaccgctggctggagggcagctgcaccctggccgtggatggctacctgtgccagtttggatttgagggcgcctgcccagccctgcaggatgaagctggccaggccggccctgctgtgtacaccacccccttccacctggtgtccacagaatttgagtggctgccctttggatctgtggccgctgtgcagtgccaggccggccgcggggccagcctgctgtgtgtgaagcagcctgagggcggcgtgggctggagccgggccggccccctgtgcctgggcaccggctgcagcccagacaatggaggctgtgaacatgaatgtgtggaggaggtggatggccacgtgtcctgccgctgcacagagggcttccggctggccgcagatggccgcagctgtgaggacccctgtgcccaggccccctgtgagcagcagtgtgagcccggcggcccccagggctacagctgccactgccgcctgggcttccggccagcagaagatgacccccaccgctgtgtggacacagatgagtgccagattgctggggtgtgccagcagatgtgtgtgaactacgtgggcggctttgagtgctactgcagcgagggccacgagctggaggctgatggcatcagctgcagccctgctggggccatgggcgcccaggccagccaggacctgggagatgagctgctggatgatggagaagatgaggaggatgaagatgaggcctggaaggccttcaacggcggctggacagagatgcctggcatcctgtggatggagcccacccagcccccagactttgccctggcctaccggcccagcttccctgaggaccgggagccccagatcccctacccagagcccacctggcccccacccctgagcgccccccgggtgccctaccacagctctgtgctgtctgtgaccaggcctgtggtggtgtctgccacccaccccaccctgcccagcgcccaccagccccctgtgatcccagccacccacccagccctgagccgggaccaccagatccctgtgattgctgccaactacccagacctgcccagcgcctaccagcccggcatcctgtctgtgagccacagcgcccagcccccagcccaccagccccccatgatcagcaccaagtacccagagctgtttcctgcccaccagagccccatgtttcctgacaccagggtggccggcacccagaccaccacccacctgcccggcatcccccccaaccacgcccccctggtgaccaccctgggcgcccagctgcccccccaggccccagatgccctggtgctgcggacccaggccacccagctgcccatcatccccacagcccagcccagcctgaccaccaccagccgcagccctgtgtccccagcccaccagatctctgtgcctgctgccacccagcctgctgccctgcccaccctgctgcccagccagagccccaccaaccagaccagccccatcagccccacccacccccacagcaaggccccccagatcccccgggaggatggccccagccccaagctggccctgtggctgcccagccctgcccccacagctgcccccacagccctgggggaggccggcctggccgagcacagccagagagatgaccgctggctgctggtggccctgctggtgcccacctgtgtgttcctggtggtgctgctggccctgggcatcgtgtactgcacccgctgtggcccccacgcccccaacaagaggatcacagactgctaccgctgggtgattcatgctggcagcaagagccccacagagcccatgccaccccggggcagcctgactggagtgcagacctgcaggacctctgtgtag

SEQ ID NO: 146705 - DNA, 951 bp, Artificial Sequence
  Description of Artificial Sequence: Synthetic coding sequence
atgctgcggcggcggggcagccctggcatgggcgtgcacgtgggcgccgccctgggcgccctgtggttctgcctgaccggggccctggaggtgcaggtgcctgaagatcctgtggtggccctggtgggcacagatgccaccctgtgctgcagcttcagccctgagcccggcttcagcctggcccagctgaacctgatctggcagctgacagacaccaagcagctggtgcacagctttgctgagggccaggaccagggcagcgcctatgccaacagaacagccctcttcccagacctgctggcccagggcaatgccagcctgcggctgcagagggtgcgggtggctgatgagggcagcttcacctgctttgtgtccatccgggactttggatctgctgctgtgtccctgcaggtggccgccccctacagcaagcccagcatgaccctggagcccaacaaggacctgcggcctggggacacagtgaccatcacctgcagcagctaccggggctacccagaggccgaggtgttctggcaggacggccagggcgtgcccctgactggaaatgtgaccaccagccagatggccaatgagcagggcctgtttgatgtgcacagcgtgctgcgggtggtgctgggcgccaacggcacctacagctgcctggtgagaaatcctgtgctgcagcaggatgcccacggctctgtgaccatcaccggccagcccatgaccttccccccagaggccctgtgggtgacagtgggcctgtctgtgtgcctgattgccctgctggtggccctggcctttgtgtgctggaggaagatcaagcagagctgtgaggaggagaatgctggagctgaggaccaggatggagagggggagggcagcaagacagccctgcagcccctgaagcacagcgacagcaaagaagatgatggccaggagatcgcctag

SEQ ID NO: 146706 - DNA, 1605 bp, Artificial Sequence
  Description of Artificial Sequence: Synthetic coding sequence
atgctgcggcggcggggcagccctggcatgggcgtgcacgtgggcgccgccctgggcgccctgtggttctgcctgaccggggccctggaggtgcaggtgcctgaagatcctgtggtggccctggtgggcacagatgccaccctgtgctgcagcttcagccctgagcccggcttcagcctggcccagctgaacctgatctggcagctgacagacaccaagcagctggtgcacagctttgctgagggccaggaccagggcagcgcctatgccaacagaacagccctcttcccagacctgctggcccagggcaatgccagcctgcggctgcagagggtgcgggtggctgatgagggcagcttcacctgctttgtgtccatccgggactttggatctgctgctgtgtccctgcaggtggccgccccctacagcaagcccagcatgaccctggagcccaacaaggacctgcggcctggggacacagtgaccatcacctgcagcagctaccagggctacccagaggccgaggtgttctggcaggacggccagggcgtgcccctgactggaaatgtgaccaccagccagatggccaatgagcagggcctgtttgatgtgcacagcatcctgcgggtggtgctgggcgccaacggcacctacagctgcctggtgagaaatcctgtgctgcagcaggatgcccacagctctgtgaccatcaccccccagaggagccccaccggggctgtggaggtgcaggtgcctgaagatcctgtggtggccctggtgggcacagatgccaccctgcgctgcagcttcagccctgagcccggcttcagcctggcccagctgaacctgatctggcagctgacagacaccaagcagctggtgcacagcttcacagagggccgggaccagggcagcgcctatgccaacagaacagccctcttcccagacctgctggcccagggcaatgccagcctgcggctgcagagggtgcgggtggctgatgagggcagcttcacctgctttgtgtccatccgggactttggatctgctgctgtgtccctgcaggtggccgccccctacagcaagcccagcatgaccctggagcccaacaaggacctgcggcctggggacacagtgaccatcacctgcagcagctaccggggctacccagaggccgaggtgttctggcaggacggccagggcgtgcccctgactggaaatgtgaccaccagccagatggccaatgagcagggcctgtttgatgtgcacagcgtgctgcgggtggtgctgggcgccaacggcacctacagctgcctggtgagaaatcctgtgctgcagcaggatgcccacggctctgtgaccatcaccggccagcccatgaccttccccccagaggccctgtgggtgacagtgggcctgtctgtgtgcctgattgccctgctggtggccctggcctttgtgtgctggaggaagatcaagcagagctgtgaggaggagaatgctggagctgaggaccaggatggagagggggagggcagcaagacagccctgcagcccctgaagcacagcgacagcaaagaagatgatggccaggagatcgcctag

SEQ ID NO: 146707 - DNA, 1482 bp, Artificial Sequence
  Description of Artificial Sequence: Synthetic coding sequence
atgctgcggcggcggggcagccctggcatgggcgtgcacgtgggcgccgccctgggcgccctgtggttctgcctgaccggggccctggaggtgcaggtgcctgaagatcctgtggtggccctggtgggcacagatgccaccctgtgctgcagcttcagccctgagcccggcttcagcctggcccagctgaacctgatctggcagctgacagacaccaagcagctggtgcacagctttgctgagggccaggaccagggcagcgcctatgccaacagaacagccctcttcccagacctgctggcccagggcaatgccagcctgcggctgcagagggtgcgggtggctgatgagggcagcttcacctgctttgtgtccatccgggactttggatctgctgctgtgtccctgcaggtggccgccccctacagcaagcccagcatgaccctggagcccaacaaggacctgcggcctggggacacagtgaccatcacctgcagcagctaccagggctacccagaggccgaggtgttctggcaggacggccagggcgtgcccctgactggaaatgtgaccaccagccagatggccaatgagcagggcctgtttgatgtgcacagcatcctgcgggtggtgctgggcgccaacggcacctacagctgcctggtgagaaatcctgtgctgcagcaggatgcccacagctctgtgaccatcaccccccagaggagccccaccggggctgtggaggtgcaggtgcctgaagatcctgtggtggccctggtgggcacagatgccaccctgcgctgcagcttcagccctgagcccggcttcagcctggcccagctgaacctgatctggcagctgacagacaccaagcagctggtgcacagcttcacagagggccgggaccagggcagcgcctatgccaacagaacagccctcttcccagacctgctggcccagggcaatgccagcctgcggctgcagagggtgcgggtggctgatgagggcagcttcacctgctttgtgtccatccgggactttggatctgctgctgtgtccctgcaggtggccgccccctacagcaagcccagcatgaccctggagcccaacaaggacctgcggcctggggacacagtgaccatcacctgcagcagctaccggggctacccagaggccgaggtgttctggcaggacggccagggcgtgcccctgactggaaatgtgaccaccagccagatggccaatgagcagggcctgtttgatgtgcacagcgtgctgcgggtggtgctgggcgccaacggcacctacagctgcctggtgagaaatcctgtgctgcagcaggatgcccacggctctgtgaccatcaccggccagcccatgaccttccccccaggccctgccagcagcgctgtgcccctgagccctgcccaccccccccacggctccatgtgctggagccactggttcagccggggcctgtag

SEQ ID NO: 146708 - DNA, 423 bp, Artificial Sequence
  Description of Artificial Sequence: Synthetic coding sequence
atgctgcggcggcggggcagccctggcatgggcgtgcacgtgggcgccgccctgggcgccctgtggttctgcctgaccggggccctggaggtgcaggtgcctgaagatcctgtggtggccctggtgggcacagatgccaccctgtgctgcagcttcagccctgagcccggcttcagcctggcccagctgaacctgatctggcagctgacagacaccaagcagctggtgcacagctttgctgagggccaggaccagggcagcgcctatgccaacagaacagccctcttcccagacctgcaccgggccgcctatgacatccccccccggggccctgtgggggacagaggagctgtgtgcctgagccactgcacagctgggggccctggcttccgggtgctggagaaggaccagacagagctgtag

SEQ ID NO: 146709 - DNA, 411 bp, Artificial Sequence
  Description of Artificial Sequence: Synthetic coding sequence
atgctgcggcggcggggcagccctggcatgggcgtgcacgtgggcgccgccctgggcgccctgtggttctgcctgaccggggccctggaggtgcaggtgcctgaagatcctgtggtggccctggtgggcacagatgccaccctgtgctgcagcttcagccctgagcccggcttcagcctggcccagctgaacctgatctggcagctgacagacaccaagcagctggtgcacagctttgctgagggccaggaccagggcagcgcctatgccaacagaacagccctcttcccagacctgctggcccagggcaatgccagcctgcggctgcagagggtgcgggtggctgatgagggcagcttcacctgctttgtgtccatccgggactttggatctgctgctgtgtccctgtag

SEQ ID NO: 146710 - DNA, 402 bp, Artificial Sequence
  Description of Artificial Sequence: Synthetic coding sequence
atgctgcggcggcggggcagccctggcatgggcgtgcacgtgggcgccgccctgggcgccctgtggttctgcctgaccggggccctggaggtgcaggtgcctgaagatcctgtggtggccctggtgggcacagatgccaccctgtgctgcagcttcagccctgagcccggcttcagcctggcccagctgaacctgatctggcagctgacagacaccaagcagctggtgcacagctttgctgagggccaggaccagggcagcgcctatgccaacagaacagccctcttcccagacctgctggcccagggcaatgccagcctgcggctgcagagggtgcgggtggctgatgagggcagcttcacctgctttgtgtccatccgggactttggatctgctgcctag

SEQ ID NO: 146711 - DNA, 1602 bp, Artificial Sequence
  Description of Artificial Sequence: Synthetic coding sequence
atgctgcggcggcggggcagccctggcatgggcgtgcacgtgggcgccgccctgggcgccctgtggttctgcctgaccggggccctggaggtgcaggtgcctgaagatcctgtggtggccctggtgggcacagatgccaccctgtgctgcagcttcagccctgagcccggcttcagcctggcccagctgaacctgatctggcagctgacagacaccaagcagctggtgcacagctttgctgagggccaggaccagggcagcgcctatgccaacagaacagccctcttcccagacctgctggcccagggcaatgccagcctgcggctgcagagggtgcgggtggctgatgagggcagcttcacctgctttgtgtccatccgggactttggatctgctgctgtgtccctgcaggtggccgccccctacagcaagcccagcatgaccctggagcccaacaaggacctgcggcctggggacacagtgaccatcacctgcagcagctaccagggctacccagaggccgaggtgttctggcaggacggccagggcgtgcccctgactggaaatgtgaccaccagccagatggccaatgagcagggcctgtttgatgtgcacagcatcctgcgggtggtgctgggcgccaacggcacctacagctgcctggtgagaaatcctgtgctgcagcaggatgcccacagctctgtgaccatcaccccccagaggagccccaccggggctgtggaggtgcaggtgcctgaagatcctgtggtggccctggtgggcacagatgccaccctgcgctgcagcttcagccctgagcccggcttcagcctggcccagctgaacctgatctggcagctgacagacaccaagcagctggtgcacagcttcacagagggccgggaccagggcagcgcctatgccaacagaacagccctcttcccagacctgctggcccagggcaatgccagcctgcggctgcagagggtgcgggtggctgatgagggcagcttcacctgctttgtgtccatccgggactttggatctgctgctgtgtccctgcaggtggccgccccctacagcaagcccagcatgaccctggagcccaacaaggacctgcggcctggggacacagtgaccatcacctgcagcagctaccggggctacccagaggccgaggtgttctggcaggacggccagggcgtgcccctgactggaaatgtgaccaccagccagatggccaatgagcagggcctgtttgatgtgcacagcgtgctgcgggtggtgctgggcgccaacggcacctacagctgcctggtgagaaatcctgtgctgcagcaggatgcccacggctctgtgaccatcaccggccagcccatgaccttccccccagaggccctgtgggtgacagtgggcctgtctgtgtgcctgattgccctgctggtggccctggcctttgtgtgctggaggaagatcaagcagagctgtgaggaggagaatgctggagctgaggaccaggatggagagggggagggcagcaagacagccctgcagcccctgaagcacagcgacagcaaggagggcaaggacacctgggcctag

SEQ ID NO: 146712 - DNA, 498 bp, Artificial Sequence
  Description of Artificial Sequence: Synthetic coding sequence
atgctgcggcggcggggcagccctggcatgggcgtgcacgtgggcgccgccctgggcgccctgtggttctgcctgaccggggccctggaggtgcaggtgcctgaagatcctgtggtggccctggtgggcacagatgccaccctgtgctgcagcttcagccctgagcccggcttcagcctggcccagctgaacctgatctggcagctgacagacaccaagcagctggtgcacagctttgctgagggccaggaccagggcagcgcctatgccaacagaacagccctcttcccagacctgctggcccagggcaatgccagcctgcggctgcagagggtgcgggtggctgatgagggcagcttcacctgctttgtgtccatccgggactttggatctgctgctgtgtccctgcaggtggccgccccctacagcaagcccagcatgaccctggagcccaacaaggacctgcggcctggggacacagtgaccatcacctgctag

SEQ ID NO: 146713 - DNA, 156 bp, Artificial Sequence
  Description of Artificial Sequence: Synthetic coding sequence
atgctgcggcggcggggcagccctggcatgggcgtgcacgtgggcgccgccctgggcgccctgtggttctgcctgaccggggccctggaggtgcaggtgcctgaagatcctgtggtggccctggtgggcacagatgccaccctgtgctgcagctag

SEQ ID NO: 146714 - DNA, 663 bp, Artificial Sequence
  Description of Artificial Sequence: Synthetic coding sequence
atgctgcggctgctgctggccctgaacctcttccccagcatccaggtgactggaaacaagatcctggtgaagcagagccccatgctggtggcctatgacaatgctgtgaacctgagctgcaagtacagctacaacctcttcagccgggagttccgggccagcctgcacaagggcctggacagcgctgtggaggtgtgtgtggtgtatggcaactacagccagcagctgcaggtgtacagcaagacaggcttcaactgtgatggcaagctgggcaatgaatctgtgaccttctacctgcagaacctgtatgtgaaccagacagacatctacttctgcaagattgaggtgatgtaccccccaccctacctggacaatgagaagagcaatggcaccatcatccacgtgaagggcaagcacctgtgccccagccccctcttccctggccccagcaagcccttctgggtgctggtggtggtgggcggcgtgctggcctgctacagcctgctggtgacagtggccttcatcatcttctgggtgcgcagcaagaggagccggctgctgcacagcgactacatgaacatgaccccaagaagacctggccccaccaggaagcactaccagccctatgccccaccccgggactttgctgcctaccgctcctag

SEQ ID NO: 146715 - DNA, 306 bp, Artificial Sequence
  Description of Artificial Sequence: Synthetic coding sequence
atgctgcggctgctgctggccctgaacctcttccccagcatccaggtgacaggcaagcacctgtgccccagccccctcttccctggccccagcaagcccttctgggtgctggtggtggtgggcggcgtgctggcctgctacagcctgctggtgacagtggccttcatcatcttctgggtgcgcagcaagaggagccggctgctgcacagcgactacatgaacatgaccccccggcggcccggccccaccaggaagcactaccagccctatgccccaccccgggactttgctgcctaccgctcctag

SEQ ID NO: 146716 - DNA, 411 bp, Artificial Sequence
  Description of Artificial Sequence: Synthetic coding sequence
atgctgcggctgctgctggccctgaacctcttccccagcatccaggtgactggaaacaagatcctggtgaagcagagccccatgctggtggcctatgacaatgctgtgaacctgagctacaatgagaagagcaatggcaccatcatccacgtgaagggcaagcacctgtgccccagccccctcttccctggccccagcaagcccttctgggtgctggtggtggtgggcggcgtgctggcctgctacagcctgctggtgacagtggccttcatcatcttctgggtgcgcagcaagaggagccggctgctgcacagcgactacatgaacatgaccccaagaagacctggccccaccaggaagcactaccagccctatgccccaccccgggactttgctgcctaccgctcctag

SEQ ID NO: 146717 - DNA, 705 bp, Artificial Sequence
  Description of Artificial Sequence: Synthetic coding sequence
atgccctgtggcctgagcgccctgatcatgtgccccaagggcatggtggccgtggtggtggccgtggatgatggagacagccaggccctggccggcaacaagatcctggtgaagcagagccccatgctggtggcctatgacaatgctgtgaacctgagctgcaagtacagctacaacctcttcagccgggagttccgggccagcctgcacaagggcctggacagcgctgtggaggtgtgtgtggtgtatggcaactacagccagcagctgcaggtgtacagcaagacaggcttcaactgtgatggcaagctgggcaatgaatctgtgaccttctacctgcagaacctgtatgtgaaccagacagacatctacttctgcaagattgaggtgatgtaccccccaccctacctggacaatgagaagagcaatggcaccatcatccacgtgaagggcaagcacctgtgccccagccccctcttccctggccccagcaagcccttctgggtgctggtggtggtgggcggcgtgctggcctgctacagcctgctggtgacagtggccttcatcatcttctgggtgcgcagcaagaggagccggctgctgcacagcgactacatgaacatgaccccaagaagacctggccccaccaggaagcactaccagccctatgccccaccccgggactttgctgcctaccgctcctag

SEQ ID NO: 146718 - DNA, 1920 bp, Artificial Sequence
  Description of Artificial Sequence: Synthetic coding sequence
atggtggactacatcgtggagtatgactatgatgctgtgcatgatgatgagctgaccatccgggtgggggagatcatcagaaatgtgaagaagctgcaggaggagggctggctggagggggagctgaatggaagaagaggcatgtttcctgacaactttgtgaaggagatcaagcgggagacagagttcaaggatgacagcctgcccatcaagcgggagagacatggaaatgtggccagcctggtgcagaggatcagcacctacggcctgcctgctgggggcatccagccccacccccagaccaagaacatcaagaagaagaccaagaagaggcagtgcaaggtgctgtttgagtacatcccccagaatgaagatgagctggagctgaaggtgggggacatcatcgacatcaatgaggaggtggaggagggctggtggagcggcaccctgaacaacaagctgggcctcttccccagcaactttgtgaaggagctggaggtgacagatgatggagagacccatgaggcccaggatgacagcgagaccgtgctggccggccccaccagccccatccccagcctgggcaatgtgtctgaaacagccagcggctctgtgacccagcccaagaagatccggggcatcggctttggagacatcttcaaggagggctctgtgaagctgcggaccaggaccagcagcagcgagacagaggagaagaagccagagaagcccctcatcctgcagagcctgggccccaagacccagagcgtggagatcaccaagacagacacagagggcaagatcaaggccaaggagtactgcaggaccctgtttgcctatgagggcaccaatgaagatgagctgaccttcaaggagggggagatcatccacctgatcagcaaggagactggagaggccggctggtggagaggagagctgaatggcaaggagggcgtcttcccagacaactttgctgtgcagatcaatgagctggacaaggacttccccaagcccaagaagcccccacctccagccaaggccccagcccccaagccagagctgattgctgctgagaagaagtacttcagcctgaagccagaggagaaggatgagaagagcaccctggagcagaagcccagcaagccagctgccccccaggtgccccccaagaagcccaccccacccaccaaggccagcaacctgctgcggagcagcggcaccgtgtaccccaagaggcctgagaagcctgtgcccccacctccacccatcgccaagatcaatggagaggtgagcagcatcagcagcaagtttgaaacagagcctgtgtccaagctgaagctggacagcgagcagctgcccctgcggcccaagtctgtggactttgacagcctgactgtgaggaccagcaaggagacagatgtggtgaactttgatgacatcgccagcagcgagaacctgctgcacctgacagccaaccggcccaagatgcctggaagaaggctgcccggccgcttcaacggcggccacagccccacccacagccctgagaagatcctgaagctgcccaaggaggaggacagcgccaacctgaagcccagcgagctgaagaaggacacctgctacagccccaagcccagcgtgtacctgagcacccccagcagcgccagcaaggccaacaccacagccttcctgacccccctggagatcaaggccaaggtggagacagatgatgtgaagaagaacagcctggatgagctgcgggcccagatcatcgagctgctgtgcatcgtggaggccctgaagaaggaccacggcaaggagctggagaagctgaggaaggacctggaggaggagaagaccatgaggagcaacctggagatggagattgagaagctgaagaaggctgtgctgagcagctag

SEQ ID NO: 146719 - DNA, 717 bp, Artificial Sequence
  Description of Artificial Sequence: Synthetic coding sequence
atgtgccgccgctgcaagccagagctgcggcagaacttccagagcgccagcggcatctgcatctgccactggctgcagatccggaggaccaggagccgggagggccgggccatgtggctgcccccagccctgctgctgctgagcctgagcggctgcttcagcatccagggccctgagagcgtgcgggcccctgagcagggcagcctgactgtgcagtgccactacaagcagggctgggagacctacatcaagtggtggtgccggggcgtgcgctgggacacctgcaagatcctgattgagacccggggcagcgagcagggcgagaagagtgacagagtgtccatcaaggacaaccagaaggacaggaccttcaccgtgaccatggagggcctgcggagagatgatgctgatgtgtactggtgtggcattgaaagaagaggccctgacctgggcacccaggtgaaggtgattgtggaccctgagggcgccgccagcaccacagccagcagccccaccaacagcaacatggctgtgttcatcggcagccacaagaggaaccactacatgctgctggtgtttgtgaaggtgcccatcctgctgatcctggtgacagccatcctgtggctgaagggcagccagagggtgcctgaggagcctggagagcagcccatctacatgaacttcagcgagcccctgaccaaggacatggccacctag

SEQ ID NO: 146720 - DNA, 606 bp, Artificial Sequence
  Description of Artificial Sequence: Synthetic coding sequence
atgtggctgcccccagccctgctgctgctgagcctgagcggctgcttcagcatccagggccctgagagcgtgcgggcccctgagcagggcagcctgactgtgcagtgccactacaagcagggctgggagacctacatcaagtggtggtgccggggcgtgcgctgggacacctgcaagatcctgattgagacccggggcagcgagcagggcgagaagagtgacagagtgtccatcaaggacaaccagaaggacaggaccttcaccgtgaccatggagggcctgcggagagatgatgctgatgtgtactggtgtggcatcgagcggcggggccctgacctgggcacccaggtgaaggtgattgtggaccctgagggcgccgccagcaccacagccagcagccccaccaacagcaacatggctgtgttcatcggcagccacaagaggaaccactacatgctgctggtgtttgtgaaggtgcccatcctgctgatcctggtgacagccatcctgtggctgaagggcagccagagggtgcctgaggagcccggggagcagcccatctacatgaacttcagcgagcccctgaccaaggacatggccacctag

SEQ ID NO: 146721 - DNA, 735 bp, Artificial Sequence
  Description of Artificial Sequence: Synthetic coding sequence
atgcccctgctgaccctgtacctgctgctcttctggctgagcggctacagcatcgtgacccagatcaccggccccaccaccgtgaatggcctggagcggggcagcctgactgtgcagtgtgtgtaccgcagcggctgggagacctacctgaagtggtggtgccgcggggccatctggagggactgcaagatcctggtgaagaccagcggcagcgagcaggaggtgaagagggacagagtgtccatcaaggacaaccagaagaacagaaccttcaccgtgaccatggaggacctgatgaagacagatgctgacacctactggtgtggcatcgagaagacaggaaatgacctgggcgtgacagtgcaggtgaccattgatcctgcccctgtgacccaggaggagaccagcagcagccccaccctgaccggccaccacctggacaacagaagtgagggcagccaggccgccaactacagacctgctgcccaccaggcccaggcccctgaggcccagtgccccccagccccccacctgcaccacatcgctgctgcctttggaggccgcctgaccctgggcctggaggatgatgaggtgcctgctgagagcagcagagatgtgcccagggctggaacagctgcccctgggggccggcccctgctgtgcaggccagaccctgctgctggaagaaacctgcctgccaagggctaccacgaggccttcctgtgccctggatag

SEQ ID NO: 146722 - DNA, 873 bp, Artificial Sequence
  Description of Artificial Sequence: Synthetic coding sequence
atgcccctgctgaccctgtacctgctgctcttctggctgagcggctacagcatcgtgacccagatcaccggccccaccaccgtgaatggcctggagcggggcagcctgactgtgcagtgtgtgtaccgcagcggctgggagacctacctgaagtggtggtgccgcggggccatctggagggactgcaagatcctggtgaagaccagcggcagcgagcaggaggtgaagagggacagagtgtccatcaaggacaaccagaagaacagaaccttcaccgtgaccatggaggacctgatgaagacagatgctgacacctactggtgtggcatcgagaagacaggaaatgacctgggcgtgacagtgcaggtgaccattgatcctgcccctgtgacccaggaggagaccagcagcagccccaccctgaccggccaccacctggacaacagacacaagctgctgaagctgtctgtgctgctgcccctcatcttcaccatcctgctgctgctgctggtggccgccagcctgctggcctggaggatgatgaagtaccagcagaaggccgccggcatgagccctgagcaggtgctgcagcccctggagggggacctgtgctacgccgacctgaccctgcagctggccggcaccagcccccagaaggccaccaccaagctgagcagcgcccaggtggaccaggtggaggtggagtatgtgaccatggccagcctgcccaaggaggacatctcctatgccagcctgaccctgggcgctgaggaccaggagcccacctactgcaacatgggccacctgagcagccacctgcccggccggggccctgaggagcccacagagtacagcaccatcagccggccctag

SEQ ID NO: 146723 - DNA, 585 bp, Artificial Sequence
  Description of Artificial Sequence: Synthetic coding sequence
atgtggctgccccagctggacctgatgagggtcatcagcgccaagagccagggctacagcatcgtgacccagatcaccggccccaccaccgtgaatggcctggagcggggcagcctgactgtgcagtgtgtgtacagaagtggctgggagacctacctgaagtggtggtgccgcggggccatctggagggactgcaagatcctggtgaagaccagcggcagcgagcaggaggtgaagagggacagagtgtccatcaaggacaaccagaagaacagaaccttcaccgtgaccatggaggacctgatgaagacagatgctgacacctactggtgtggcatcgagaagacaggaaatgacctgggcgtgacagtgcaggtgaccatcgaccctgcccctgtgacccaggaggagaccagcagcagccccaccctgaccggccaccacctggacaacagcagcagagatgtgcccagggctggaacagctgcccctgggggccggcccctgctgtgcaggccagaccctgctgctggaagaaacctgcctgccaagggctaccacgaggccttcctgtgccctggatag

SEQ ID NO: 146724 - DNA, 720 bp, Artificial Sequence
  Description of Artificial Sequence: Synthetic coding sequence
atgtggctgccccagctggacctgatgagggtcatcagcgccaagagccagggctacagcatcgtgacccagatcaccggccccaccaccgtgaatggcctggagcggggcagcctgactgtgcagtgtgtgtacagaagtggctgggagacctacctgaagtggtggtgccgcggggccatctggagggactgcaagatcctggtgaagaccagcggcagcgagcaggaggtgaagagggacagagtgtccatcaaggacaaccagaagaacagaaccttcaccgtgaccatggaggacctgatgaagacagatgctgacacctactggtgtggcatcgagaagacaggaaatgacctgggcgtgacagtgcaggtgaccatcgaccctgccagcaccccagcccccaccacccccaccagcaccaccttcaccgcccctgtgacccaggaggagaccagcagcagccccaccctgaccggccaccacctggacaacagacacaagctgctgaagctgtctgtgctgctgcccctcatcttcaccatcctgctgctgctgctggtggccgccagcctgctggcctggaggatgatgaagtaccagcagaagggcacagctgcccctgggggccggcccctgctgtgcaggccagaccctgctgctggcaggaacctgcctgccaagggctaccacgaggccttcctgtgccccggctag

SEQ ID NO: 146725 - DNA, 699 bp, Artificial Sequence
  Description of Artificial Sequence: Synthetic coding sequence
atgctgcgggccgccctgcctgccctgctgctgcccctgctgggcctggccgctgctgctgtggccgactgccccagcagcacctggatccagttccaggacagctgctacatcttcctgcaggaggccatcaaggtggagagcattgaagatgtgaggaaccagtgcacagaccatggagctgacatgatcagcatccacaatgaggaggagaatgccttcatcctggacaccctgaagaagcagtggaagggcccagatgacatcctgctgggcatgttttatgacacagatgatgccagcttcaagtggtttgacaacagcaacatgacctttgacaagtggacagaccaggatgatgatgaggacctggtggacacctgtgccttcctgcacatcaagacaggagagtggaagaagggcaactgtgaggtgtcctctgtggagggcaccctgtgcaagacagccatcccctacaagaggaagtacctgagtgacaaccacatcctgatcagcgccctggtgattgccagcaccgtcatcctgactgtgctgggcgccatcatctggttcctgtacaagaagcacagcgacagccgcttcaccaccgtcttcagcacagccccccagagcccctacaatgaagactgtgtgctggtggtgggggaggagaatgagtaccctgtgcagtttgattag

SEQ ID NO: 146726 - DNA, 525 bp, Artificial Sequence
  Description of Artificial Sequence: Synthetic coding sequence
atgctgcgggccgccctgcctgccctgctgctgcccctgctgggcctggccgctgctgctgtggccgactgccccagcagcacctggatccagttccaggacagctgctacatcttcctgcaggaggccatcaaggtggagagcattgaagatgtgaggaaccagtgcacagaccatggagctgacatgatcagcatccacaatgaggaggagaatgccttcatcctggacaccctgaagaagcagtggaagggcccagatgacatcctgctgggcatgttttatgacacagatgtgccctacaagaggaagtacctgagtgacaaccacatcctgatcagcgccctggtgattgccagcaccgtcatcctgactgtgctgggcgccatcatctggttcctgtacaagaagcacagcgacagccgcttcaccaccgtcttcagcacagccccccagagcccctacaatgaagactgtgtgctggtggtgggggaggagaatgagtaccctgtgcagtttgattag

SEQ ID NO: 146727 - DNA, 849 bp, Artificial Sequence
  Description of Artificial Sequence: Synthetic coding sequence
atgtctgggggctggatggcccaggtgggcgcctggaggactggagccctgggcctggccctgctgctgctgctgggcctgggcctgggcctggaggccgccgccagccccctgagcacccccaccagcgcccaggccgccggccccagcagcggcagctgcccccccaccaagttccagtgcaggaccagcggcctgtgtgtgcccctgacctggaggtgtgaccgggacctggactgcagtgatggcagtgatgaggaggagtgcagaattgagccctgcacccagaagggccagtgccccccacctcctggcctgccctgcccctgcacaggagtgtctgactgcagcggcggcacagacaagaagctgaggaactgcagccggctggcctgcctggccggggagctgcgctgcaccctgagtgatgactgcatccccctgacctggaggtgtgatggccacccagactgcccagacagcagtgatgagctgggctgcggcaccaatgagatcctgcctgaaggagatgccaccaccatgggcccccctgtgaccctggagagcgtgaccagcctgagaaatgccaccaccatgggcccccctgtgaccctggagagcgtgcccagcgtgggcaatgccaccagcagcagcgctggggaccagagcggcagccccacagcctatggagtgattgctgctgctgctgtgctgagcgccagcctggtgacagccaccctgctgctgctgtcctggctgcgggcccaggagcggctgcggcccctgggcctgctggtggccatgaaggagagcctgctgctgtctgagcagaagaccagcctgccctag

SEQ ID NO: 146728 - DNA, 606 bp, Artificial Sequence
  Description of Artificial Sequence: Synthetic coding sequence
aatgagatcctgcctgaaggagatgccaccaccatgggcccccctgtgaccctggagagcgtgaccagcctgagaaatgccaccaccatgggcccccctgtgaccctggagagcgtgcccagcgtgggcaatgccatcctgctgtgccggcggcctgtgtggaagcccaactgcctgtggggctactgcagctgctgcggggcccagtgcaagccaggccaccgccaccccccaccatttgtgctggcccccagccctggggcccccccacccaccggggtgactggaggccacgagggcgtgcctgctgctgtgaggacagaggacctggccgccctgcggaccagcacctgccaccaccgccacagcgccctgggcgtggccggccaggaggagagcagtgatgctgatggctacccaggcaccccagccctgcgggacctgagcagcagcggccacgtggagcccaggacccgggccccagctgaggtggccctggagattgagggcccctggaccctgcccatggagatccggggggccaggatgggcaacctgccccagcctgagctgcggggctggccccaggccgccccccggggctag

SEQ ID NO: 146729 - DNA, 723 bp, Artificial Sequence
  Description of Artificial Sequence: Synthetic coding sequence
atgtctgggggctggatggcccaggtgggcgcctggaggactggagccctgggcctggccctgctgctgctgctgggcctgggcctgggcctggaggccgccgccagccccctgagcacccccaccagcgcccaggccgccggcatcgagccctgcacccagaagggccagtgccccccacctcctggcctgccctgcccctgcacaggagtgtctgactgcagcggcggcacagacaagaagctgaggaactgcagccggctggcctgcctggccggggagctgcgctgcaccctgagtgatgactgcatccccctgacctggaggtgtgatggccacccagactgcccagacagcagtgatgagctgggctgcggcaccaatgagatcctgcctgaaggagatgccaccaccatgggcccccctgtgaccctggagagcgtgaccagcctgagaaatgccaccaccatgggcccccctgtgaccctggagagcgtgcccagcgtgggcaatgccaccagcagcagcgctggggaccagagcggcagccccacagcctatggagtgattgctgctgctgctgtgctgagcgccagcctggtgacagccaccctgctgctgctgtcctggctgcgggcccaggagcggctgcggcccctgggcctgctggtggccatgaaggagagcctgctgctgtctgagcagaagaccagcctgccctag

SEQ ID NO: 146730 - DNA, 1095 bp, Artificial Sequence
  Description of Artificial Sequence: Synthetic coding sequence
atgcccctgctgctgctgctgcccctgctgtgggccggggccctggccatggaccccaacttctggctgcaggtgcaggagagcgtgacagtgcaggagggcctgtgtgtgctggtgccctgcaccttcttccaccccatcccctactatgacaagaacagccctgtgcacggctactggttccgggagggcgccatcatcagccgggacagccctgtggccaccaacaagctggaccaggaggtgcaggaggagacccagggccgcttccggctgctgggggaccccagcaggaacaactgcagcctgagcatcgtggatgcccggcggcgggacaatggcagctacttcttcaggatggagcggggcagcaccaagtacagctacaagagcccccagctgtctgtgcacgtgacagacctgacccaccggcccaagatcctgatccctggcaccctggagcccggccacagcaagaacctgacctgcagcgtgtcctgggcctgtgagcagggcaccccacccatcttctcctggctgtctgctgcccccaccagcctgggccccaggaccacccacagctctgtgctgatcatcaccccccggccccaggaccacggcaccaacctgacctgccaggtgaagtttgctggagctggggtgaccacagagaggaccatccagctgaatgtgacctacgtgccccagaaccccaccaccggcatcttccctggagatggcagcggcaagcaggagaccagggctggggtggtgcatggagccatcggcggggccggcgtgacagccctgctggccctgtgcctgtgcctgatcttcttcatcgtgaagacccacaggaggaaggccgccaggacagctgtgggcagaaatgacacccaccccaccactggaagtgccagccccaagcaccagaagaagagcaagctgcacggccccacagagaccagcagctgcagcggggccgcccccaccgtggagatggatgaggagctgcactacgccagcctgaacttccacggcatgaaccccagcaaggacaccagcacagagtacagcgaggtgaggacccagtag

SEQ ID NO: 146731 - DNA, 933 bp, Artificial Sequence
  Description of Artificial Sequence: Synthetic coding sequence
atgcccctgctgctgctgctgcccctgctgtgggccggggccctggccatggaccccaacttctggctgcaggtgcaggagagcgtgacagtgcaggagggcctgtgtgtgctggtgccctgcaccttcttccaccccatcccctactatgacaagaacagccctgtgcacggctactggttccgggagggcgccatcatcagccgggacagccctgtggccaccaacaagctggaccaggaggtgcaggaggagacccagggccgcttccggctgctgggggaccccagcaggaacaactgcagcctgagcatcgtggatgcccggcggcgggacaatggcagctacttcttcaggatggagcggggcagcaccaagtacagctacaagagcccccagctgtctgtgcacgtgacagacctgacccaccggcccaagatcctgatccctggcaccctggagcccggccacagcaagaacctgacctgcagcgtgtcctgggcctgtgagcagggcaccccacccatcttctcctggctgtctgctgcccccaccagcctgggccccaggaccacccacagctctgtgctgatcatcaccccccggccccaggaccacggcaccaacctgacctgccaggtgaagtttgctggagctggggtgaccacagagaggaccatccagctgaatgtgacctacgtgccccagaaccccaccaccggcatcttccctggagatggcagcggcaagcaggagaccagggctggggtggtgcatggagccatcggcggggccggcgtgacagccctgctggccctgtgcctgtgcctgatcttcttcatcgtgaagacccacaggaggaaggccgccaggacagctgtgggcagaaatgacacccaccccaccactggaagtgccagccctgtgaggtag

SEQ ID NO: 146732 - DNA, 714 bp, Artificial Sequence
  Description of Artificial Sequence: Synthetic coding sequence
atgcccctgctgctgctgctgcccctgctgtgggccgacctgacccaccggcccaagatcctgatccctggcaccctggagcccggccacagcaagaacctgacctgcagcgtgtcctgggcctgtgagcagggcaccccacccatcttctcctggctgtctgctgcccccaccagcctgggccccaggaccacccacagctctgtgctgatcatcaccccccggccccaggaccacggcaccaacctgacctgccaggtgaagtttgctggggccggcgtgaccacagagaggaccatccagctgaatgtgacctacgtgccccagaaccccaccaccggcatcttccctggagatggcagcggcaagcaggagacccgggccggcgtggtgcacggggccatcggcggggccggcgtgacagccctgctggccctgtgcctgtgcctgatcttcttcatcgtgaagacccacaggaggaaggccgccaggacagctgtgggcagaaatgacacccaccccaccaccggcagcgccagccccaagcaccagaagaagagcaagctgcacggccccacagagaccagcagctgcagcggggccgcccccaccgtggagatggatgaggagctgcactacgccagcctgaacttccacggcatgaaccccagcaaggacaccagcacagagtacagcgaggtgaggacccagtag

SEQ ID NO: 146733 - DNA, 639 bp, Artificial Sequence
  Description of Artificial Sequence: Synthetic coding sequence
atgcccctgctgctgctgctgcccctgctgtgggccgacctgacccaccggcccaagatcctgatccctggcaccctggagcccggccacagcaagaacctgacctgcagcgtgtcctgggcctgtgagcagggcaccccacccatcttctcctggctgtctgctgcccccaccagcctgggccccaggaccacccacagctctgtgctgatcatcaccccccggccccaggaccacggcaccaacctgacctgccaggtgaagtttgctggggccggcgtgaccacagagaggaccatccagctgaatgtgacctacgtgccccagaaccccaccaccggcatcttccctggagatggcagcggcaagcaggagacccgggccggcgtggtgcacggggccatcggcggggccggcgtgacagccctgctggccctgtgcctgtgcctgatcttcttcatcgtgaagacccacaggaggaaggccgccaggacagctgtgggcagaaatgacacccaccccaccaccggcagcgccagccctgtgtctgatggagcctcctggcaccctgtgtgcccagctgacaccagcagccagtgtggcccccccagctgccccatccagcacttccagaactag

SEQ ID NO: 146734 - DNA, 1419 bp, Artificial Sequence
  Description of Artificial Sequence: Synthetic coding sequence
atgggctgtgacaggaactgtggcctgattgctggagctgtgattggagctgtgctggccgtgtttggaggcatcctgatgcctgtgggggacctgctgatccagaagaccatcaagaagcaggtggtgctggaggagggcaccatcgccttcaagaactgggtgaagacaggaacagaggtgtaccggcagttctggatctttgatgtgcagaacccccaggaggtgatgatgaacagcagcaacatccaggtgaagcagaggggcccctacacctacagagtgcgcttcctggccaaggaaaatgtgacccaggatgctgaggacaacacagtgtccttcctgcagcccaacggggccatctttgagcccagcctgtctgtgggcacagaggccgacaacttcaccgtgctgaacctggccgtggccgccgccagccacatctaccagaaccagtttgtgcagatgatcctgaacagcctcatcaacaagagcaagagctccatgttccaggtgaggaccctgcgggagctgctgtggggctacagagaccccttcctgagcctggtgccctaccctgtgaccaccaccgtgggcctcttctacccctacaacaacacagcagatggagtgtacaaggtgttcaacgggaaggacaacatcagcaaggtggccatcatcgacacctacaagggcaagaggaacctgagctactgggagagccactgtgacatgatcaatggaacagatgctgccagcttccccccatttgtggagaagagccaggtgctgcagttcttcagcagtgacatctgccgcagcatctatgctgtgtttgaaagtgatgtgaacctgaagggcatccctgtgtacagatttgtgctgcccagcaaggcctttgccagccctgtggagaacccagacaactactgcttctgcacagagaagatcatcagcaagaactgcaccagctatggagtgctggacatcagcaagtgcaaggagggccggcctgtgtacatcagcctgccccacttcctgtatgccagcccagatgtgtctgagcccattgatggcctgaaccccaatgaggaggagcacaggacctacctggacatcgagcccatcaccggcttcaccctgcagtttgccaagaggctgcaggtgaacctgctggtgaagcccagcgagaagatccaggtgctgaagaacctgaagaggaactacatcgtgcccatcctgtggctgaatgaaacaggcaccatcggagatgagaaggccaacatgttccgcagccaggtgacaggcaagatcaacctgctgggcctcatcgagatgatcctgctgtctgtgggcgtggtgatgtttgtggccttcatgatctcctactgtgcctgccgcagcaagaccatcaagtag

SEQ ID NO: 146735 - DNA, 1419 bp, Artificial Sequence; identical to SEQ ID NO: 146734
  Description of Artificial Sequence: Synthetic coding sequence

SEQ ID NO: 146736 - DNA, 612 bp, Artificial Sequence
  Description of Artificial Sequence: Synthetic coding sequence
atgggctgtgacaggaactgtggcctgattgctggagctgtgattggagctgtgctggccgtgtttggaggcatcctgatgcctgtgggggacctgctgatccagaagaccatcaagaagcaggtggtgctggaggagggcaccatcgccttcaagaactgggtgaagacaggaacagaggtgtaccggcagttctggatctttgatgtgcagaacccccaggaggtgatgatgaacagcagcaacatccaggtgaagcagaggggcccctacacctacagagtgcgcttcctggccaaggaaaatgtgacccaggatgctgaggacaacacagtgtccttcctgcagcccaacggggccatctttgagcccagcctgtctgtgggcacagaggccgacaacttcaccgtgctgaacctggccgtggccgccgccagccacatctaccagaaccagtttgtgcagatgatcctgaacagcctcatcaacaagagcaagagctccatgttccaggtgaggaccctgcgggagctgctgtggggctacagagaccccttcctgagcctggtgccctaccctgtgaccaccaccgtgggcctcttctacccctag

SEQ ID NO: 146737 - DNA, 1392 bp, Artificial Sequence
  Description of Artificial Sequence: Synthetic coding sequence
atgggctgtgacaggaactgtggcctgattgctggagctgtgattggagctgtgctggccgtgtttggaggcatcctgatgcctgtgggggacctgctgatccagaagaccatcaagaagcaggtggtgctggaggagggcaccatcgccttcaagaactgggtgaagacaggaacagaggtgtaccggcagttctggatctttgatgtgcagaacccccaggaggtgatgatgaacagcagcaacatccaggtgaagcagaggggcccctacacctacagagtgcgcttcctggccaaggaaaatgtgacccaggatgctgaggacaacacagtgtccttcctgcagcccaacggggccatctttgagcccagcctgtctgtgggcacagaggccgacaacttcaccgtgctgaacctggccgtggccgccgccagccacatctaccagaaccagtttgtgcagatgatcctgaacagcctcatcaacaagagcaagagctccatgttccaggtgaggaccctgcgggagctgctgtggggctacagagaccccttcctgagcctggtgccctaccctgtgaccaccaccgtgggcctcttctacccctacaacaacacagcagatggagtgtacaaggtgttcaacgggaaggacaacatcagcaaggtggccatcatcgacacctacaagggcaagaggaacctgagctactgggagagccactgtgacatgatcaatggaacagatgctgccagcttccccccatttgtggagaagagccaggtgctgcagttcttcagcagtgacatctgccgcagcatctatgctgtgtttgaaagtgatgtgaacctgaagggcatccctgtgtacagatttgtgctgcccagcaaggcctttgccagccctgtggagaacccagacaactactgcttctgcacagagaagatcatcagcaagaactgcaccagctatggagtgctggacatcagcaagtgcaaggagggccggcctgtgtacatcagcctgccccacttcctgtatgccagcccagatgtgtctgagcccattgatggcctgaaccccaatgaggaggagcacaggacctacctggacatcgagcccatcaccggcttcaccctgcagtttgccaagaggctgcaggtgaacctgctggtgaagcccagcgagaagatccaggtgctgaagaacctgaagaggaactacatcgtgcccatcctgtggctgaatgaaacaggcaccatcggagatgagaaggccaacatgttccgcagccaggtgacaggcaagatcaacctgctgggcctcatcgagatgatcctgctgtctgtgggcgtggtgatgtttgtggccttcatgatctcctactag

SEQ ID NO: 146738 - DNA, 447 bp, Artificial Sequence
  Description of Artificial Sequence: Synthetic coding sequence
atgggctgtgacaggaactgtggcctgattgctggagctgtgattggagctgtgctggccgtgtttggaggcatcctgatgcctgtgggggacctgctgatccagaagaccatcaagaagcaggtggtgctggaggagggcaccatcgccttcaagaactgggtgaagacaggaacagaggtgtaccggcagttctggatctttgatgtgcagaacccccaggaggtgatgatgaacagcagcaacatccaggtgaagcagaggggcccctacacctacagagtgcgcttcctggccaaggaaaatgtgacccaggatgctgaggacaacacagtgtccttcctgcagcccaacggggccatctttgagcccagcctgtctgtgggcacagaggccgacaacttcaccgtgctgaacctggccgtggccgccgccagccacatctag

SEQ ID NO: 146739 - DNA, 282 bp, Artificial Sequence
  Description of Artificial Sequence: Synthetic coding sequence
atgggctgtgacaggaactgtggcctgattgctggagctgtgattggagctgtgctggccgtgtttggaggcatcctgatgcctgtgggggacctgctgatccagaagaccatcaagaagcaggtggtgctggaggagggcaccatcgccttcaagaactgggtgaagacaggaacagaggtgtaccggcagttctggatctttgatgtgcagaacccccaggaggtgatgatgaacagcagcaacatccaggtgaagcagaggggcccctacacctactag

SEQ ID NO: 146740 - DNA, 1419 bp, Artificial Sequence; identical to SEQ ID NO: 146734
  Description of Artificial Sequence: Synthetic coding sequence

SEQ ID NO: 146741 - DNA, 1302 bp, Artificial Sequence
  Description of Artificial Sequence: Synthetic coding sequence
atgggctgtgacaggaactgtggcctgattgctggagctgtgattggagctgtgctggccgtgtttggaggcatcctgatgcctgtgggggacctgctgatccagaagaccatcaagaagcaggtggtgctggaggagggcaccatcgccttcaagaactgggtgaagacaggaacagaggtgtaccggcagttctggatctttgatgtgcagaacccccaggaggtgatgatgaacagcagcaacatccaggtgaagcagaggggcccctacacctacagagtgcgcttcctggccaaggaaaatgtgacccaggatgctgaggacaacacagtgtccttcctgcagcccaacggggccatctttgagcccagcctgtctgtgggcacagaggccgacaacttcaccgtgctgaacctggccgtggccgccgccagccacatctaccagaaccagtttgtgcagatgatcctgaacagcctcatcaacaagagcaagagctccatgttccaggtgaggaccctgcgggagctgctgtggggctacagagaccccttcctgagcctggtgccctaccctgtgaccaccaccgtgggcctcttctacccctacaacaacacagcagatggagtgtacaaggtgttcaacgggaaggacaacatcagcaaggtggccatcatcgacacctacaagggcaagaggagcatctatgctgtgtttgaaagtgatgtgaacctgaagggcatccctgtgtacagatttgtgctgcccagcaaggcctttgccagccctgtggagaacccagacaactactgcttctgcacagagaagatcatcagcaagaactgcaccagctatggagtgctggacatcagcaagtgcaaggagggccggcctgtgtacatcagcctgccccacttcctgtatgccagcccagatgtgtctgagcccattgatggcctgaaccccaatgaggaggagcacaggacctacctggacatcgagcccatcaccggcttcaccctgcagtttgccaagaggctgcaggtgaacctgctggtgaagcccagcgagaagatccaggtgctgaagaacctgaagaggaactacatcgtgcccatcctgtggctgaatgagaccggcaccatcggagatgagaaggccaacatgttccgcagccaggtgacaggcaagatcaacctgctgggcctgattgagatgatcctgctgtctgtgggcgtggtgatgtttgtggccttcatgatctcctactgtgcctgccgcagcaagaccatcaagtag

SEQ ID NO: 146742 - DNA, 1419 bp, Artificial Sequence; identical to SEQ ID NO: 146734
  Description of Artificial Sequence: Synthetic coding sequence

SEQ ID NO: 146743 - DNA, 282 bp, Artificial Sequence; identical to SEQ ID NO: 146739
  Description of Artificial Sequence: Synthetic coding sequence

SEQ ID NO: 146744 - DNA, 432 bp, Artificial Sequence
  Description of Artificial Sequence: Synthetic coding sequence
atgggctgtgacaggaactgtggcctgattgctggagctgtgattggagctgtgctggccgtgtttggaggcatcctgatgcctgtgggggacctgctgatccagaagaccatcaagaagcaggtggtgctggaggagggcaccatcgccttcaagaactgggtgaagacaggaacagaggtgtaccggcagttctggatctttgatgtgcagaacccccaggaggtgatgatgaacagcagcaacatccaggtgaagcagaggggcccctacacctacagagtgcgcttcctggccaaggaaaatgtgacccaggatgctgaggacaacacagtgtccttcctgcagcccaacggggccatctttgagcccagcctgtctgtgggcacagaggccgacaacttcaccgtgctgaacctggccgtggcctag

SEQ ID NO: 146745 - DNA, 1419 bp, Artificial Sequence; identical to SEQ ID NO: 146734
  Description of Artificial Sequence: Synthetic coding sequence

SEQ ID NO: 146746 - DNA, 198 bp, Artificial Sequence
  Description of Artificial Sequence: Synthetic coding sequence
atgggctgtgacaggaactgtggcctgattgctggagctgtgattggagctgtgctggccgtgtttggaggcatcctgatgcctgtgggggacctgctgatccagaagaccatcaagaagcaggtggtgctggaggagggcaccatcgccttcaagaactgggtgaagacaggaacagaggtgtaccggcagttctag

SEQ ID NO: 146747 - DNA, 1191 bp, Artificial Sequence
  Description of Artificial Sequence: Synthetic coding sequence
atgatgaacagcagcaacatccaggtgaagcagaggggcccctacacctacagagtgcgcttcctggccaaggaaaatgtgacccaggatgctgaggacaacacagtgtccttcctgcagcccaacggggccatctttgagcccagcctgtctgtgggcacagaggccgacaacttcaccgtgctgaacctggccgtggccgccgccagccacatctaccagaaccagtttgtgcagatgatcctgaacagcctcatcaacaagagcaagagctccatgttccaggtgaggaccctgcgggagctgctgtggggctacagagaccccttcctgagcctggtgccctaccctgtgaccaccaccgtgggcctcttctacccctacaacaacacagcagatggagtgtacaaggtgttcaacgggaaggacaacatcagcaaggtggccatcatcgacacctacaagggcaagaggaacctgagctactgggagagccactgtgacatgatcaatggaacagatgctgccagcttccccccatttgtggagaagagccaggtgctgcagttcttcagcagtgacatctgccgcagcatctatgctgtgtttgaaagtgatgtgaacctgaagggcatccctgtgtacagatttgtgctgcccagcaaggcctttgccagccctgtggagaacccagacaactactgcttctgcacagagaagatcatcagcaagaactgcaccagctatggagtgctggacatcagcaagtgcaaggagggccggcctgtgtacatcagcctgccccacttcctgtatgccagcccagatgtgtctgagcccattgatggcctgaaccccaatgaggaggagcacaggacctacctggacatcgagcccatcaccggcttcaccctgcagtttgccaagaggctgcaggtgaacctgctggtgaagcccagcgagaagatccaggtgctgaagaacctgaagaggaactacatcgtgcccatcctgtggctgaatgaaacaggcaccatcggagatgagaaggccaacatgttccgcagccaggtgacaggcaagatcaacctgctgggcctcatcgagatgatcctgctgtctgtgggcgtggtgatgtttgtggccttcatgatctcctactgtgcctgccgcagcaagaccatcaagtag

SEQ ID NO: 146748 - DNA, 1239 bp, Artificial Sequence
  Description of Artificial Sequence: Synthetic coding sequence
atgggctgtgacaggaactgtggcctgattgctggagctgtgattggagctgtgctggccgtgtttggaggcatcctgatgcctgtgggggacctgctgatccagaagaccatcaagaagcaggtggtgctggaggagggcaccatcgccttcaagaactgggtgaagacaggaacagaggtgtaccggcagttctggatctttgatgtgcagaacccccaggaggtgatgatgaacagcagcaacatccaggtgaagcagaggggcccctacacctacagagtgcgcttcctggccaaggaaaatgtgacccaggatgctgaggacaacacagtgtccttcctgcagcccaacggggccatctttgagcccagcctgtctgtgggcacagaggccgacaacttcaccgtgctgaacctggccgtggcctacaacaacacagcagatggagtgtacaaggtgttcaacgggaaggacaacatcagcaaggtggccatcatcgacacctacaagggcaagaggaacctgagctactgggagagccactgtgacatgatcaatggaacagatgctgccagcttccccccatttgtggagaagagccaggtgctgcagttcttcagcagtgacatctgccgcagcatctatgctgtgtttgaaagtgatgtgaacctgaagggcatccctgtgtacagatttgtgctgcccagcaaggcctttgccagccctgtggagaacccagacaactactgcttctgcacagagaagatcatcagcaagaactgcaccagctatggagtgctggacatcagcaagtgcaaggagggccggcctgtgtacatcagcctgccccacttcctgtatgccagcccagatgtgtctgagcccattgatggcctgaaccccaatgaggaggagcacaggacctacctggacatcgagcccatcaccggcttcaccctgcagtttgccaagaggctgcaggtgaacctgctggtgaagcccagcgagaagatccaggtgctgaagaacctgaagaggaactacatcgtgcccatcctgtggctgaatgaaacaggcaccatcggagatgagaaggccaacatgttccgcagccaggtgacaggcaagatcaacctgctgggcctcatcgagatgatcctgctgtctgtgggcgtggtgatgtttgtggccttcatgatctcctactgtgcctgccgcagcaagaccatcaagtag

SEQ ID NO: 146749 - DNA, 867 bp, Artificial Sequence
  Description of Artificial Sequence: Synthetic coding sequence
atgggctgtgacaggaactgtggcctgattgctggagctgtgattggagctgtgctggccgtgtttggaggcatcctgatgcctgtgggggacctgctgatccagaagaccatcaagaagcaggtggtgctggaggagggcaccatcgccttcaagaactgggtgaagacaggaacagaggtgtaccggcagttctggatctttgatgtgcagaacccccaggaggtgatgatgaacagcagcaacatccaggtgaagcagaggggcccctacacctacagagtgcgcttcctggccaaggaaaatgtgacccaggatgctgaggacaacacagtgtccttcctgcagcccaacggggccatctttgagcccagcctgtctgtgggcacagaggccgacaacttcaccgtgctgaacctggccgtggccgccgccagccacatctaccagaaccagtttgtgcagatgatcctgaacagcctcatcaacaagagcaagagctccatgttccaggtgaggaccctgcgggagctgctgtggggctacagagaccccttcctgagcctggtgccctaccctgtgaccaccaccgtgggcctcttctacccctacaacaacacagcagatggagtgtacaaggtgttcaacgggaaggacaacatcagcaaggtggccatcatcgacacctacaagggcaagaggaacctgagctactgggagagccactgtgacatgatcaatggaacagatgctgccagcttccccccatttgtggagaagagccaggtgctgcagttcttcagcagtgacatctgccgggagacctgtgtgcacttcaccagcagcttctctgtgtgcaagagctag

SEQ ID NO: 146750 - DNA, 846 bp, Artificial Sequence
  Description of Artificial Sequence: Synthetic coding sequence
atgtctgcccaggagagctgcctgagcctcatcaagtacttcctgtttgtgttcaacctcttcttctttgtgctgggcagcctcatcttctgcttcggcatctggatcctgattgacaagaccagctttgtgtcctttgtgggcctggcctttgtgcccctgcagatctggagcaaggtgctggccatcagcggcatcttcaccatgggcatcgccctgctgggctgtgtgggcgccctgaaggagctgcgctgcctgctgggcctgtacttcggcatgctgctgctgctgtttgccacccagatcaccctgggcatcctgatcagcacccagagggcccagctggagaggagcctgagagatgtggtggagaagaccatccagaagtatggcaccaaccctgaggagacagctgctgaggagagctgggactatgtgcagttccagctgcgctgctgcggctggcactacccccaggactggttccaggtgctgatcctgcggggaaatggcagcgaggcccaccgggtgccctgcagctgctacaacctgagcgccaccaatgacagcaccatcctggacaaggtgatcctgccccagctgagccggctgggccacctggcccggagccgccacagcgctgacatctgtgctgtgcctgctgagagccacatctaccgggagggctgtgcccagggcctgcagaagtggctgcacaacaacctgatcagcatcgtgggcatctgcctgggcgtgggcctgctggagctgggcttcatgaccctgagcatcttcctgtgcaggaacctggaccacgtgtacaaccggctggcccgctacagatag

SEQ ID NO: 146751 - DNA, 471 bp, Artificial Sequence
  Description of Artificial Sequence: Synthetic coding sequence
atgtctgcccaggagagctgcctgagcctcatcaagtacttcctgtttgtgttcaacctcttcttctttgtgctgggcagcctcatcttctgcttcggcatctggatcctgattgacaagaccagctttgtgtcctttgtgggcctggcctttgtgcccctgcagatctggagcaaggtgctggccatcagcggcatcttcaccatgggcatcgccctgctgggctgtgtgggcgccctgaaggagctgcgctgcctgctgggcctgtacttcggcatgctgctgctgctgtttgccacccagatcaccctgggcatcctgatcagcacccagagggcccagaaggacacccccacctggaccaagggggacagacacaagcagctgcagcgggagacccacggcaagaagcgggagcaggagaaggagattgatgccctgaaggaggagacagagacctatgagccctag

SEQ ID NO: 146752 - DNA, 642 bp, Artificial Sequence
  Description of Artificial Sequence: Synthetic coding sequence
atgggcatcgccctgctgggctgtgtgggcgccctgaaggagctgcgctgcctgctgggcctgtacttcggcatgctgctgctgctgtttgccacccagatcaccctgggcatcctgatcagcacccagagggcccagctggagaggagcctgagagatgtggtggagaagaccatccagaagtatggcaccaaccctgaggagacagctgctgaggagagctgggactatgtgcagttccagctgcgctgctgcggctggcactacccccaggactggttccaggtgctgatcctgcggggaaatggcagcgaggcccaccgggtgccctgcagctgctacaacctgagcgccaccaatgacagcaccatcctggacaaggtgatcctgccccagctgagccggctgggccacctggcccggagccgccacagcgctgacatctgtgctgtgcctgctgagagccacatctaccgggagggctgtgcccagggcctgcagaagtggctgcacaacaacctgatcagcatcgtgggcatctgcctgggcgtgggcctgctggagctgggcttcatgaccctgagcatcttcctgtgcaggaacctggaccacgtgtacaaccggctggcccgctacagatag

SEQ ID NO: 146753 - DNA, 813 bp, Artificial Sequence
  Description of Artificial Sequence: Synthetic coding sequence
atgtctgcccaggagagctgcctgagcctcatcaagtacttcctgtttgtgttcaacctcttcttctttgtgctgggcagcctcatcttctgcttcggcatctggatcctgattgacaagaccagctttgtgtcctttgtgggcctggcctttgtgcccctgcagatctggagcaaggtgctggccatcagcggcatcttcaccatgggcatcgccctgctgggctgtgtgggcgccctgaaggagctgcgctgcctgctgggcctgtacttcggcatgctgctgctgctgtttgccacccagatcaccctgggcatcctgatcagcacccagagggcccagctggagaggagcctgagagatgtggtggagaagaccatccagaagtatggcaccaaccctgaggagacagctgctgaggagagctgggactatgtgcagttccagctgcgctgctgcggctggcactacccccaggactggttccaggtgctgatcctgcggggaaatggcagcgaggcccaccgggtgccctgcagctgctacaacctgagcgccaccaatgacagcaccatcctggacaaggtgatcctgccccagctgagccggctgggccacctggcccggagccgccacagcgctgacatctgtgctgtgcctgctgagagccacatctaccgggagggctgtgcccagggcctgcagaagtggctgcacaacaacctgatcagcatcgtgggcatctgcctgggcgtgggcctgctggaggtgatctggccccggccccaccccaggtctgccctgaacccctag

SEQ ID NO: 146754 - DNA, 1095 bp, Artificial Sequence; identical to SEQ ID NO: 143274
  Description of Artificial Sequence: Synthetic coding sequence

SEQ ID NO: 146755 - DNA, 483 bp, Artificial Sequence
  Description of Artificial Sequence: Synthetic coding sequence
atggccaactgtgagttcagccctgtgtctggggacaagccctgctgccgcctgagccggcgggcccagctgtgcctgggcgtgtccatcctggtgctgatcctggtggtggtgctggccgtggtggtgccccgctggaggcagcagtggagcggccctggcaccaccaagcgcttccctgagaccgtgctggcccgctgtgtgaagtacacagagatccaccctgagatgagacatgtggactgccagagcgtgtgggatgccttcaagggggccttcatcagcaagcacccctgcaacatcacagaggaggactaccagcccctgatgaagctgggcacccagacagtgccctgcaacaagaatgagaccatcaacctggcccagacaggagagaggacagctgccaccaccctcttccagtacagcggcaagcgcttccctgctggcctgcagaagctgcctgtgatgtggagcatgtag

SEQ ID NO: 146756 - DNA, 624 bp, Artificial Sequence
  Description of Artificial Sequence: Synthetic coding sequence
atgcagagcggcacccactggagggtgctgggcctgtgcctgctgtctgtgggcgtgtggggccaggatggaaatgaggagatgggcggcatcacccagaccccctacaaggtgtccatcagcggcaccaccgtcatcctgacctgcccccagtacccaggcagcgagatcctgtggcagcacaatgacaagaacattggaggagatgaagatgacaagaacattggaagtgatgaggaccacctgagcctgaaggagttcagcgagctggagcagagcggctactacgtgtgctacccccggggcagcaagccagaagatgccaacttctacctgtacctgcgggcccgggtgtgtgagaactgcatggagatggatgtgatgtctgtggccaccatcgtgattgtggacatctgcatcactggaggcctgctgctgctggtgtactactggagcaagaacaggaaggccaaggccaagcctgtgaccaggggggccggggccggcggccggcagaggggccagaacaaggagcggcccccacctgtgcccaacccagactatgagcccatcaggaagggccagagggacctgtacagcggcctgaaccagaggcgcatctag

SEQ ID NO: 146757 - DNA, 606 bp, Artificial Sequence
  Description of Artificial Sequence: Synthetic coding sequence
atgcagagcggcacccactggagggtgctgggcctgtgcctgctgtctgtgggcgtgtggggccaggatggaaatgaggagatggcctacaaggtgtccatcagcggcaccaccgtcatcctgacctgcccccagtacccaggcagcgagatcctgtggcagcacaatgacaagaacattggaggagatgaagatgacaagaacattggaagtgatgaggaccacctgagcctgaaggagttcagcgagctggagcagagcggctactacgtgtgctacccccggggcagcaagccagaagatgccaacttctacctgtacctgcgggcccgggtgtgtgagaactgcatggagatggatgtgatgtctgtggccaccatcgtgattgtggacatctgcatcactggaggcctgctgctgctggtgtactactggagcaagaacaggaaggccaaggccaagcctgtgaccaggggggccggggccggcggccggcagaggggccagaacaaggagcggcccccacctgtgcccaacccagactatgagcccatcaggaagggccagagggacctgtacagcggcctgaaccagaggcgcatctag

SEQ ID NO: 146758 - DNA, 237 bp, Artificial Sequence
  Description of Artificial Sequence: Synthetic coding sequence
atgattggcttcctgacagaggacaagaagaagtggaacctgggcagcaatgccaaggacccccggggcatgtaccagtgcaagggcagccagaacaagagcaagcccctgcaggtgtactaccgcaccagtgacaagcagaccctgctgcccaatgaccagctgtaccagcccctgaaggacagagaagatgaccagtacagccacctgcagggcaaccagctgcggagaaattag

SEQ ID NO: 146759 - DNA, 549 bp, Artificial Sequence
  Description of Artificial Sequence: Synthetic coding sequence
atggagcagggcaagggcctggccgtgctgatcctggccatcatcctgctgcagggcaccctggcccagagcatcaagggcaaccacctggtgaaggtgtatgactaccaggaggatggctctgtgctgctgacctgtgatgctgaggccaagaacatcacctggttcaaggatggcaagatgattggcttcctgacagaggacaagaagaagtggaacctgggcagcaatgccaaggacccccggggcatgtaccagtgcaagggcagccagaacaagagcaagcccctgcaggtgtactacaggatgtgccagaactgcatcgagctgaatgctgccaccatcagcggcttcctgtttgctgagatcgtgtccatctttgtgctggccgtgggcgtgtacttcatcgccggccaggatggagtgcggcagagccgggccagtgacaagcagaccctgctgcccaatgaccagctgtaccagcccctgaaggacagagaagatgaccagtacagccacctgcagggcaaccagctgcggagaaattag

SEQ ID NO: 146760 - DNA, 1200 bp, Artificial Sequence
  Description of Artificial Sequence: Synthetic coding sequence
atggagcccccaggccggcgggagtgccccttccccagctggaggtttcctggcctgctgctggccgccatggtgctgctgctgtacagcttcagtgatgcctgtgaggagccccccacctttgaggccatggagctgattggcaagcccaagccctactatgagatcggggagcgggtggactacaagtgcaagaagggctacttctacatcccccccctggccacccacaccatctgtgacaggaaccacacctggctgcctgtgtctgatgatgcctgctaccgggagacctgcccctacatccgggaccccctgaatggccaggccgtgcctgccaacggcacctatgaatttggctaccagatgcacttcatctgcaatgaaggctactacctgattggagaggagatcctgtactgtgagctgaagggctctgtggccatctggagcggcaagccacccatctgtgagaaggtgctgtgcaccccaccacccaagatcaagaatggcaagcacaccttcagcgaggtggaggtgtttgagtacctggatgctgtgacctacagctgtgaccctgcccctggccctgaccccttcagcctgattggagagagcaccatctactgtggggacaacagcgtgtggagcagagctgcccctgagtgcaaggtggtgaagtgccgcttccctgtggtggagaatggcaagcagatcagcggctttgggaagaagttctactacaaggccaccgtgatgtttgaatgtgacaagggcttctacctggatggcagtgacaccatcgtgtgtgacagcaacagcacctgggacccccctgtgcccaagtgcctgaaggtgctgccccccagcagcaccaagcccccagccctgagccacagcgtgtccaccagcagcaccaccaagagccctgccagcagcgccagcggcccccggcccacctacaagccccctgtgagcaactacccaggctaccccaagccagaggagggcatcctggacagcctggatgtgtgggtgattgctgtgattgtcatcgccatcgtggtgggcgtggccgtcatctgtgtggtgccctaccgctacctgcagaggaggaagaagaagggcaaggcagatggaggagcagaatatgccacctaccagaccaagagcaccaccccagctgagcagaggggctag

SEQ ID NO: 146761 - DNA, 1050 bp, Artificial Sequence
  Description of Artificial Sequence: Synthetic coding sequence
atggagcccccaggccggcgggagtgccccttccccagctggaggtttcctggcctgctgctggccgccatggtgctgctgctgtacagcttcagtgatgcctgtgaggagccccccacctttgaggccatggagctgattggcaagcccaagccctactatgagatcggggagcgggtggactacaagtgcaagaagggctacttctacatcccccccctggccacccacaccatctgtgacaggaaccacacctggctgcctgtgtctgatgatgcctgctaccgggagacctgcccctacatccgggaccccctgaatggccaggccgtgcctgccaacggcacctatgaatttggctaccagatgcacttcatctgcaatgaaggctactacctgattggagaggagatcctgtactgtgagctgaagggctctgtggccatctggagcggcaagccacccatctgtgagaaggtgctgtgcaccccaccacccaagatcaagaatggcaagcacaccttcagcgaggtggaggtgtttgagtacctggatgctgtgacctacagctgtgaccctgcccctggccctgaccccttcagcctgattggagagagcaccatctactgtggggacaacagcgtgtggagcagagctgcccctgagtgcaaggtggtgaagtgccgcttccctgtggtggagaatggcaagcagatcagcggctttgggaagaagttctactacaaggccaccgtgatgtttgaatgtgacaagggcttctacctggatggcagtgacaccatcgtgtgtgacagcaacagcacctgggacccccctgtgcccaagtgcctgaagggcccccggcccacctacaagccccctgtgagcaactacccaggctaccccaagccagaggagggcatcctggacagcctggatgtgtgggtgattgctgtgattgtcatcgccatcggcaagcagatggtggagctgaacatgcccctgacccggctgaaccagcccctgcagcagagccgggaggccgagtag

SEQ ID NO: 146762 - DNA, 1155 bp, Artificial Sequence
  Description of Artificial Sequence: Synthetic coding sequence
atggagcccccaggccggcgggagtgccccttccccagctggaggtttcctggcctgctgctggccgccatggtgctgctgctgtacagcttcagtgatgcctgtgaggagccccccacctttgaggccatggagctgattggcaagcccaagccctactatgagatcggggagcgggtggactacaagtgcaagaagggctacttctacatcccccccctggccacccacaccatctgtgacaggaaccacacctggctgcctgtgtctgatgatgcctgctaccgggagacctgcccctacatccgggaccccctgaatggccaggccgtgcctgccaacggcacctatgaatttggctaccagatgcacttcatctgcaatgaaggctactacctgattggagaggagatcctgtactgtgagctgaagggctctgtggccatctggagcggcaagccacccatctgtgagaaggtgctgtgcaccccaccacccaagatcaagaatggcaagcacaccttcagcgaggtggaggtgtttgagtacctggatgctgtgacctacagctgtgaccctgcccctggccctgaccccttcagcctgattggagagagcaccatctactgtggggacaacagcgtgtggagcagagctgcccctgagtgcaaggtggtgaagtgccgcttccctgtggtggagaatggcaagcagatcagcggctttgggaagaagttctactacaaggccaccgtgatgtttgaatgtgacaagggcttctacctggatggcagtgacaccatcgtgtgtgacagcaacagcacctgggacccccctgtgcccaagtgcctgaaggtgtccaccagcagcaccaccaagagccctgccagcagcgccagcggcccccggcccacctacaagccccctgtgagcaactacccaggctaccccaagccagaggagggcatcctggacagcctggatgtgtgggtgattgctgtgattgtgattgccatcgtggtgggcgtggccgtcatctgtgtggtgccctaccgctacctgcagaggaggaagaagaagggcaaggcagatggcggcgcagaatatgccacctaccagaccaagagcaccaccccagctgagcagaggggctag

SEQ ID NO: 146763 - DNA, 1110 bp, Artificial Sequence
  Description of Artificial Sequence: Synthetic coding sequence
atggagcccccaggccggcgggagtgccccttccccagctggaggtttcctggcctgctgctggccgccatggtgctgctgctgtacagcttcagtgatgcctgtgaggagccccccacctttgaggccatggagctgattggcaagcccaagccctactatgagatcggggagcgggtggactacaagtgcaagaagggctacttctacatcccccccctggccacccacaccatctgtgacaggaaccacacctggctgcctgtgtctgatgatgcctgctaccgggagacctgcccctacatccgggaccccctgaatggccaggccgtgcctgccaacggcacctatgaatttggctaccagatgcacttcatctgcaatgaaggctactacctgattggagaggagatcctgtactgtgagctgaagggctctgtggccatctggagcggcaagccacccatctgtgagaaggtgctgtgcaccccaccacccaagatcaagaatggcaagcacaccttcagcgaggtggaggtgtttgagtacctggatgctgtgacctacagctgtgaccctgcccctggccctgaccccttcagcctgattggagagagcaccatctactgtggggacaacagcgtgtggagcagagctgcccctgagtgcaaggtggtgaagtgccgcttccctgtggtggagaatggcaagcagatcagcggctttgggaagaagttctactacaaggccaccgtgatgtttgaatgtgacaagggcttctacctggatggcagtgacaccatcgtgtgtgacagcaacagcacctgggacccccctgtgcccaagtgcctgaagggcccccggcccacctacaagccccctgtgagcaactacccaggctaccccaagccagaggagggcatcctggacagcctggatgtgtgggtgattgctgtgattgtcatcgccatcgtggtgggcgtggccgtcatctgtgtggtgccctaccgctacctgcagaggaggaagaagaagggcaaggcagatggaggagcagaatatgccacctaccagaccaagagcaccaccccagctgagcagaggggctag

SEQ ID NO: 146764 - DNA, 1179 bp, Artificial Sequence
  Description of Artificial Sequence: Synthetic coding sequence
atggagcccccaggccggcgggagtgccccttccccagctggaggtttcctggcctgctgctggccgccatggtgctgctgctgtacagcttcagtgatgcctgtgaggagccccccacctttgaggccatggagctgattggcaagcccaagccctactatgagatcggggagcgggtggactacaagtgcaagaagggctacttctacatcccccccctggccacccacaccatctgtgacaggaaccacacctggctgcctgtgtctgatgatgcctgctaccgggagacctgcccctacatccgggaccccctgaatggccaggccgtgcctgccaacggcacctatgaatttggctaccagatgcacttcatctgcaatgaaggctactacctgattggagaggagatcctgtactgtgagctgaagggctctgtggccatctggagcggcaagccacccatctgtgagaaggtgctgtgcaccccaccacccaagatcaagaatggcaagcacaccttcagcgaggtggaggtgtttgagtacctggatgctgtgacctacagctgtgaccctgcccctggccctgaccccttcagcctgattggagagagcaccatctactgtggggacaacagcgtgtggagcagagctgcccctgagtgcaaggtggtgaagtgccgcttccctgtggtggagaatggcaagcagatcagcggctttgggaagaagttctactacaaggccaccgtgatgtttgaatgtgacaagggcttctacctggatggcagtgacaccatcgtgtgtgacagcaacagcacctgggacccccctgtgcccaagtgcctgaaggtgctgccccccagcagcaccaagcccccagccctgagccacagcgtgtccaccagcagcaccaccaagagccctgccagcagcgccagcggcccccggcccacctacaagccccctgtgagcaactacccaggctaccccaagccagaggagggcatcctggacagcctggatgtgtgggtgattgctgtgattgtcatcgccatcgtggtgggcgtggccgtcatctgtgtggtgccctaccgctacctgcagaggaggaagaagaagggcacctacctgacagatgagacccaccgggaggtgaagttcaccagcctgtag

SEQ ID NO: 146765 - DNA, 1068 bp, Artificial Sequence
  Description of Artificial Sequence: Synthetic coding sequence
atggagcccccaggccggcgggagtgccccttccccagctggaggtttcctggcctgctgctggccgccatggtgctgctgctgtacagcttcagtgatgcctgtgaggagccccccacctttgaggccatggagctgattggcaagcccaagccctactatgagatcggggagcgggtggactacaagtgcaagaagggctacttctacatcccccccctggccacccacaccatctgtgacaggaaccacacctggctgcctgtgtctgatgatgcctgctaccgggagacctgcccctacatccgggaccccctgaatggccaggccgtgcctgccaacggcacctatgaatttggctaccagatgcacttcatctgcaatgaaggctactacctgattggagaggagatcctgtactgtgagctgaagggctctgtggccatctggagcggcaagccacccatctgtgagaaggtgctgtgcaccccaccacccaagatcaagaatggcaagcacaccttcagcgaggtggaggtgtttgagtacctggatgctgtgacctacagctgtgaccctgcccctggccctgaccccttcagcctgattggagagagcaccatctactgtggggacaacagcgtgtggagcagagctgcccctgagtgcaaggtggtgaagtgccgcttccctgtggtggagaatggcaagcagatcagcggctttgggaagaagttctactacaaggccaccgtgatgtttgaatgtgacaagggcttctacctggatggcagtgacaccatcgtgtgtgacagcaacagcacctgggacccccctgtgcccaagtgcctgaagggctaccccaagccagaggagggcatcctggacagcctggatgtgtgggtgattgctgtgattgtcatcgccatcgtggtgggcgtggccgtcatctgtgtggtgccctaccgctacctgcagaggaggaagaagaagggcaaggcagatggaggagcagaatatgccacctaccagaccaagagcaccaccccagctgagcagaggggctag

SEQ ID NO: 146766 - DNA, 1158 bp, Artificial Sequence
  Description of Artificial Sequence: Synthetic coding sequence
atggagcccccaggccggcgggagtgccccttccccagctggaggtttcctggcctgctgctggccgccatggtgctgctgctgtacagcttcagtgatgcctgtgaggagccccccacctttgaggccatggagctgattggcaagcccaagccctactatgagatcggggagcgggtggactacaagtgcaagaagggctacttctacatcccccccctggccacccacaccatctgtgacaggaaccacacctggctgcctgtgtctgatgatgcctgctaccgggagacctgcccctacatccgggaccccctgaatggccaggccgtgcctgccaacggcacctatgaatttggctaccagatgcacttcatctgcaatgaaggctactacctgattggagaggagatcctgtactgtgagctgaagggctctgtggccatctggagcggcaagccacccatctgtgagaaggtgctgtgcaccccaccacccaagatcaagaatggcaagcacaccttcagcgaggtggaggtgtttgagtacctggatgctgtgacctacagctgtgaccctgcccctggccctgaccccttcagcctgattggagagagcaccatctactgtggggacaacagcgtgtggagcagagctgcccctgagtgcaaggtggtgaagtgccgcttccctgtggtggagaatggcaagcagatcagcggctttgggaagaagttctactacaaggccaccgtgatgtttgaatgtgacaagggcttctacctggatggcagtgacaccatcgtgtgtgacagcaacagcacctgggacccccctgtgcccaagtgcctgaaggtgctgccccccagcagcaccaagcccccagccctgagccacagcgtgtccaccagcagcaccaccaagagccctgccagcagcgccagcggctaccccaagccagaggagggcatcctggacagcctggatgtgtgggtgattgctgtgattgtcatcgccatcgtggtgggcgtggccgtcatctgtgtggtgccctaccgctacctgcagaggaggaagaagaagggcaaggcagatggaggagcagaatatgccacctaccagaccaagagcaccaccccagctgagcagaggggctag

SEQ ID NO: 146767 - DNA, 1089 bp, Artificial Sequence
  Description of Artificial Sequence: Synthetic coding sequence
atggagcccccaggccggcgggagtgccccttccccagctggaggtttcctggcctgctgctggccgccatggtgctgctgctgtacagcttcagtgatgcctgtgaggagccccccacctttgaggccatggagctgattggcaagcccaagccctactatgagatcggggagcgggtggactacaagtgcaagaagggctacttctacatcccccccctggccacccacaccatctgtgacaggaaccacacctggctgcctgtgtctgatgatgcctgctaccgggagacctgcccctacatccgggaccccctgaatggccaggccgtgcctgccaacggcacctatgaatttggctaccagatgcacttcatctgcaatgaaggctactacctgattggagaggagatcctgtactgtgagctgaagggctctgtggccatctggagcggcaagccacccatctgtgagaaggtgctgtgcaccccaccacccaagatcaagaatggcaagcacaccttcagcgaggtggaggtgtttgagtacctggatgctgtgacctacagctgtgaccctgcccctggccctgaccccttcagcctgattggagagagcaccatctactgtggggacaacagcgtgtggagcagagctgcccctgagtgcaaggtggtgaagtgccgcttccctgtggtggagaatggcaagcagatcagcggctttgggaagaagttctactacaaggccaccgtgatgtttgaatgtgacaagggcttctacctggatggcagtgacaccatcgtgtgtgacagcaacagcacctgggacccccctgtgcccaagtgcctgaagggcccccggcccacctacaagccccctgtgagcaactacccaggctaccccaagccagaggagggcatcctggacagcctggatgtgtgggtgattgctgtgattgtcatcgccatcgtggtgggcgtggccgtcatctgtgtggtgccctaccgctacctgcagaggaggaagaagaagggcacctacctgacagatgagacccaccgggaggtgaagttcaccagcctgtag

SEQ ID NO: 146768 - DNA, 1134 bp, Artificial Sequence
  Description of Artificial Sequence: Synthetic coding sequence
atggagcccccaggccggcgggagtgccccttccccagctggaggtttcctggcctgctgctggccgccatggtgctgctgctgtacagcttcagtgatgcctgtgaggagccccccacctttgaggccatggagctgattggcaagcccaagccctactatgagatcggggagcgggtggactacaagtgcaagaagggctacttctacatcccccccctggccacccacaccatctgtgacaggaaccacacctggctgcctgtgtctgatgatgcctgctaccgggagacctgcccctacatccgggaccccctgaatggccaggccgtgcctgccaacggcacctatgaatttggctaccagatgcacttcatctgcaatgaaggctactacctgattggagaggagatcctgtactgtgagctgaagggctctgtggccatctggagcggcaagccacccatctgtgagaaggtgctgtgcaccccaccacccaagatcaagaatggcaagcacaccttcagcgaggtggaggtgtttgagtacctggatgctgtgacctacagctgtgaccctgcccctggccctgaccccttcagcctgattggagagagcaccatctactgtggggacaacagcgtgtggagcagagctgcccctgagtgcaaggtggtgaagtgccgcttccctgtggtggagaatggcaagcagatcagcggctttgggaagaagttctactacaaggccaccgtgatgtttgaatgtgacaagggcttctacctggatggcagtgacaccatcgtgtgtgacagcaacagcacctgggacccccctgtgcccaagtgcctgaaggtgtccaccagcagcaccaccaagagccctgccagcagcgccagcggcccccggcccacctacaagccccctgtgagcaactacccaggctaccccaagccagaggagggcatcctggacagcctggatgtgtgggtgattgctgtgattgtgattgccatcgtggtgggcgtggccgtcatctgtgtggtgccctaccgctacctgcagaggaggaagaagaagggcacctacctgacagatgagacccaccgggaggtgaagttcaccagcctgtag

SEQ ID NO: 146769 - DNA, 1011 bp, Artificial Sequence
  Description of Artificial Sequence: Synthetic coding sequence
atggagcccccaggccggcgggagtgccccttccccagctggaggtttcctggcctgctgctggccgccatggtgctgctgctgtacagcttcagcggggagacctgcccctacatccgggaccccctgaatggccaggccgtgcctgccaacggcacctatgaatttggctaccagatgcacttcatctgcaatgaaggctactacctgattggagaggagatcctgtactgtgagctgaagggctctgtggccatctggagcggcaagccacccatctgtgagaaggtgctgtgcaccccaccacccaagatcaagaatggcaagcacaccttcagcgaggtggaggtgtttgagtacctggatgctgtgacctacagctgtgaccctgcccctggccctgaccccttcagcctcatcggggagagcaccatctactgtggggacaacagcgtgtggagccgggccgcccctgagtgcaaggtggtgaagtgccgcttccctgtggtggagaatggcaagcagatcagcggctttgggaagaagttctactacaaggccaccgtgatgtttgaatgtgacaagggcttctacctggatggcagtgacaccatcgtgtgtgacagcaacagcacctgggacccccctgtgcccaagtgcctgaaggtgctgccccccagcagcaccaagcccccagccctgagccacagcgtgtccaccagcagcaccaccaagagccctgccagcagcgccagcggcccccggcccacctacaagccccctgtgagcaactacccaggctaccccaagccagaggagggcatcctggacagcctggatgtgtgggtgattgctgtgattgtgattgccatcgtggtgggcgtggccgtcatctgtgtggtgccctaccgctacctgcagaggaggaagaagaagggcaaggcagatggcggcgcagaatatgccacctaccagaccaagagcaccaccccagctgagcagaggggctag

SEQ ID NO: 146770 - DNA, 1095 bp, Artificial Sequence
  Description of Artificial Sequence: Synthetic coding sequence
atggagcccccaggccggcgggagtgccccttccccagctggaggtttcctggcctgctgctggccgccatggtgctgctgctgtacagcttcagtgatgcctgtgaggagccccccacctttgaggccatggagctgattggcaagcccaagccctactatgagatcggggagcgggtggactacaagtgcaagaagggctacttctacatcccccccctggccacccacaccatctgtgacaggaaccacacctggctgcctgtgtctgatgatgcctgctaccgggagacctgcccctacatccgggaccccctgaatggccaggccgtgcctgccaacggcacctatgaatttggctaccagatgcacttcatctgcaatgaaggctactacctgattggagaggagatcctgtactgtgagctgaagggctctgtggccatctggagcggcaagccacccatctgtgagaaggtgctgtgcaccccaccacccaagatcaagaatggcaagcacaccttcagcgaggtggaggtgtttgagtacctggatgctgtgacctacagctgtgaccctgcccctggccctgaccccttcagcctgattggagagagcaccatctactgtggggacaacagcgtgtggagcagagctgcccctgagtgcaaggtggtgaagtgccgcttccctgtggtggagaatggcaagcagatcagcggctttgggaagaagttctactacaaggccaccgtgatgtttgaatgtgacaagggcttctacctggatggcagtgacaccatcgtgtgtgacagcaacagcacctgggacccccctgtgcccaagtgcctgaaggtgtccaccagcagcaccaccaagagccctgccagcagcgccagcggcccccggcccacctacaagccccctgtgagcaactacccaggctaccccaagccagaggagggcatcctggacagcctggatgtgtgggtgattgctgtgattgtgattgccatcggcaagcagatggtggagctgaacatgcccctgacccggctgaaccagcccctgcagcagagccgggaggccgagtag

SEQ ID NO: 146771 - DNA, 1113 bp, Artificial Sequence
  Description of Artificial Sequence: Synthetic coding sequence
atggagcccccaggccggcgggagtgccccttccccagctggaggtttcctggcctgctgctggccgccatggtgctgctgctgtacagcttcagtgatgcctgtgaggagccccccacctttgaggccatggagctgattggcaagcccaagccctactatgagatcggggagcgggtggactacaagtgcaagaagggctacttctacatcccccccctggccacccacaccatctgtgacaggaaccacacctggctgcctgtgtctgatgatgcctgctaccgggagacctgcccctacatccgggaccccctgaatggccaggccgtgcctgccaacggcacctatgaatttggctaccagatgcacttcatctgcaatgaaggctactacctgattggagaggagatcctgtactgtgagctgaagggctctgtggccatctggagcggcaagccacccatctgtgagaaggtgctgtgcaccccaccacccaagatcaagaatggcaagcacaccttcagcgaggtggaggtgtttgagtacctggatgctgtgacctacagctgtgaccctgcccctggccctgaccccttcagcctgattggagagagcaccatctactgtggggacaacagcgtgtggagcagagctgcccctgagtgcaaggtggtgaagtgccgcttccctgtggtggagaatggcaagcagatcagcggctttgggaagaagttctactacaaggccaccgtgatgtttgaatgtgacaagggcttctacctggatggcagtgacaccatcgtgtgtgacagcaacagcacctgggacccccctgtgcccaagtgcctgaaggtgtccaccagcagcaccaccaagagccctgccagcagcgccagcggctaccccaagccagaggagggcatcctggacagcctggatgtgtgggtgattgctgtgattgtgattgccatcgtggtgggcgtggccgtcatctgtgtggtgccctaccgctacctgcagaggaggaagaagaagggcaaggcagatggcggcgcagaatatgccacctaccagaccaagagcaccaccccagctgagcagaggggctag

SEQ ID NO: 146772 - DNA, 510 bp, Artificial Sequence
  Description of Artificial Sequence: Synthetic coding sequence
atgtgcagccggggctgggacagctgcctggccctggagctgctgctgctgcccctgagcctgctggtgaccagcatccagggccacctggtgcacatgacagtggtgtctggcagcaatgtgaccctgaacatcagcgagagcctgcctgagaactacaagcagctgacctggttctacacctttgaccagaagatcgtggagtgggacagcaggaagagcaagtactttgagagcaagttcaagggccgggtgcggctggacccccagagcggggccctgtacatcagcaaggtgcagaaggaggacaacagcacctacatcatgagggtgctgaagaagacaggaaatgagcaggagtggaagatcaagctgcaggtgctgggggagagcggggagcccaagagcaagagccccctgcagtggccccagatggaccactgccgggcctcctgggaggcctggggcaccctgggggaggaggagaggaagaccagcggccaggtgtag

SEQ ID NO: 146773 - DNA, 732 bp, Artificial Sequence
  Description of Artificial Sequence: Synthetic coding sequence
atgtgcagccggggctgggacagctgcctggccctggagctgctgctgctgcccctgagcctgctggtgaccagcatccagggccacctggtgcacatgacagtggtgtctggcagcaatgtgaccctgaacatcagcgagagcctgcctgagaactacaagcagctgacctggttctacacctttgaccagaagatcgtggagtgggacagcaggaagagcaagtactttgagagcaagttcaagggccgggtgcggctggacccccagagcggggccctgtacatcagcaaggtgcagaaggaggacaacagcacctacatcatgagggtgctgaagaagacaggaaatgagcaggagtggaagatcaagctgcaggtgctggaccctgtgcccaagcctgtgatcaagattgagaagattgaggacatggatgacaactgctacctgaagctgagctgtgtgattcctggagagagcgtgaactacacctggtacggggacaagaggcccttccccaaggagctgcagaacagcgtgctggagaccaccctgatgccccacaactacagccgctgctacacctgccaggtgagcaacagcgtgagcagcaagaatggcaccgtgtgcctgagccccccctgcaccctggcccggagctttggagtggagtggatcgcctcctggctggtggtgacagtgcccaccatcctgggcctgctgctgacctag

SEQ ID NO: 146774 - DNA, 1044 bp, Artificial Sequence
  Description of Artificial Sequence: Synthetic coding sequence
atggccctgctcttcagcctcatcctggccatctgcaccaggcctggcttcctggccagccccagcggcgtgcggctggtgggcggcctgcaccgctgtgagggccgggtggaggtggagcagaagggccagtggggcaccgtgtgtgatgatggctgggacatcaaggatgtggccgtgctgtgccgggagctgggctgtggggccgccagcggcaccccatctggcatcctgtatgagcccccagctgagaaggagcagaaggtgctgatccagagcgtgtcctgcacaggaacagaggacaccctggcccagtgtgagcaggaggaggtgtatgactgcagccatgatgaagatgctggggccagctgtgaaaatcctgagagcagcttcagccctgtgcctgagggcgtgcggctggctgatggccctggccactgcaagggccgggtggaggtgaagcaccagaaccagtggtacacagtgtgccagacaggctggagcctgcgggccgccaaggtggtgtgccggcagctgggctgcggccgggctgtgctgacccagaagcgctgcaacaagcacgcctacggcaggaagcccatctggctgagccagatgagctgcagcggccgggaggccaccctgcaggactgccccagcggcccctggggcaagaacacctgcaaccatgatgaggacacctgggtggagtgtgaggacccctttgacctgcggctggtgggcggggacaacctgtgcagcggccgcctggaggtgctgcacaagggcgtgtggggctctgtgtgtgatgacaactggggcgagaaggaggaccaggtggtgtgcaagcagctgggctgcggcaagagcctgagccccagcttccgggacagaaaatgttatggccctggggtgggccgcatctggctggacaacgtgcgctgcagcggggaggagcagagcctggagcagtgccagcaccgcttctggggcttccatgactgcacccaccaggaggatgtggccgtcatctgcagcggctag

SEQ ID NO: 146775 - DNA, 660 bp, Artificial Sequence
  Description of Artificial Sequence: Synthetic coding sequence
atgggcatgagcagcctgaagctgctgaagtatgtgctcttcttcttcaacctgctcttctggatctgtggctgctgcatcctgggcttcggcatctacctgctgatccacaacaactttggagtgctcttccacaacctgcccagcctgaccctgggcaatgtgtttgtgattgtgggcagcatcatcatggtggtggccttcctgggctgcatgggcagcatcaaggagaacaagtgcctgctgatgtccttcttcatcctgctgctgatcatcctgctggccgaggtgaccctggccatcctgctgtttgtgtatgagcagaagctgaatgaatatgtggccaagggcctgacagacagcatccaccgctaccacagcgacaacagcaccaaggccgcctgggacagcatccagagcttcctgcagtgctgcggcatcaatggcaccagtgactggaccagcggccccccagccagctgccccagcgacaggaaggtggagggctgctacgccaaggcccggctgtggttccacagcaacttcctgtacatcggcatcatcaccatctgtgtgtgtgtgattgaggtgctgggcatgagctttgccctgaccctgaactgccagattgacaagaccagccagaccatcggcctgtag

SEQ ID NO: 146776 - DNA, 483 bp, Artificial Sequence
  Description of Artificial Sequence: Synthetic coding sequence
atgggcatgagcagcctgaagctgctgaagtatgtgctcttcttcttcaacctgctcttctggatctgtggctgctgcatcctgggcttcggcatctacctgctgatccacaacaactttggagtgctcttccacaacctgcccagcctgaccctgggcaatgtgtttgtgattgtgggcagcatcatcatggtggtggccttcctgggctgcatgggcagcatcaaggagaacaagtgcctgctgatgtccttcttcatcctgctgctgatcatcctgctggccgaggtgaccctggccatcctgctgtttgtgtatgagcagaagggctgctacgccaaggcccggctgtggttccacagcaacttcctgtacatcggcatcatcaccatctgtgtgtgtgtgattgaggtgctgggcatgagctttgccctgaccctgaactgccagattgacaagaccagccagaccatcggcctgtag

SEQ ID NO: 146777 - DNA, 1323 bp, Artificial Sequence
  Description of Artificial Sequence: Synthetic coding sequence
atgacagtggcccggcccagcgtgcctgctgccctgcccctgctgggggagctgccccggctgctgctgctggtgctgctgtgcctgcctgctgtgtggggagactgtggcctgcccccagatgtgcccaatgcccagcctgccctggagggccgcaccagcttcccagaagatactgtcatcacctacaagtgtgaggagagctttgtgaagatccctggagagaaggacagcgtcatctgcctgaagggcagccagtggagcgacatcgaggagttctgcaacagaagctgtgaggtgcccacccggctgaacagcgccagcctgaagcagccctacatcacccagaactacttccctgtgggcaccgtggtggagtatgagtgcaggcctggctaccgccgggagcccagcctgagccccaagctgacctgcctgcagaacctgaagtggagcacagctgtggagttctgcaagaagaagagctgccccaaccctggagagatcagaaatggccagattgatgtgcctgggggcatcctgtttggagccaccatctccttcagctgcaacacaggctacaagctgtttggcagcaccagcagcttctgcctgatcagcggcagctctgtgcagtggagcgaccccctgcctgaatgtcgggagatctactgcccagccccaccccagattgacaatggcatcatccagggcgagcgggaccactacggctaccggcagagcgtgacctacgcctgcaacaagggcttcaccatgattggagagcacagcatctactgcaccgtgaacaatgatgaaggagagtggagcggccccccacctgagtgccggggcaagagcctgaccagcaaggtgcccccaacagtgcagaagcccaccaccgtgaatgtgcccaccacagaggtgagccccaccagccagaagaccaccaccaagaccaccaccccaaatgcccaggccaccaggagcacccctgtgtccaggaccaccaagcacttccacgagaccacccccaacaagggcagcggcaccaccagcggcaccacccggctgctgagcggcagcaggcctgtgacccaggccggcatgcgctggtgtgacaggagcagcctgcagagcaggaccccaggcttcaagaggagcttccacttcagcctgcccagctcctggtactaccgggcccacgtgttccacgtggacagatttgcctgggatgccagcaaccacggcctggccgacctggccaaggaggagctgcggaggaagtacacccaggtgtaccgcctcttcctggtgtcctag

SEQ ID NO: 146778 - DNA, 1095 bp, Artificial Sequence
  Description of Artificial Sequence: Synthetic coding sequence
atgacagtggcccggcccagcgtgcctgctgccctgcccctgctgggggagctgccccggctgctgctgctggtgctgctgtgcctgcctgctgtgtggggagactgtggcctgcccccagatgtgcccaatgcccagcctgccctggagggccgcaccagcttcccagaagatactgtcatcacctacaagtgtgaggagagctttgtgaagatccctggagagaaggacagcgtcatctgcctgaagggcagccagtggagcgacatcgaggagttctgcaacagaagctgtgaggtgcccacccggctgaacagcgccagcctgaagcagccctacatcacccagaactacttccctgtgggcaccgtggtggagtatgagtgcaggcctggctaccgccgggagcccagcctgagccccaagctgacctgcctgcagaacctgaagtggagcacagctgtggagttctgcaagaagaagagctgccccaaccctggagagatcagaaatggccagattgatgtgcctgggggcatcctgtttggagccaccatctccttcagctgcaacacaggctacaagctgtttggcagcaccagcagcttctgcctgatcagcggcagctctgtgcagtggagcgaccccctgcctgaatgtcgggagatctactgcccagccccaccccagattgacaatggcatcatccagggcgagcgggaccactacggctaccggcagagcgtgacctacgcctgcaacaagggcttcaccatgattggagagcacagcatctactgcaccgtgaacaatgatgaaggagagtggagcggccccccacctgagtgccggggcaagagcctgaccagcaaggtgcccccaacagtgcagaagcccaccaccgtgaatgtgcccaccacagaggtgagccccaccagccagaagaccaccaccaagaccaccaccccaaatgcccaggccaccaggagcacccctgtgtccaggaccaccaagcacttccacgagaccacccccaacaagggcagcggcaccaccagcggcaccacccggctgctgtctgtgctcttcatgtag

SEQ ID NO: 146779 - DNA, 1146 bp, Artificial Sequence
  Description of Artificial Sequence: Synthetic coding sequence
atgacagtggcccggcccagcgtgcctgctgccctgcccctgctgggggagctgccccggctgctgctgctggtgctgctgtgcctgcctgctgtgtggggagactgtggcctgcccccagatgtgcccaatgcccagcctgccctggagggccgcaccagcttcccagaagatactgtcatcacctacaagtgtgaggagagctttgtgaagatccctggagagaaggacagcgtcatctgcctgaagggcagccagtggagcgacatcgaggagttctgcaacagaagctgtgaggtgcccacccggctgaacagcgccagcctgaagcagccctacatcacccagaactacttccctgtgggcaccgtggtggagtatgagtgcaggcctggctaccgccgggagcccagcctgagccccaagctgacctgcctgcagaacctgaagtggagcacagctgtggagttctgcaagaagaagagctgccccaaccctggagagatcagaaatggccagattgatgtgcctgggggcatcctgtttggagccaccatctccttcagctgcaacacaggctacaagctgtttggcagcaccagcagcttctgcctgatcagcggcagctctgtgcagtggagcgaccccctgcctgaatgtcgggagatctactgcccagccccaccccagattgacaatggcatcatccagggcgagcgggaccactacggctaccggcagagcgtgacctacgcctgcaacaagggcttcaccatgattggagagcacagcatctactgcaccgtgaacaatgatgaaggagagtggagcggccccccacctgagtgccggggcaagagcctgaccagcaaggtgcccccaacagtgcagaagcccaccaccgtgaatgtgcccaccacagaggtgagccccaccagccagaagaccaccaccaagaccaccaccccaaatgcccaggccaccaggagcacccctgtgtccaggaccaccaagcacttccacgagaccacccccaacaagggcagcggcaccaccagcggcaccacccggctgctgagcggccacacctgcttcaccctgaccggcctgctgggcaccctggtgaccatgggcctgctgacctag

SEQ ID NO: 146780 - DNA, 1320 bp, Artificial Sequence
  Description of Artificial Sequence: Synthetic coding sequence
atgacagtggcccggcccagcgtgcctgctgccctgcccctgctgggggagctgccccggctgctgctgctggtgctgctgtgcctgcctgctgtgtggggagactgtggcctgcccccagatgtgcccaatgcccagcctgccctggagggccgcaccagcttcccagaagatactgtcatcacctacaagtgtgaggagagctttgtgaagatccctggagagaaggacagcgtcatctgcctgaagggcagccagtggagcgacatcgaggagttctgcaacagaagctgtgaggtgcccacccggctgaacagcgccagcctgaagcagccctacatcacccagaactacttccctgtgggcaccgtggtggagtatgagtgcaggcctggctaccgccgggagcccagcctgagccccaagctgacctgcctgcagaacctgaagtggagcacagctgtggagttctgcaagaagaagagctgccccaaccctggagagatcagaaatggccagattgatgtgcctgggggcatcctgtttggagccaccatctccttcagctgcaacacaggctacaagctgtttggcagcaccagcagcttctgcctgatcagcggcagctctgtgcagtggagcgaccccctgcctgaatgtcgggagatctactgcccagccccaccccagattgacaatggcatcatccagggcgagcgggaccactacggctaccggcagagcgtgacctacgcctgcaacaagggcttcaccatgattggagagcacagcatctactgcaccgtgaacaatgatgaaggagagtggagcggccccccacctgagtgccggggcaagagcctgaccagcaaggtgcccccaacagtgcagaagcccaccaccgtgaatgtgcccaccacagaggtgagccccaccagccagaagaccaccaccaagaccaccaccccaaatgcccaggccaccaggagcacccctgtgtccaggaccaccaagcacttccacgagaccacccccaacaagggcagcggcaccaccagcggcaccacccggctgctgtctgagaccgtcttccacagggtcatccaggacggcctggacctgctggccagccgcagcgcctgcctgggcctgcccaagtgctgggactacagaagagagcccccccacctggcccgggcccacgtgttccacgtggacagatttgcctgggatgccagcaaccacggcctggccgacctggccaaggaggagctgcggaggaagtacacccaggtgtaccgcctcttcctggtgtcctag

SEQ ID NO: 146781 - DNA, 390 bp, Artificial Sequence
  Description of Artificial Sequence: Synthetic coding sequence
atgacagtggcccggcccagcgtgcctgctgccctgcccctgctgggggagctgccccggctgctgctgctggtgctgctgtgcctgcctgctgtgtggggagactgtggcctgcccccagatgtgcccaatgcccagcctgccctggagggccgcaccagcttcccagaagatactgtcatcacctacaagtgtgaggagagctttgtgaagatccctggagagaaggacagcgtcatctgcctgaagggcagccagtggagcgacatcgaggagttctgcaacagaagctgtgaggtgcccacccggctgcagaagaggaccttcagcatcaccaagaccaacctgcccagcgagttcaagatggtgcacagcagccgcatcctgtag

SEQ ID NO: 146782 - DNA, 1155 bp, Artificial Sequence
  Description of Artificial Sequence: Synthetic coding sequence
atgacagtggcccggcccagcgtgcctgctgccctgcccctgctgggggagctgccccggctgctgctgctggtgctgctgtgcctgcctgctgtgtggggagactgtggcctgcccccagatgtgcccaatgcccagcctgccctggagggccgcaccagcttcccagaagatactgtcatcacctacaagtgtgaggagagctttgtgaagatccctggagagaaggacagcgtcatctgcctgaagggcagccagtggagcgacatcgaggagttctgcaacagaagctgtgaggtgcccacccggctgaacagcgccagcctgaagcagccctacatcacccagaactacttccctgtgggcaccgtggtggagtatgagtgcaggcctggctaccgccgggagcccagcctgagccccaagctgacctgcctgcagaacctgaagtggagcacagctgtggagttctgcaagaagaagagctgccccaaccctggagagatcagaaatggccagattgatgtgcctgggggcatcctgtttggagccaccatctccttcagctgcaacacaggctacaagctgtttggcagcaccagcagcttctgcctgatcagcggcagctctgtgcagtggagcgaccccctgcctgaatgtcgggagatctactgcccagccccaccccagattgacaatggcatcatccagggcgagcgggaccactacggctaccggcagagcgtgacctacgcctgcaacaagggcttcaccatgattggagagcacagcatctactgcaccgtgaacaatgatgaaggagagtggagcggccccccacctgagtgccggggcaagagcctgaccagcaaggtgcccccaacagtgcagaagcccaccaccgtgaatgtgcccaccacagaggtgagccccaccagccagaagaccaccaccaagaccaccaccccaaatgcccaggccaccaggagcacccctgtgtccaggaccaccaagcacttccacgagaccacccccaacaagggcagcggcaccaccagcggcaccacccggctgctgagcgccctgcaggtgcggccctttgaggtgtctggcagcagccacatcagcagcaagaagatgatgtgcatcctgtag

SEQ ID NO: 146783 - DNA, 954 bp, Artificial Sequence
  Description of Artificial Sequence: Synthetic coding sequence
atgacagtggcccggcccagcgtgcctgctgccctgcccctgctgggggagctgccccggctgctgctgctggtgctgctgtgcctgcctgctgtgtggggagactgtggcctgcccccagatgtgcccaatgcccagcctgccctggagggccgcaccagcttcccagaagatactgtcatcacctacaagtgtgaggagagctttgtgaagatccctggagagaaggacagcgtcatctgcctgaagggcagccagtggagcgacatcgaggagttctgcaaccagaagagctgccccaaccctggagagatcagaaatggccagattgatgtgcctgggggcatcctgtttggagccaccatctccttcagctgcaacacaggctacaagctgtttggcagcaccagcagcttctgcctgatcagcggcagctctgtgcagtggagcgaccccctgcctgaatgtcgggagatctactgcccagccccaccccagattgacaatggcatcatccagggcgagcgggaccactacggctaccggcagagcgtgacctacgcctgcaacaagggcttcaccatgattggagagcacagcatctactgcaccgtgaacaatgatgaaggagagtggagcggccccccacctgagtgccggggcaagagcctgaccagcaaggtgcccccaacagtgcagaagcccaccaccgtgaatgtgcccaccacagaggtgagccccaccagccagaagaccaccaccaagaccaccaccccaaatgcccaggccaccaggagcacccctgtgtccaggaccaccaagcacttccacgagaccacccccaacaagggcagcggcaccaccagcggccagctgaccctcttcagcggccacacctgcttcaccctgaccggcctgctgggcaccctggtgaccatgggcctgctgacctag

SEQ ID NO: 146784 - DNA, 753 bp, Artificial Sequence
  Description of Artificial Sequence: Synthetic coding sequence
atggtggccggcagtgatgctggccgggccctgggcgtgctgtctgtggtgtgcctgctgcactgcttcggcttcatcagctgcttcagccagcagatctacggcgtggtgtatggaaatgtgaccttccacgtgcccagcaatgtgcccctgaaggaggtgctgtggaagaagcagaaggacaaggtggccgagctggagaacagcgagttccgggccttcagcagcttcaagaacagagtgtacctggacacagtgtctggcagcctgaccatctacaacctgaccagcagtgatgaagatgaatatgagatggagagccccaacatcacagacaccatgaagttcttcctgtatgtgctggagagcctgcccagccccaccctgacctgtgccctgaccaacggcagcattgaggtgcagtgcatgatccctgagcactacaacagccaccggggcctcatcatgtacagctgggactgccccatggagcagtgcaagaggaacagcaccagcatctacttcaagatggagaatgacctgccccagaagatccagtgcaccctgagcaaccccctcttcaacaccaccagcagcatcatcctgaccacctgcatccccagcagcggccacagccgccacagatatgccctgatccccatccccctggccgtcatcaccacctgcatcgtgctgtacatgaatggcatcctgaagtgtgacaggaagccagacaggaccaacagcaactag

SEQ ID NO: 146785 - DNA, 747 bp, Artificial Sequence
  Description of Artificial Sequence: Synthetic coding sequence
atggtggccggcagtgatgctggccgggccctgggcgtgctgtctgtggtgtgcctgctgcactgcttcggcttcatcagctgcttcagccagcagatctacggcgtggtgtatggaaatgtgaccttccacgtgcccagcaatgtgcccctgaaggaggtgctgtggaagaagcagaaggacaaggtggccgagctggagaacagcgagttccgggccttcagcagcttcaagaacagagtgtacctggacacagtgtctggcagcctgaccatctacaacctgaccagcagtgatgaagatgaatatgagatggagagccccaacatcacagacaccatgaagttcttcctgtatgtgctggagagcctgcccagccccaccctgacctgtgccctgaccaacggcagcattgaggtgcagtgcatgatccctgagcactacaacagccaccggggcctcatcatgtacagctgggactgccccatggagcagtgcaagaggaacagcaccagcatctacttcaagatggagaatgacctgccccagaagatccagtgcaccctgagcaaccccctcttcaacaccaccagcagcatcatcctgaccacctgcatccccagcagcggccacagccgccacagatatgccctgatccccatccccctggccgtcatcaccacctgcatcgtgctgtacatgaatggcatcctgaagtgtgacaggaagccagacaggaccaagtag

SEQ ID NO: 146786 - DNA, 387 bp, Artificial Sequence
  Description of Artificial Sequence: Synthetic coding sequence
atgggcatccagggcggctctgtgctgtttggcctgctgctggtgctggccgtgttctgccacagcggccacagcctgcagtgctacaactgccccaaccccacagctgactgcaagacagctgtgaactgcagcagtgactttgatgcctgcctgatcaccaaggccggcctgcaggtgtacaacaagtgctggaagtttgagcactgcaacttcaatgatgtgaccacccggctgagagaaaatgagctgacctactactgctgcaagaaggacctgtgcaacttcaatgagcagctggagaatggaggcaccagcctgtctgagaagacagtgctgctgctggtgacccccttcctggccgccgcctggagcctgcacccctag

SEQ ID NO: 146787 - DNA, 387 bp, Artificial Sequence; identical to SEQ ID NO: 146786
  Description of Artificial Sequence: Synthetic coding sequence

SEQ ID NO: 146788 - DNA, 387 bp, Artificial Sequence; identical to SEQ ID NO: 146786
  Description of Artificial Sequence: Synthetic coding sequence

SEQ ID NO: 146789 - DNA, 387 bp, Artificial Sequence; identical to SEQ ID NO: 146786
  Description of Artificial Sequence: Synthetic coding sequence

SEQ ID NO: 146790 - DNA, 387 bp, Artificial Sequence; identical to SEQ ID NO: 146786
  Description of Artificial Sequence: Synthetic coding sequence

SEQ ID NO: 146791 - DNA, 387 bp, Artificial Sequence; identical to SEQ ID NO: 146786
  Description of Artificial Sequence: Synthetic coding sequence

SEQ ID NO: 146792 - DNA, 387 bp, Artificial Sequence; identical to SEQ ID NO: 146786
  Description of Artificial Sequence: Synthetic coding sequence

SEQ ID NO: 146793 - DNA, 387 bp, Artificial Sequence; identical to SEQ ID NO: 146786
  Description of Artificial Sequence: Synthetic coding sequence

SEQ ID NO: 146794 - DNA, 387 bp, Artificial Sequence; identical to SEQ ID NO: 146786
  Description of Artificial Sequence: Synthetic coding sequence

SEQ ID NO: 146795 - DNA, 2007 bp, Artificial Sequence
  Description of Artificial Sequence: Synthetic coding sequence
atgtggctgttcttcggcatcaccggcctgctgacagctgccctgagcggccaccccagccctgcccccccagaccagctgaacaccagcagcgctgagagcgagctgtgggagcctggagagcggctgcctgtgcggctgaccaacggcagcagcagctgcagcggcaccgtggaggtgcggctggaggcctcctgggagcccgcctgtggggccctgtgggacagcagagctgctgaggccgtgtgccgggccctgggctgcggcggcgctgaggccgccagccagctggccccacccaccccagagctgcccccacctcctgctgctggcaacacctctgtggccgccaatgccaccctggccggggccccagccctgctgtgcagcggggctgagtggaggctgtgtgaggtggtggagcacgcctgccgcagtgatggaagaagagcccgggtgacctgtgctgaaaatagagccctgcggctggtggatggcggcggggcctgtgccggccgggtggagatgctggagcacggggagtggggctctgtgtgtgatgacacctgggacctggaggatgcccacgtggtgtgccggcagctgggctgcggctgggccgtgcaggccctgcccggcctgcacttcaccccaggccggggccccatccaccgggaccaggtgaactgcagcggggctgaggcctacctgtgggactgccccggcctgcccggccagcactactgcggccacaaggaggatgctggagctgtgtgcagcgagcaccagagctggaggctgaccggcggcgctgacagatgtgagggccaggtggaggtgcacttccggggcgtgtggaacacagtgtgtgacagcgagtggtaccccagcgaggccaaggtgctgtgccagagcctgggctgcggcacagctgtggagcggcccaagggcctgccccacagcctgagcggccgcatgtactacagctgcaatggagaggagctgaccctgagcaactgctcctggaggttcaacaacagcaacctgtgcagccagagcctggccgcccgggtgctgtgcagcgccagccgcagcctgcacaacctgagcaccccagaggtgcctgcctctgtgcagacagtgaccatcgagagctctgtgacagtgaagattgagaacaaggagagccgggagctgatgctgctgatccccagcatcgtgctgggcatcctgctgctgggcagcctcatcttcatcgccttcatcctgctgcgcatcaagggcaagtatgccctgcctgtgatggtgaaccaccagcacctgcccaccaccatcccagctggcagcaacagctaccagcctgtgcccatcaccatccccaaggaggtgttcatgctgcccatccaggtgcaggcccctcctcctgaggacagcgacagcggcagtgacagcgactatgagcactatgacttcagcgcccagccccctgtggccctgaccaccttctacaacagccagaggcaccgggtgacagatgaggaggtgcagcagagccgcttccagatgccacccctggaggagggcctggaggagctgcacgccagccacatccccacagccaaccctggccactgcatcacagatcctcccagcctgggcccccagtaccaccccaggagcaacagcgagagcagcaccagcagcggggaggactactgcaacagccccaagagcaagctgcccccctggaacccccaggtgttcagcagcgagaggagcagcttcctggagcagccccccaacctggagctggccggcacccagcctgccttctctgctggccccccagcagatgacagcagcagcaccagcagtggagagtggtaccagaacttccagcccccaccccagccccccagcgaggagcagtttggctgccccggcagccccagcccccagcctgacagcacagacaatgatgattatgatgacatctctgctgcctag

SEQ ID NO: 146796 - DNA, 1911 bp, Artificial Sequence
  Description of Artificial Sequence: Synthetic coding sequence
atgtggctgttcttcggcatcaccggcctgctgacagctgccctgagcggccaccccagccctgcccccccagaccagctgaacaccagcagcgctgagagcgagctgtgggagcctggagagcggctgcctgtgcggctgaccaacggcagcagcagctgcagcggcaccgtggaggtgcggctggaggcctcctgggagcccgcctgtggggccctgtgggacagcagagctgctgaggccgtgtgccgggccctgggctgcggcggcgctgaggccgccagccagctggccccacccaccccagagctgcccccacctcctgctgctggcaacacctctgtggccgccaatgccaccctggccggggccccagccctgctgtgcagcggggctgagtggaggctgtgtgaggtggtggagcacgcctgccgcagtgatggaagaagagcccgggtgacctgtgctgaaaatagagccctgcggctggtggatggcggcggggcctgtgccggccgggtggagatgctggagcacggggagtggggctctgtgtgtgatgacacctgggacctggaggatgcccacgtggtgtgccggcagctgggctgcggctgggccgtgcaggccctgcccggcctgcacttcaccccaggccggggccccatccaccgggaccaggtgaactgcagcggggctgaggcctacctgtgggactgccccggcctgcccggccagcactactgcggccacaaggaggatgctggagctgtgtgcagcgagcaccagagctggaggctgaccggcggcgctgacagatgtgagggccaggtggaggtgcacttccggggcgtgtggaacacagtgtgtgacagcgagtggtaccccagcgaggccaaggtgctgtgccagagcctgggctgcggcacagctgtggagcggcccaagggcctgccccacagcctgagcggccgcatgtactacagctgcaatggagaggagctgaccctgagcaactgctcctggaggttcaacaacagcaacctgtgcagccagagcctggccgcccgggtgctgtgcagcgccagccgcagcctgcacaacctgagcaccccagaggtgcctgcctctgtgcagacagtgaccatcgagagctctgtgacagtgaagattgagaacaaggagagccgggagctgatgctgctgatccccagcatcgtgctgggcatcctgctgctgggcagcctcatcttcatcgccttcatcctgctgcgcatcaagggcaagtatgtgttcatgctgcccatccaggtgcaggcccctcctcctgaggacagcgacagcggcagtgacagcgactatgagcactatgacttcagcgcccagccccctgtggccctgaccaccttctacaacagccagaggcaccgggtgacagatgaggaggtgcagcagagccgcttccagatgccacccctggaggagggcctggaggagctgcacgccagccacatccccacagccaaccctggccactgcatcacagatcctcccagcctgggcccccagtaccaccccaggagcaacagcgagagcagcaccagcagcggggaggactactgcaacagccccaagagcaagctgcccccctggaacccccaggtgttcagcagcgagaggagcagcttcctggagcagccccccaacctggagctggccggcacccagcctgccttctctgctggccccccagcagatgacagcagcagcaccagcagtggagagtggtaccagaacttccagcccccaccccagccccccagcgaggagcagtttggctgccccggcagccccagcccccagcctgacagcacagacaatgatgattatgatgacatctctgctgcctag

SEQ ID NO: 146797 - DNA, 1788 bp, Artificial Sequence
  Description of Artificial Sequence: Synthetic coding sequence
atgtggctgttcttcggcatcaccggcctgctgacagctgccctgagcggccaccccagccctgcccccccagaccagctgaacaccagcagcgctgagagcgagctgtgggagcctggagagcggctgcctgtgcggctgaccaacggcagcagcagctgcagcggcaccgtggaggtgcggctggaggcctcctgggagcccgcctgtggggccctgtgggacagcagagctgctgaggccgtgtgccgggccctgggctgcggcggcgctgaggccgccagccagctggccccacccaccccagagctgcccccacctcctgctgctggcaacacctctgtggccgccaatgccaccctggccggggccccagccctgctgtgcagcggggctgagtggaggctgtgtgaggtggtggagcacgcctgccgcagtgatggaagaagagcccgggtgacctgtgctgaaaatagagccctgcggctggtggatggcggcggggcctgtgccggccgggtggagatgctggagcacggggagtggggctctgtgtgtgatgacacctgggacctggaggatgcccacgtggtgtgccggcagctgggctgcggctgggccgtgcaggccctgcccggcctgcacttcaccccaggccggggccccatccaccgggaccaggtgaactgcagcggggctgaggcctacctgtgggactgccccggcctgcccggccagcactactgcggccacaaggaggatgctggagctgtgtgcagcgagcaccagagctggaggctgaccggcggcgctgacagatgtgagggccaggtggaggtgcacttccggggcgtgtggaacacagtgtgtgacagcgagtggtaccccagcgaggccaaggtgctgtgccagagcctgggctgcggcacagctgtggagcggcccaagggcctgccccacagcctgagcggccgcatgtactacagctgcaatggagaggagctgaccctgagcaactgctcctggaggttcaacaacagcaacctgtgcagccagagcctggccgcccgggtgctgtgcagcgccagccgcagcctgcacaacctgagcaccccagaggtgcctgcctctgtgcagacagtgaccatcgagagctctgtgacagtgaagattgagaacaaggagagccgggagctgatgctgctgatccccagcatcgtgctgggcatcctgctgctgggcagcctcatcttcatcgccttcatcctgctgcgcatcaagggcaagtatgacagccagaggcaccgggtgacagatgaggaggtgcagcagagccgcttccagatgccacccctggaggagggcctggaggagctgcacgccagccacatccccacagccaaccctggccactgcatcacagacccccccagcctgggcccccagtaccaccccaggagcaacagcgagagcagcaccagcagtggagaggactactgcaacagccccaagagcaagctgcccccctggaacccccaggtgttcagcagcgagaggagcagcttcctggagcagccccccaacctggagctggccggcacccagcctgccttctctgctggccccccagcagatgacagcagcagcaccagcagcggggagtggtaccagaacttccagcccccaccccagcccccatctgaggagcagtttggctgccccggcagccccagcccccagcctgacagcacagacaatgatgattatgatgacatctctgctgcctag

SEQ ID NO: 146798 - DNA, 1806 bp, Artificial Sequence
  Description of Artificial Sequence: Synthetic coding sequence
atgtggctgttcttcggcatcaccggcctgctgacagctgccctgagcggccaccccagccctgcccccccagaccagctgaacaccagcagcgctgagagcgagctgtgggagcctggagagcggctgcctgtgcggctgaccaacggcagcagcagctgcagcggcaccgtggaggtgcggctggaggcctcctgggagcccgcctgtggggccctgtgggacagcagagctgctgaggccgtgtgccgggccctgggctgcggcggcgctgaggccgccagccagctggccccacccaccccagagctgcccccacctcctgctgctggcaacacctctgtggccgccaatgccaccctggccggggccccagccctgctgtgcagcggggctgagtggaggctgtgtgaggtggtggagcacgcctgccgcagtgatggaagaagagcccgggtgacctgtgctgaaaatagagccctgcggctggtggatggcggcggggcctgtgccggccgggtggagatgctggagcacggggagtggggctctgtgtgtgatgacacctgggacctggaggatgcccacgtggtgtgccggcagctgggctgcggctgggccgtgcaggccctgcccggcctgcacttcaccccaggccggggccccatccaccgggaccaggtgaactgcagcggggctgaggcctacctgtgggactgccccggcctgcccggccagcactactgcggccacaaggaggatgctggagctgtgtgcagcgagcaccagagctggaggctgaccggcggcgctgacagatgtgagggccaggtggaggtgcacttccggggcgtgtggaacacagtgtgtgacagcgagtggtaccccagcgaggccaaggtgctgtgccagagcctgggctgcggcacagctgtggagcggcccaagggcctgccccacagcctgagcggccgcatgtactacagctgcaatggagaggagctgaccctgagcaactgctcctggaggttcaacaacagcaacctgtgcagccagagcctggccgcccgggtgctgtgcagcgccagccgcagcctgcacaacctgagcaccccagaggtgcctgcctctgtgcagacagtgaccatcgagagctctgtgacagtgaagattgagaacaaggagagccgggagctgatgctgctgatccccagcatcgtgctgggcatcctgctgctgggcagcctcatcttcatcgccttcatcctgctgcgcatcaagggcaagtatgtgttcatgctgcccatccaggtgcaggcccctcctcctgaggacagcgacagcggcagtgacagcgactatgagcactatgacttcagcgcccagccccctgtggccctgaccaccttctacaacagccagaggcaccgggtgacagatgaggaggtgcagcagagccgcttccagatgccacccctggaggagggcctggaggagctgcacgccagccacatccccacagccaaccctggccactgcatcacagatcctcccagcctgggcccccagtaccaccccaggagcaacagcgagagcagcaccagcagcggggaggactactgcaacagccccaagagcaagctgcccccctggaacccccaggtgttcagcagcgagaggagcagcttcctggagcagccccccaacctggagctggccggcacccagcctgccttcagcggcagccccagcccccagcctgacagcacagacaatgatgattatgatgacatctctgctgcctag

SEQ ID NO: 146799 - DNA, 1779 bp, Artificial Sequence
  Description of Artificial Sequence: Synthetic coding sequence
atgtggctgttcttcggcatcaccggcctgctgacagctgccctgagcggccaccccagccctgcccccccagaccagctgaacaccagcagcgctgagagcgagctgtgggagcctggagagcggctgcctgtgcggctgaccaacggcagcagcagctgcagcggcaccgtggaggtgcggctggaggcctcctgggagcccgcctgtggggccctgtgggacagcagagctgctgaggccgtgtgccgggccctgggctgcggcggcgctgaggccgccagccagctggccccacccaccccagagctgcccccacctcctgctgctggcaacacctctgtggccgccaatgccaccctggccggggccccagccctgctgtgcagcggggctgagtggaggctgtgtgaggtggtggagcacgcctgccgcagtgatggaagaagagcccgggtgacctgtgctgaaaatagagccctgcggctggtggatggcggcggggcctgtgccggccgggtggagatgctggagcacggggagtggggctctgtgtgtgatgacacctgggacctggaggatgcccacgtggtgtgccggcagctgggctgcggctgggccgtgcaggccctgcccggcctgcacttcaccccaggccggggccccatccaccgggaccaggtgaactgcagcggggctgaggcctacctgtgggactgccccggcctgcccggccagcactactgcggccacaaggaggatgctggagctgtgtgcagcgagcaccagagctggaggctgaccggcggcgctgacagatgtgagggccaggtggaggtgcacttccggggcgtgtggaacacagtgtgtgacagcgagtggtaccccagcgaggccaaggtgctgtgccagagcctgggctgcggcacagctgtggagcggcccaagggcctgccccacagcctgagcggccgcatgtactacagctgcaatggagaggagctgaccctgagcaactgctcctggaggttcaacaacagcaacctgtgcagccagagcctggccgcccgggtgctgtgcagcgccagccgcagcctgcacaacctgagcaccccagaggtgcctgcctctgtgcagacagtgaccatcgagagctctgtgacagtgaagattgagaacaaggagagccgggagctgatgctgctgatccccagcatcgtgctgggcatcctgctgctgggcagcctcatcttcatcgccttcatcctgctgcgcatcaagggcaagtatgccctgcctgtgatggtgaaccaccagcacctgcccaccaccatcccagctggcagcaacagctaccagcctgtgcccatcaccatccccaaggaggacagccagaggcaccgggtgacagatgaggaggtgcagcagagccgcttccagatgccacccctggaggagggcctggaggagctgcacgccagccacatccccacagccaaccctggccactgcatcacagacccccccagcctgggcccccagtaccaccccaggagcaacagcgagagcagcaccagcagtggagaggactactgcaacagccccaagagcaagctgcccccctggaacccccaggtgttcagcagcgagaggagcagcttcctggagcagccccccaacctggagctggccggcacccagcctgccttcagcggcagccccagcccccagcctgacagcacagacaatgatgattatgatgacatctctgctgcctag

SEQ ID NO: 146800 - DNA, 717 bp, Artificial Sequence
  Description of Artificial Sequence: Synthetic coding sequence
atggctgtggagggcggcatgaagtgtgtgaagttcctgctgtatgtgctgctgctggccttctgtgcctgtgctgtgggcctgattgctgtgggcgtgggcgcccagctggtgctgagccagaccatcatccagggcgccaccccaggcagcctgctgcctgtggtgatcatcgctgtgggcgtcttcctgttcctggtggcctttgtgggctgctgcggggcctgcaaggagaactactgcctgatgatcacctttgccatcttcctgagcctcatcatgctggtggaggtggccgccgccatcgccggctacgtgttccgggacaaggtgatgtctgagttcaacaacaacttccggcagcagatggagaactaccccaagaacaaccacacagccagcatcctggacaggatgcaggccgacttcaagtgctgcggggccgccaactacacagactgggagaagatccccagcatgagcaagaacagagtgcctgacagctgctgcatcaacgtgacagtgggctgcggcatcaacttcaatgagaaggccatccacaaggagggctgtgtggagaagattggaggctggctgaggaagaatgtgctggtggtggccgctgctgccctgggcatcgcctttgtggaggtgctgggcatcgtgtttgcctgctgcctggtgaagagcatccgcagcggctatgaggtgatgtag

SEQ ID NO: 146801 - DNA, 711 bp, Artificial Sequence
  Description of Artificial Sequence: Synthetic coding sequence
atggctgtggagggcggcatgaagtgtgtgaagttcctgctgtatgtgctgctgctggccttctgtgcctgtgctgtgggcctgattgctgtgggcgtgggcgcccagctggtgctgagccagaccatcatccagggcgccaccccaggcagcctgctgcctgtggtgatcatcgctgtgggcgtcttcctgttcctggtggcctttgtgggctgctgcggggcctgcaaggagaactactgcctgatgatcacctttgccatcttcctgagcctcatcatgctggtggaggtggccgccgccatcgccggctacgtgttccgggacaaggtgatgtctgagttcaacaacaacttccggcagcagatggagaactaccccaagaacaaccacacagccagcatcctggacaggatgcaggccgacttcaagtgctgcggggccgccaactacacagactgggagaagatccccagcatgagcaagaacagagtgcctgacagctgctgcatcaacgtgacagtgggctgcggcatcaacttcaatgagaaggccatccacaaggagggctgtgtggagaagattggaggctggctgaggaagaatgtgctggtggtggccgctgctgccctgggcatcgcctttgtgctgggcatcgtgtttgcctgctgcctggtgaagagcatccgcagcggctatgaggtgatgtag

SEQ ID NO: 146802 - DNA, 402 bp, Artificial Sequence
  Description of Artificial Sequence: Synthetic coding sequence
atggctgtggagggcggcatgaagtgtgtgaagttcctgctgtatgtgctgctgctggccttctgtgcctgtgctgtgggcctgattgctgtgggcgtgggcgcccagctggtgctgagccagaccatcatccagggcgccaccccaggcagcctgctgcctgtggtgatcatcgctgtgggcgtcttcctgttcctggtggcctttgtgggctgctgcggggcctgcaaggagaactactgcctgatgatcacctttgccatcttcctgagcctcatcatgctggtggaggtggccgccgccatcgccggctacgtgttccgggacaaggtgatgtctgagttcaacaacaacttccggcagcagatggagaactaccccaagaacaaccacacagcctag

SEQ ID NO: 146803 - DNA, 717 bp, Artificial Sequence; identical to SEQ ID NO: 146800
  Description of Artificial Sequence: Synthetic coding sequence

SEQ ID NO: 146804 - DNA, 648 bp, Artificial Sequence
  Description of Artificial Sequence: Synthetic coding sequence
atggctgtggagggcggcatgaagtgtgtgaagttcctgctgtatgtgctgctgctggccttctgtgcctgtgctgtgggcctgattgctgtgggcgtgggcgcccagctggtgctgagccagaccatcatccagggcgccaccccaggcagcctgctgcctgtggtgatcatcgctgtgggcgtcttcctgttcctggtggcctttgtgggctgctgcggggcctgcaaggagaactactgcctgatgatcacctttgccatcttcctgagcctcatcatgctggtggaggtggccgccgccatcgccggctacgtgttccgggacaaggtgatgtctgagttcaacaacaacttccggcagcagatggagaactaccccaagaacaaccacacagccagcatcctggacaggatgcaggccgacttcaagtgctgcggggccgccaactacacagactgggagaagatccccagcatgagcaagaacagagtgcctgacagctgctgcatcaacgtgacagtgggctgcggcatcaacttcaatgagaaggccatccacaaggagggctgtgtggagaagattggaggctggctgaggaagaatgtgctggtggtggccgctgctgccctgggcatcgccttctag

SEQ ID NO: 146805 - DNA, 654 bp, Artificial Sequence
  Description of Artificial Sequence: Synthetic coding sequence
atggctgtggagggcggcatgaagtgtgtgaagttcctgctgtatgtgctgctgctggccttctgtgcctgtgctgtgggcctgattgctgtgggcgtgggcgcccagctggtgctgagccagaccatcatccagggcgccaccccaggcagcctgctgcctgtggtgatcatcgctgtgggcgtcttcctgttcctggtggcctttgtgggctgctgcggggcctgcaaggagaactactgcctgatgatcacctttgccatcttcctgagcctcatcatgctggtggaggtggccgccgccatcgccggctacgtgttccgggacaaggtgatgtctgagttcaacaacaacttccggcagcagatggagaactaccccaagaacaaccacacagccagcatcctggacaggatgcaggccgacttcaagtgctgcggggccgccaactacacagactgggagaagatccccagcatgagcaagaacagagtgcctgacagctgctgcatcaacgtgacagtgggctgcggcatcaacttcaatgagaaggccatccacaaggagggctgtgtggagaagattggaggctggctgaggaagaatgtgctggtggtggccgctgctgccctgggcatcgcctttgtggagtag

SEQ ID NO: 146806 - DNA, 717 bp, Artificial Sequence; identical to SEQ ID NO: 146800
  Description of Artificial Sequence: Synthetic coding sequence

SEQ ID NO: 146807 - DNA, 648 bp, Artificial Sequence
  Description of Artificial Sequence: Synthetic coding sequence
atggctgtggagggcggcatgaagtgtgtgaagttcctgctgtatgtgctgctgctggccttctgtggggccaccccaggcagcctgctgcctgtggtgatcatcgctgtgggcgtcttcctgttcctggtggcctttgtgggctgctgcggggcctgcaaggagaactactgcctgatgatcacctttgccatcttcctgagcctcatcatgctggtggaggtggccgccgccatcgccggctacgtgttccgggacaaggtgatgtctgagttcaacaacaacttccggcagcagatggagaactaccccaagaacaaccacacagccagcatcctggacaggatgcaggccgacttcaagtgctgcggggccgccaactacacagactgggagaagatccccagcatgagcaagaacagagtgcctgacagctgctgcatcaacgtgacagtgggctgcggcatcaacttcaatgagaaggccatccacaaggagggctgtgtggagaagattggaggctggctgaggaagaatgtgctggtggtggccgccgccgccctgggcatcgcctttgtggaggtgctgggcatcgtgtttgcctgctgcctggtgaagagcatccgcagcggctatgaggtgatgtag

SEQ ID NO: 146808 - DNA, 471 bp, Artificial Sequence
  Description of Artificial Sequence: Synthetic coding sequence
atgatcacctttgccatcttcctgagcctcatcatgctggtggaggtggccgccgccatcgccggctacgtgttccgggacaaggtgatgtctgagttcaacaacaacttccggcagcagatggagaactaccccaagaacaaccacacagccagcatcctggacaggatgcaggccgacttcaagtgctgcggggccgccaactacacagactgggagaagatccccagcatgagcaagaacagagtgcctgacagctgctgcatcaacgtgacagtgggctgcggcatcaacttcaatgagaaggccatccacaaggagggctgtgtggagaagattggaggctggctgaggaagaatgtgctggtggtggccgctgctgccctgggcatcgcctttgtggaggtgctgggcatcgtgtttgcctgctgcctggtgaagagcatccgcagcggctatgaggtgatgtag

SEQ ID NO: 146809 - DNA, 471 bp, Artificial Sequence; identical to SEQ ID NO: 146808
  Description of Artificial Sequence: Synthetic coding sequence

SEQ ID NO: 146810 - DNA, 1065 bp, Artificial Sequence
  Description of Artificial Sequence: Synthetic coding sequence
atgaggctggccgtgctcttcagcggggccctgctgggcctgctggccgcccagggcactggaaatgactgcccccacaagaagagcgccaccctgctgcccagcttcaccgtgacccccaccgtgacagagagcacaggcaccaccagccacaggaccaccaagagccacaagaccaccacccacaggaccaccaccaccggcaccaccagccacggccccaccacagccacccacaaccccaccaccaccagccacggcaatgtgacagtgcaccccaccagcaacagcacagccaccagccagggccccagcacagccacccacagccctgccaccaccagccacggcaatgccaccgtgcaccccaccagcaacagcacagccaccagccctggcttcaccagcagcgcccaccctgagcccccaccacccagccccagccccagccccaccagcaaggagaccatcggggactacacctggaccaacggcagccagccctgtgtgcacctgcaggcccagatccagatccgggtgatgtacaccacccagggcggcggggaggcctggggcatctctgtgctgaaccccaacaagaccaaggtgcagggcagctgtgagggcgcccacccccacctgctgctgtccttcccctacggccacctgagctttggcttcatgcaggacctgcagcagaaggtggtgtacctgagctacatggctgtggagtacaacgtgtccttcccccacgccgcccagtggaccttcagcgcccagaatgccagcctgcgggacctgcaggcccccctgggccagagcttcagctgcagcaacagcagcatcatcctgagccctgctgtgcacctggacctgctgagcctgcggctgcaggccgcccagctgccccacactggagtgtttggccagagcttcagctgccccagcgacaggagcatcctgctgcccctcatcatcggcctcatcctgctgggcctgctggccctggtgctgattgccttctgcatcatcagaagaagaccttctgcctaccaggccctgtag

SEQ ID NO: 146811 - DNA, 894 bp, Artificial Sequence
  Description of Artificial Sequence: Synthetic coding sequence
atgaggctggccgtgctcttcagcggggccctgctgggcctgctggccgagagcacaggcaccaccagccacaggaccaccaagagccacaagaccaccacccacaggaccaccaccaccggcaccaccagccacggccccaccacagccacccacaaccccaccaccaccagccatggaaatgccaccgtgcaccccaccagcaacagcacagccaccagccctggcttcaccagcagcgcccaccctgagcccccaccacccagccccagccccagccccaccagcaaggagaccatcggggactacacctggaccaacggcagccagccctgtgtgcacctgcaggcccagatccagatccgggtgatgtacaccacccagggcggcggggaggcctggggcatctctgtgctgaaccccaacaagaccaaggtgcagggcagctgtgagggcgcccacccccacctgctgctgtccttcccctacggccacctgagctttggcttcatgcaggacctgcagcagaaggtggtgtacctgagctacatggctgtggagtacaacgtgtccttcccccatgctgcccagtggaccttcagcgcccagaatgccagcctgcgggacctgcaggcccccctgggccagagcttcagctgcagcaacagcagcatcatcctgagccctgctgtgcacctggacctgctgagcctgcggctgcaggccgcccagctgccccacactggagtgtttggccagagcttcagctgccccagcgacaggagcatcctgctgcccctcatcatcggcctcatcctgctgggcctgctggccctggtgctgattgccttctgcatcatcagaagaagacccagcgcctaccaggccctgtag

SEQ ID NO: 146812 - DNA, 3018 bp, Artificial Sequence
  Description of Artificial Sequence: Synthetic coding sequence
atgatgtctgatgccagtgacatgctggccgccgccctggagcagatggatggcatcatcgccggcagcaaggccctggagtacagcaatggcatctttgactgccagagccccaccagccccttcatgggcagcctgcgggccctgcacctggtggaggacctgcggggcctgctggagatgatggagacagatgagaaggagggcctgcgctgccagatcccagacagcacagctgagaccctggtggagtggctgcagagccagatgaccaacggccacctgcctggaaatggagatgtgtaccaggagcggctggcccggctggagaatgacaaggagagcctggtgctgcaggtgtctgtgctgacagaccaggtggaggcccagggcgagaagatccgggacctggagttctgcctggaggagcaccgggagaaggtgaatgccacagaggagatgctgcagcaggagctgctgagcaggaccagcctggagacccagaagctggacctgatggccgagatcagcaacctgaagctgaagctgacagctgtggagaaggaccggctggactatgaggacaagttccgggacacagagggcctcatccaggagatcaatgacctgcggctgaaggtgtctgagatggattctgagcggctgcagtatgagaagaagctgaagagcaccaaggatgagctggccagcctgaaggagcagctggaggagaaggagagcgaggtgaagaggctgcaggagaagctggtgtgcaagatgaagggggagggcgtggagatcgtggacagagatgagaacttcaagaagaagctgaaggagaagaacatcgaggtgcagaagatgaagaaggctgtggagagcctgatggccgccaatgaggagaaggacaggaagattgaggacctgcggcagtgcctgaaccgctacaagaagatgcaggacacagtggtgctggcccagggcaagaagggcaaggatggagaatatgaggagctgctgaacagcagcagcatcagcagcctgctggatgcccagggcttcagtgacctggagaagagccccagccccacccctgtgatgggcagccccagctgtgaccccttcaacacctctgtgcctgaggagttccacaccaccatcctgcaggtgtccatccccagcctgctgcctgccaccgtgtccatggagaccagcgagaagagcaagctgacccccaagccagagaccagctttgaggagaatgatggcaacatcatcctgggcgccaccgtggacacccagctgtgtgacaagctgctgaccagcagcctgcagaagagcagcagcctgggcaacctgaagaaggagaccagtgatggagagaaggagaccatccagaagaccagcgaggaccgggccccagctgagagccggcccttcggcaccctgccccccaggcctcctggccaggacacctccatggatgacaaccccttcggcaccaggaaggtgcgcagcagctttggccggggcttcttcaagatcaagagcaacaagaggacagccagcgcccccaacctggacaggaagaggtctgccagcgcccccaccctggccgagacagagaaggagacagctgagcacctggacctggccggggccagcagccggcccaaggacagccagaggaacagccccttccagatccccccacccagcccagacagcaagaagaagagccggggcatcatgaagctgtttgggaagctgcggcgcagccagagcaccaccttcaacccagatgacatgtctgagcctgagttcaagagaggaggcacccgggccacagctggcccccggctgggctggagccgggacctgggccagagcaacagcgacctggacatgccctttgccaagtggaccaaggagcaggtgtgcaactggctgatggagcagggcctgggcagctacctgaacagcggcaagcactggatcgccagcggccagaccctgctgcaggccagccagcaggacctggagaaggagctgggcatcaagcacagcctgcacaggaagaagctgcagctggccctgcaggccctgggcagcgaggaggagaccaaccacggcaagctggacttcaactgggtgacccgctggctggatgacatcggcctgccccagtacaagacccagtttgatgagggccgggtggatggccgcatgctgcactacatgacagtggatgacctgctgagcctgaaggtggtgtctgtgctgcaccacctgagcatcaagagggccatccaggtgctgcgcatcaacaactttgagcccaactgcctgcggcggcggcccagtgatgagaacaccatcgcccccagcgaggtgcagaagtggaccaaccaccgggtgatggagtggctgcggtctgtggacctggccgagtatgcccccaacctgcggggcagcggcgtgcacggcggcctgatggtgctggagccccgcttcaacgtggagaccatggcccagctgctgaacatcccccccaacaagaccctgctgcggcggcacctggccacccacttcaacctgctgattggagctgaggcccagcaccagaagagagatgccatggagctgcctgactatgtgctgctgacagccacagccaaggtgaagcccaagaagctggccttcagcaactttggaaacctgaggaagaagaagcaggaggatggagaggagtatgtgtgccccatggagctgggccaggccagcggcagcgccagcaagaagggcttcaagccaggcctggacatgaggctgtatgaagaagatgacctggaccggctggagcagatggaggacagcgagggcaccgtgcggcagatcggggccttcagcgagggcatcaacaacctgacccacatgctgaaggaggatgacatgttcaaggactttgctgcccggagccccagcgccagcatcacagatgaggacagcaatgtgtag

SEQ ID NO: 146813 - DNA, 495 bp, Artificial Sequence
  Description of Artificial Sequence: Synthetic coding sequence
atgagcagcgagaactgctttgtggccgagaacagcagcctgcaccctgagagcggccaggagaatgatgccaccagcccccacttcagcaccaggcatgagggcagcttccaggtgcctgtgctgtgtgctgtgatgaatgtggtgttcatcaccatcctgatcatcgccctgattgccctgtctgtgggccagtacaactgccccggccagtacaccttctccatgcccagcgacagccacgtgagcagctgcagcgaggactgggtgggctaccagaggaagtgctacttcatcagcacagtgaagaggtcctggaccagcgcccagaatgcctgcagcgagcacggggccaccctggccgtgattgattctgagaaggacatgaacttcctgaagagatatgccggccgggaggagcactgggtgggcctgaagaaggagcccggccacccctggaagtggagcaatggcaaggagttcaacaactggtag

SEQ ID NO: 146814 - DNA, 723 bp, Artificial Sequence
  Description of Artificial Sequence: Synthetic coding sequence
atggccggccccccccggctgctgctgctgcccctgctgctggccctggcccggggcctgcccggggccctggccgcccaggaggtgcagcagagcccccactgcaccaccgtgcctgtgggcgcctctgtgaacatcacctgcagcaccagcggcggcctgcggggcatctacctgcggcagctgggcccccagccccaggacatcatctactatgaagatggagtggtgcccaccacagaccggcgcttccggggcagaattgacttcagcggcagccaggacaacctgaccatcaccatgcaccggctgcagctgagtgacaccggcacctacacctgccaggccatcacagaggtgaatgtgtatggcagcggcaccctggtgctggtgacagaggagcagagccagggctggcaccgctgcagtgatgccccaccccgggccagcgccctgcctgcccccccaactggaagtgccctgcctgacccccagacagccagcgccctgcctgaccccccagctgccagcgccctgcctgctgccctggccgtcatctccttcctgctgggcctgggcctgggcgtggcctgtgtgctggcccggacccagatcaagaagctgtgctcctggagggacaagaacagcgctgcctgtgtggtgtatgaggacatgagccacagccgctgcaacaccctgagcagccccaaccagtaccagtag

SEQ ID NO: 146815 - DNA, 1080 bp, Artificial Sequence
  Description of Artificial Sequence: Synthetic coding sequence
atggccgaggccatcacctacgccgacctgcgctttgtgaaggcccccctgaagaagagcatcagcagccggctgggccaggaccctggagcagatgatgatggagagatcacctatgaaaatgtgcaggtgcctgctgtgctgggcgtgcccagcagcctggccagctctgtgctgggggacaaggctgctgtgaagtctgagcagcccacagcctcctggagggctgtgaccagccctgctgtgggccgcatcctgccctgcaggaccacctgcctgcgctacctgctgctgggcctgctgctgacctgcctgctgctgggcgtgacagccatctgcctgggcgtgcgctacctgcaggtgtcccagcagctgcagcagaccaacagagtgctggaggtgaccaacagcagcctgcggcagcagctgcggctgaagatcacccagctgggccagagcgctgaggacctgcagggcagcagaagagagctggcccagagccaggaggccctgcaggtggagcagagggcccaccaggccgctgagggccagctgcaggcctgccaggccgaccggcagaagaccaaggagaccctgcagagcgaggagcagcagaggcgggccctggagcagaagctgagcaacatggagaaccggctgaagcccttcttcacctgtggcagcgctgacacctgctgccccagcggctggatcatgcaccagaagagctgcttctacatcagcctgaccagcaagaactggcaggagagccagaagcagtgtgagaccctgagcagcaagctggccaccttcagcgagatctacccccagagccacagctactacttcctgaacagcctgctgcccaacggcggcagcggcaacagctactggacaggcctgagcagcaacaaggactggaagctgacagatgacacccagaggaccaggacctacgcccagagcagcaagtgcaacaaggtgcacaagacctggagctggtggaccctggagagcgagagctgccgcagcagcctgccctacatctgtgagatgacagccttccgcttcccagactag

SEQ ID NO: 146816 - DNA, 363 bp, Artificial Sequence
  Description of Artificial Sequence: Synthetic coding sequence
atggccgaggccatcacctacgccgacctgcgctttgtgaaggcccccctgaagaagagcatcagcagccggctgggccaggaccctggagcagatgatgatggagagatcacctatgaaaatgtgcaggtgcctgctgtgctgggcgtgcccagcagcctggccagctctgtgctgggggacaaggctgctgtgaagtctgagcagcccacagcctcctggagggctgtgaccagccctgctgtgggccgcatcctgccctgtgaatgtgcctgtgccggccagccccggggccaggtgctggcccctgtgcctgctgctgatggagctggcccccggggcgtgcagctgctgcctggatag

SEQ ID NO: 146817 - DNA, 360 bp, Artificial Sequence
  Description of Artificial Sequence: Synthetic coding sequence
atggccgaggccatcacctacgccgacctgcgctttgtgaaggcccccctgaagaagagcatcagcagccggctgggccaggaccctggagcagatgatgatggagagatcacctatgaaaatgtgcaggtgcctgctgtgctgggcgtgcccagcagcctggccagctctgtgctgggggacaaggctgctgtgaagtctgagcagcccacagcctcctggagggctgtgaccagccctgctgtgggccgcatcctgccctgcaggaccacctgcctgcgctacctgctgctgggcctgctgctgacctgcctgctgctgggcgtgacagccatctgcctgggcgtgcgctgtgagtag

SEQ ID NO: 146818 - DNA, 1080 bp, Artificial Sequence; identical to SEQ ID NO: 146815
  Description of Artificial Sequence: Synthetic coding sequence

SEQ ID NO: 146819 - DNA, 1080 bp, Artificial Sequence
  Description of Artificial Sequence: Synthetic coding sequence
atgcagaccaggaacccccagagccatggagaaaatggagccagcccctggagctggggagaccggctgggccctggccctgaccctggagcagatgatgatggagagatcacctatgaaaatgtgcaggtgcctgctgtgctgggcgtgcccagcagcctggccagctctgtgctgggggacaaggctgctgtgaagtctgagcagcccacagcctcctggagggctgtgaccagccctgctgtgggccgcatcctgccctgcaggaccacctgcctgcgctacctgctgctgggcctgctgctgacctgcctgctgctgggcgtgacagccatctgcctgggcgtgcgctacctgcaggtgtcccagcagctgcagcagaccaacagagtgctggaggtgaccaacagcagcctgcggcagcagctgcggctgaagatcacccagctgggccagagcgctgaggacctgcagggcagcagaagagagctggcccagagccaggaggccctgcaggtggagcagagggcccaccaggccgctgagggccagctgcaggcctgccaggccgaccggcagaagaccaaggagaccctgcagagcgaggagcagcagaggcgggccctggagcagaagctgagcaacatggagaaccggctgaagcccttcttcacctgtggcagcgctgacacctgctgccccagcggctggatcatgcaccagaagagctgcttctacatcagcctgaccagcaagaactggcaggagagccagaagcagtgtgagaccctgagcagcaagctggccaccttcagcgagatctacccccagagccacagctactacttcctgaacagcctgctgcccaacggcggcagcggcaacagctactggacaggcctgagcagcaacaaggactggaagctgacagatgacacccagaggaccaggacctacgcccagagcagcaagtgcaacaaggtgcacaagacctggagctggtggaccctggagagcgagagctgccgcagcagcctgccctacatctgtgagatgacagccttccgcttcccagactag

SEQ ID NO: 146820 - DNA, 891 bp, Artificial Sequence
  Description of Artificial Sequence: Synthetic coding sequence
atgcacagaagaagaagccgcagctgccgggaggaccagaagcctgtgatggatgaccagagggacctgatcagcaacaatgagcagctgcccatgctgggcagaagacctggggcccctgagagcaagtgcagcagaggagccctgtacacaggcttcagcatcctggtgaccctgctgctggccggccaggccaccacagcctacttcctgtaccagcagcagggccgcctggacaagctgactgtgaccagccagaacctgcagctggagaacctgaggatgaagctgcccaagccacccaagcctgtgtccaagatgaggatggccacccccctgctgatgcaggccctgcccatgggcgccctgccccagggccccatgcagaatgccaccaagtatggcaacatgacagaagatcatgtgatgcacctgctgcagaatgctgaccccctgaaggtgtacccacccctgaagggcagcttccctgagaacctgcggcacctgaagaacaccatggagaccatcgactggaaggtgtttgagagctggatgcaccactggctgctgtttgagatgagccgccacagcctggagcagaagcccacagatgccccacccaaggtgctgaccaagtgccaggaggaggtgagccacatcccagctgtgcaccctggcagcttccggcccaagtgtgatgaaaatggaaactacctgcccctgcagtgctacggcagcatcggctactgctggtgtgtgttccccaacggcacagaggtgcccaacaccaggagccggggccaccacaactgcagcgagagcctggagctggaggaccccagcagcggcctgggcgtgaccaagcaggacctgggccctgtgcccatgtag

SEQ ID NO: 146821 - DNA, 699 bp, Artificial Sequence
  Description of Artificial Sequence: Synthetic coding sequence
atgcacagaagaagaagccgcagctgccgggaggaccagaagcctgtgatggatgaccagagggacctgatcagcaacaatgagcagctgcccatgctgggcagaagacctggggcccctgagagcaagtgcagcagaggagccctgtacacaggcttcagcatcctggtgaccctgctgctggccggccaggccaccacagcctacttcctgtaccagcagcagggccgcctggacaagctgactgtgaccagccagaacctgcagctggagaacctgaggatgaagctgcccaagccacccaagcctgtgtccaagatgaggatggccacccccctgctgatgcaggccctgcccatgggcgccctgccccagggccccatgcagaatgccaccaagtatggcaacatgacagaagatcatgtgatgcacctgctgcagaatgctgaccccctgaaggtgtacccacccctgaagggcagcttccctgagaacctgcggcacctgaagaacaccatggagaccatcgactggaaggtgtttgagagctggatgcaccactggctgctgtttgagatgagccgccacagcctggagcagaagcccacagatgccccacccaaggagagcctggagctggaggaccccagcagcggcctgggcgtgaccaagcaggacctgggccctgtgcccatgtag

SEQ ID NO: 146822 - DNA, 483 bp, Artificial Sequence
  Description of Artificial Sequence: Synthetic coding sequence
atgcacagaagaagaagccgcagctgccgggaggaccagaagcctgtgatggatgaccagagggacctgatcagcaacaatgagcagctgcccatgctgggcagaagacctggggcccctgagagcaagtgcagcagaggagccctgtacacaggcttcagcatcctggtgaccctgctgctggccggccaggccaccacagcctacttcctgtaccagcagcagggccgcctggacaagctgactgtgaccagccagaacctgcagctggagaacctgaggatgaagctgcccaagccacccaagcctgtgtccaagatgaggatggccacccccctgctgatgcaggccctgcccatgggcgccctgccccagggccccatgcagaatgccaccaagtatggcaacatgacagaagatcatgtgatgcacctgctgcagagccactggaactggaggacccggctgctgggctgggtgtag

SEQ ID NO: 146823 - DNA, 951 bp, Artificial Sequence
  Description of Artificial Sequence: Synthetic coding sequence
tgaagaagctgccgggaggaccagaagcctgtgatggatgaccagagggacctgatcagcaacaatgagcagctgcccatgctgggccggcggcctggggcccctgagagcaagtgcagcagaggagccctgtacacaggcttcagcatcctggtgaccctgctgctggccggccaggccaccacagcctacttcctgtaccagcagcagggccgcctggacaagctgactgtgaccagccagaacctgcagctggagaacctgaggatgaagctgcccaagccacccaagcctgtgtccaagatgaggatggccacccccctgctgatgcaggccctgcccatgggcgccctgccccagggccccatgcagaatgccaccaagtatggcaacatgacagaggaccacgtgatgcacctgctgcagaatgctgaccccctgaaggtgtacccacccctgaagggcagcttccctgagaacctgcggcacctgaagaacaccatggagaccatcgactggaaggtgtttgagagctggatgcaccactggctgctgtttgagatgagccgccacagcctggagcagaagcccacagatgccccacccaaggtgctgaccaagtgccaggaggaggtgagccacatcccagctgtgcaccctggcagcttccggcccaagtgtgatgaaaatggaaactacctgcccctgcagtgctacggcagcatcggctactgctggtgtgtgttccccaatggaacagaggtgcccaacaccaggagccggggccaccacaactgcagcgagagcctggagctggaggaccccagcagcggcctgggcgtgaccaagcaggacctgggccctgggaagggcctggccgagggccacctggtgaccagcagcagcagccctgctggccctgcccccctgtgggccggggagggcgtgtag

SEQ ID NO: 146824 - DNA, 369 bp, Artificial Sequence
  Description of Artificial Sequence: Synthetic coding sequence
atgcacagaagaagaagccgcagctgccgggaggaccagaagcctgtgatggatgaccagagggacctgatcagcaacaatgagcagctgcccatgctgggcagaagacctggggcccctgagagcaagtgcagcagaggagccctgtacacaggcttcagcatcctggtgaccctgctgctggccggccaggccaccacagcctacttcctgtaccagcagcagggccgcctggacaagctgactgtgaccagccagaacctgcagctggagaacctgaggatgaagctgcccaagccccatgctgagtgccaccaggtgtggcagcacgaccggggcccctgtgatgccccagccccagaatgttag

SEQ ID NO: 146825 - DNA, 459 bp, Artificial Sequence
  Description of Artificial Sequence: Synthetic coding sequence
atgcacagaagaagaagccgcagctgccgggaggaccagaagcctgtgatggatgaccagagggacctgatcagcaacaatgagcagctgcccatgctgggcagaagacctggggcccctgagagcaagtgcagcagaggagccctgtacacaggcttcagcatcctggtgaccctgctgctggccggccaggccaccacagcctacttcctgtaccagcagcagggccgcctggacaagctgactgtgaccagccagaacctgcagctggagaacctgaggatgaagctgcccaagccacccaagcctgtgtccaagatgaggatggccacccccctgctgatgcaggccctgcccatgggcgccctgccccagggccccatgcagaatgccaccaagtatggcaacatgacagaagatcatgtgatgcacctgctgcaggaggtggccaagagctag

SEQ ID NO: 146826 - DNA, 690 bp, Artificial Sequence
  Description of Artificial Sequence: Synthetic coding sequence
atggcccggctggccctgagccctgtgcccagccactggatggtggccctgctgctgctgctgtctgctgagcctgtgcctgctgcccggtctgaggaccgctacagaaaccccaagggcagcgcctgcagccgcatctggcagagcccccgcttcatcgccaggaagaggggcttcaccgtgaagatgcactgctacatgaacagcgccagcggaaatgtgtcctggctgtggaagcaggagatggatgagaacccccagcagctgaagctggagaagggccgcatggaggagagccagaatgaaagcctggccaccctgaccatccagggcatccgctttgaagataatggcatctacttctgccagcagaagtgcaacaacaccagcgaggtgtaccagggctgcggcacagagctgcgggtgatgggcttcagcaccctggcccagctgaagcagaggaacaccctgaaggatggcatcatcatgatccagaccctgctgatcatcctcttcatcatcgtgcccatcttcctgctgctggacaaggatgacagcaaggccggcatggaggaggaccacacctatgagggcctggacatcgaccagacagccacctatgaggacatcgtgaccctgaggactggagaggtgaagtggagcgtgggggagcaccctggccaggagtag

SEQ ID NO: 146827 - DNA, 378 bp, Artificial Sequence
  Description of Artificial Sequence: Synthetic coding sequence
atggcccggctggccctgagccctgtgcccagccactggatggtggccctgctgctgctgctgtctgctgagcctgtgcctgctgcccggtctgaggaccgctacagaaaccccaagggcttcagcaccctggcccagctgaagcagaggaacaccctgaaggatggcatcatcatgatccagaccctgctgatcatcctcttcatcatcgtgcccatcttcctgctgctggacaaggatgacagcaaggccggcatggaggaggaccacacctatgagggcctggacatcgaccagacagccacctatgaggacatcgtgaccctgaggactggagaggtgaagtggagcgtgggggagcaccctggccaggagtag

SEQ ID NO: 146828 - DNA, 693 bp, Artificial Sequence
  Description of Artificial Sequence: Synthetic coding sequence
atggcccggctggccctgagccctgtgcccagccactggatggtggccctgctgctgctgctgtctgctgctgagcctgtgcctgctgcccggagtgaagatcgctacagaaaccccaagggcagcgcctgcagccgcatctggcagagcccccgcttcatcgccaggaagaggggcttcaccgtgaagatgcactgctacatgaacagcgccagcggaaatgtgtcctggctgtggaagcaggagatggatgagaacccccagcagctgaagctggagaagggccgcatggaggagagccagaatgaaagcctggccaccctgaccatccagggcatccgctttgaggacaatggcatctacttctgccagcagaagtgcaacaacaccagcgaggtgtaccagggctgcggcacagagctgcgggtgatgggcttcagcaccctggcccagctgaagcagaggaacaccctgaaggatggcatcatcatgatccagaccctgctgatcatcctcttcatcatcgtgcccatcttcctgctgctggacaaggatgacagcaaggccggcatggaggaggaccacacctatgagggcctggacatcgaccagacagccacctatgaagatattgtgaccctgaggactggagaggtgaagtggagcgtgggggagcaccctggccaggagtag

SEQ ID NO: 146829 - DNA, 711 bp, Artificial Sequence
  Description of Artificial Sequence: Synthetic coding sequence
atgggcgtggagggctgcaccaagtgcatcaagtacctgctgtttgtgttcaactttgtgttctggctggccggcggcgtcatcctgggcgtggccctgtggctgcggcatgacccccagaccaccaacctgctgtacctggagctgggggacaagccagcccccaacaccttctacgtgggcatctacatcctgattgctgtgggcgctgtgatgatgtttgtgggcttcctgggctgctatggagccatccaggagagccagtgcctgctgggcaccttcttcacctgcctggtgatcctgtttgcctgtgaggtggccgccggcatctggggctttgtgaacaaggaccagatcgccaaggatgtgaagcagttctatgaccaggccctgcagcaggccgtggtggatgatgatgccaacaatgccaaggctgtggtgaagaccttccacgagaccctggactgctgcggcagcagcaccctgacagccctgaccacctctgtgctgaagaacaacctgtgccccagcggcagcaacatcatcagcaacctcttcaaggaggactgccaccagaagattgatgacctcttcagcggcaagctgtacctgattggaattgctgccatcgtggtggccgtcatcatgatctttgagatgatcctgtccatggtgctgtgctgcggcatccggaacagctctgtgtactag

SEQ ID NO: 146830 - DNA, 618 bp, Artificial Sequence
  Description of Artificial Sequence: Synthetic coding sequence
atgagccggggcctgcagctgctgctgctgagctgtgcctacagcctggccccagccaccccagaggtgaaggtggcctgcagtgaagatgtggacctgccctgcacagccccctgggacccccaggtgccctacacagtgtcctgggtgaagctgctggagggcggggaggagaggatggagaccccccaggaggaccacctgcggggccagcactaccaccagaagggccagaatggcagctttgatgccccaaatgaaagaccctacagcctgaagatccggaacaccaccagctgcaacagcggcacctaccgctgcaccctgcaggaccctgatggccagaggaacctgagcggcaaggtgatcctgcgggtgacaggctgcccagcccagaggaaggaggagaccttcaagaagtacagagctgagatcgtgctgctgctggccctggtgatcttctacctgaccctcatcatcttcacctgcaagtttgcccggctgcagagcatcttcccagacttcagcaaggccggcatggagcgggccttcctgcctgtgaccagccccaacaagcacctgggcctggtgaccccccacaagacagagctggtgtag

SEQ ID NO: 146831 - DNA, 351 bp, Artificial Sequence
  Description of Artificial Sequence: Synthetic coding sequence
atggacccccagtgcaccatgggcctgagcaacatcctgtttgtgatggccttcctgctgtctgagctggaggacccccagcccccaccagaccacatcccctggatcacagctgtgctgcccaccgtcatcatctgtgtgatggtgttctgcctgatcctgtggaagtggaagaagaagaagaggcccaggaacagctacaagtgtggcaccaacaccatggagcgggaggagagcgagcagaccaagaagcgggagaagatccacatccctgagaggagtgatgaggcccagagggtcttcaagagcagcaagaccagcagctgtgacaagagtgacacctgcttctag

SEQ ID NO: 146832 - DNA, 990 bp, Artificial Sequence
  Description of Artificial Sequence: Synthetic coding sequence
atggacccccagtgcaccatgggcctgagcaacatcctgtttgtgatggccttcctgctgtctggagctgcccccctgaagatccaggcctacttcaatgaaacagctgacctgccctgccagtttgccaacagccagaaccagagcctgtctgagctggtggtgttctggcaggaccaggagaacctggtgctgaatgaggtgtacctgggcaaggagaagtttgattctgtgcacagcaagtacatgggccgcaccagctttgacagcgacagctggaccctgcggctgcacaacctgcagatcaaggacaagggcctgtaccagtgcatcatccaccacaagaagcccaccggcatgatccgcatccaccagatgaacagcgagctgtctgtgctggccaacttcagccagcctgagatcgtgcccatcagcaacatcacagaaaatgtgtacatcaacctgacctgcagcagcatccacggctacccagagcccaagaagatgtctgtgctgctgcggaccaagaacagcaccatcgagtatgatggagtgatgcagaagagccaggacaacgtgacagagctgtatgatgtgtccatcagcctgtctgtgtccttcccagatgtgaccagcaacatgaccatcttctgcatcctggagacagacaagacccggctgctgagcagccccttcagcattgagctggaggacccccagcccccaccagaccacatcccctggatcacagctgtgctgcccaccgtcatcatctgtgtgatggtgttctgcctgatcctgtggaagtggaagaagaagaagaggcccagaaattcctacaagtgtggcaccaacaccatggagcgggaggagagcgagcagaccaagaagcgggagaagatccacatccctgagaggagtgatgaggcccagagggtcttcaagagcagcaagaccagcagctgtgacaagagtgacacctgcttctag

SEQ ID NO: 146833 - DNA, 972 bp, Artificial Sequence
  Description of Artificial Sequence: Synthetic coding sequence
atgggcctgagcaacatcctgtttgtgatggccttcctgctgtctggagctgcccccctgaagatccaggcctacttcaatgaaacagctgacctgccctgccagtttgccaacagccagaaccagagcctgtctgagctggtggtgttctggcaggaccaggagaacctggtgctgaatgaggtgtacctgggcaaggagaagtttgattctgtgcacagcaagtacatgggccgcaccagctttgacagcgacagctggaccctgcggctgcacaacctgcagatcaaggacaagggcctgtaccagtgcatcatccaccacaagaagcccaccggcatgatccgcatccaccagatgaacagcgagctgtctgtgctggccaacttcagccagcctgagatcgtgcccatcagcaacatcacagaaaatgtgtacatcaacctgacctgcagcagcatccacggctacccagagcccaagaagatgtctgtgctgctgcggaccaagaacagcaccatcgagtatgatggagtgatgcagaagagccaggacaacgtgacagagctgtatgatgtgtccatcagcctgtctgtgtccttcccagatgtgaccagcaacatgaccatcttctgcatcctggagacagacaagacccggctgctgagcagccccttcagcattgagctggaggacccccagcccccaccagaccacatcccctggatcacagctgtgctgcccaccgtcatcatctgtgtgatggtgttctgcctgatcctgtggaagtggaagaagaagaagaggcccagaaattcctacaagtgtggcaccaacaccatggagcgggaggagagcgagcagaccaagaagcgggagaagatccacatccctgagaggagtgatgaggcccagagggtcttcaagagcagcaagaccagcagctgtgacaagagtgacacctgcttctag

SEQ ID NO: 146834 - DNA, 504 bp, Artificial Sequence
  Description of Artificial Sequence: Synthetic coding sequence
atgggcctgagcaacatcctgtttgtgatggccttcctgctgtctggagctgcccccctgaagatccaggcctacttcaatgaaacagctgacctgccctgccagtttgccaacagccagaaccagagcctgtctgagctggtggtgttctggcaggaccaggagaacctggtgctgaatgaggtgtacctgggcaaggagaagtttgattctgtgcacagcaagtacatgggccgcaccagctttgacagcgacagctggaccctgcggctgcacaacctgcagatcaaggacaagggcctgtaccagtgcatcatccaccacaagaagcccaccggcatgatccgcatccaccagatgaacagcgagctgtctgtgctggccaacttcagccagcctgagatcgtgcccatcagcaacatcacagaaaatgtgtacatcaacctgacctgcagcagcatccacggctacccagagcccaagaagatgtctgtgctgctgtag

SEQ ID NO: 146835 - DNA, 744 bp, Artificial Sequence
  Description of Artificial Sequence: Synthetic coding sequence
atgggccgcaccagctttgacagcgacagctggaccctgcggctgcacaacctgcagatcaaggacaagggcctgtaccagtgcatcatccaccacaagaagcccaccggcatgatccgcatccaccagatgaacagcgagctgtctgtgctggccaacttcagccagcctgagatcgtgcccatcagcaacatcacagaaaatgtgtacatcaacctgacctgcagcagcatccacggctacccagagcccaagaagatgtctgtgctgctgcggaccaagaacagcaccatcgagtatgatggagtgatgcagaagagccaggacaacgtgacagagctgtatgatgtgtccatcagcctgtctgtgtccttcccagatgtgaccagcaacatgaccatcttctgcatcctggagacagacaagacccggctgctgagcagccccttcagcattgagctggaggacccccagcccccaccagaccacatcccctggatcacagctgtgctgcccaccgtcatcatctgtgtgatggtgttctgcctgatcctgtggaagtggaagaagaagaagaggcccagaaattcctacaagtgtggcaccaacaccatggagcgggaggagagcgagcagaccaagaagcgggagaagatccacatccctgagaggagtgatgaggcccagagggtcttcaagagcagcaagaccagcagctgtgacaagagtgacacctgcttctag

SEQ ID NO: 146836 - DNA, 654 bp, Artificial Sequence
  Description of Artificial Sequence: Synthetic coding sequence
atggacccccagtgcaccatgggcctgagcaacatcctgtttgtgatggccttcctgctgagcgccaacttcagccagcctgagatcgtgcccatcagcaacatcacagaaaatgtgtacatcaacctgacctgcagcagcatccacggctacccagagcccaagaagatgtctgtgctgctgcggaccaagaacagcaccatcgagtatgatggagtgatgcagaagagccaggacaacgtgacagagctgtatgatgtgtccatcagcctgtctgtgtccttcccagatgtgaccagcaacatgaccatcttctgcatcctggagacagacaagacccggctgctgagcagccccttcagcattgagctggaggacccccagcccccaccagaccacatcccctggatcacagctgtgctgcccaccgtcatcatctgtgtgatggtgttctgcctgatcctgtggaagtggaagaagaagaagaggcccagaaattcctacaagtgtggcaccaacaccatggagcgggaggagagcgagcagaccaagaagcgggagaagatccacatccctgagaggagtgatgaggcccagagggtcttcaagagcagcaagaccagcagctgtgacaagagtgacacctgcttctag

SEQ ID NO: 146837 - DNA, 732 bp, Artificial Sequence
  Description of Artificial Sequence: Synthetic coding sequence
atgaggccccggctgtggctgctgctggccgcccagctgactgtgctgcacggcaacagcgtgctgcagcagaccccagcctacatcaaggtgcagaccaacaagatggtgatgctgagctgtgaggccaagatcagcctgagcaacatgaggatctactggctgcggcagaggcaggcccccagcagtgacagccaccacgagttcctggccctgtgggacagcgccaagggcaccatccatggagaggaggtggagcaggagaagattgctgtgttcagagatgccagccgcttcatcctgaacctgacctctgtgaagccagaagattctggcatctacttctgcatgattgtgggcagccctgagctgaccttcggcaagggcacccagctgtctgtggtggacttcctgcccaccacagcccagcccaccaagaagagcaccctgaagaagagggtgtgccgcctgcccaggcctgagacccagaagggccccctgtgcagccccatcaccctgggcctgctggtggccggcgtgctggtgctgctggtgtccctgggcgtggccatccacctgtgctgcagaagaagaagagcccggctgcgcttcatgaagcagccccagggcgagggcatcagcggcacctttgtgccccagtgcctgcacggctactacagcaacaccaccaccagccagaagctgctgaacccctggatcctgaagacctag

SEQ ID NO: 146838 - DNA, 642 bp, Artificial Sequence
  Description of Artificial Sequence: Synthetic coding sequence
atgaggccccggctgtggctgctgctggccgcccagctgactgtgctgcacggcaacagcgtgctgcagcagaccccagcctacatcaaggtgcagaccaacaagatggtgatgctgagctgtgaggccaagatcagcctgagcaacatgaggatctactggctgcggcagaggcaggcccccagcagtgacagccaccacgagttcctggccctgtgggacagcgccaagggcaccatccatggagaggaggtggagcaggagaagattgctgtgttcagagatgccagccgcttcatcctgaacctgacctctgtgaagccagaagattctggcatctacttctgcatgattgtgggcagccctgagctgaccttcggcaagggcacccagctgtctgtggtggacttcctgcccaccacagcccagcccaccaagaagagcaccctgaagaagagggtgtgccgcctgcccaggcctgagacccagaagggcagaagaagaagagcccggctgcgcttcatgaagcagccccagggcgagggcatcagcggcacctttgtgccccagtgcctgcacggctactacagcaacaccaccaccagccagaagctgctgaacccctggatcctgaagacctag

SEQ ID NO: 146839 - DNA, 633 bp, Artificial Sequence
  Description of Artificial Sequence: Synthetic coding sequence
atgaggccccggctgtggctgctgctggccgcccagctgactgtgctgcacggcaacagcgtgctgcagcagaccccagcctacatcaaggtgcagaccaacaagatggtgatgctgagctgtgaggccaagatcagcctgagcaacatgaggatctactggctgcggcagaggcaggcccccagcagtgacagccaccacgagttcctggccctgtgggacagcgccaagggcaccatccatggagaggaggtggagcaggagaagattgctgtgttcagagatgccagccgcttcatcctgaacctgacctctgtgaagccagaagattctggcatctacttctgcatgattgtgggcagccctgagctgaccttcggcaagggcacccagctgtctgtggtggacttcctgcccaccacagcccagcccaccaagaagagcaccctgaagaagagggtgtgccgcctgcccaggcctgagacccagaagggccccctgtgcagccccatcaccctgggcctgctggtggccggcgtgctggtgctgctggtgtccctgggcgtggccatccacctgtgctgcagaagaagaagagcccggctgcgcttcatgaagcagttctacaagtag

SEQ ID NO: 146840 - DNA, 666 bp, Artificial Sequence
  Description of Artificial Sequence: Synthetic coding sequence
atgaggccccggctgtggctgctgctggccgcccagctgactgtgctgcacggcaacagcgtgctgcagcagaccccagcctacatcaaggtgcagaccaacaagatggtgatgctgagctgtgaggccaagatcagcctgagcaacatgaggatctactggctgcggcagaggcaggcccccagcagtgacagccaccacgagttcctggccctgtgggacagcgccaagggcaccatccatggagaggaggtggagcaggagaagattgctgtgttcagagatgccagccgcttcatcctgaacctgacctctgtgaagccagaagattctggcatctacttctgcatgattgtgggcagccctgagctgaccttcggcaagggcacccagctgtctgtggtggacttcctgcccaccacagcccagcccaccaagaagagcaccctgaagaagagggtgtgccgcctgcccaggcctgagacccagaagggccccctgtgcagccccatcaccctgggcctgctggtggccggcgtgctggtgctgctggtgtccctgggcgtggccatccacctgtgctgcagaagaagaagagcccggctgcgcttcatgaagcagctgcggctgcaccccctggagaagtgcagcaggatggactactag

SEQ ID NO: 146841 - DNA, 597 bp, Artificial Sequence
  Description of Artificial Sequence: Synthetic coding sequence
atgaggccccggctgtggctgctgctggccgcccagctgactgtgctgcacggcaacagcgtgctgcagcagaccccagcctacatcaaggtgcagaccaacaagatggtgatgctgagctgtgaggccaagatcagcctgagcaacatgaggatctactggctgcggcagaggcaggcccccagcagtgacagccaccacgagttcctggccctgtgggacagcgccaagggcaccatccatggagaggaggtggagcaggagaagattgctgtgttcagagatgccagccgcttcatcctgaacctgacctctgtgaagccagaagattctggcatctacttctgcatgattgtgggcagccctgagctgaccttcggcaagggcacccagctgtctgtggtggacttcctgcccaccacagcccagcccaccaagaagagcaccctgaagaagagggtgtgccgcctgcccaggcctgagacccagaagggcctgaagggcaaggtgtaccaggagcccctgagccccaatgcctgcatggacaccacagccatcctgcagccccacaggagctgcctgacccacggcagctag

SEQ ID NO: 146842 - DNA, 93 bp, Artificial Sequence
  Description of Artificial Sequence: Synthetic coding sequence
atgaggccccggctgtggctgctgctggccgcccagctgaccggcagaagaagaagagcccggctgcgcttcatgaagcagctgtacaagtag

SEQ ID NO: 146843 - DNA, 624 bp, Artificial Sequence
  Description of Artificial Sequence: Synthetic coding sequence
atgaggccccggctgtggctgctgctggccgcccagctgactgtgctgcacggcaacagcgtgctgcagcagaccccagcctacatcaaggtgcagaccaacaagatggtgatgctgagctgtgaggccaagatcagcctgagcaacatgaggatctactggctgcggcagaggcaggcccccagcagtgacagccaccacgagttcctggccctgtgggacagcgccaagggcaccatccatggagaggaggtggagcaggagaagattgctgtgttcagagatgccagccgcttcatcctgaacctgacctctgtgaagccagaagattctggcatctacttctgcatgattgtgggcagccctgagctgaccttcggcaagggcacccagctgtctgtggtggacttcctgcccaccacagcccagcccaccaagaagagcaccctgaagaagagggtgtgccgcctgcccaggcctgagacccagaagggccccctgtgcagccccatcaccctgggcctgctggtggccggcgtgctggtgctgctggtgtccctgggcgtggccatccacctgtgctgcagaagaagaagagcccggctgcgcttcatgaagcagtag

SEQ ID NO: 146844 - DNA, 153 bp, Artificial Sequence
  Description of Artificial Sequence: Synthetic coding sequence
gagcggggccgggagcggcgggtgaagctgcgcttcagcgcccggccccagggcgagggcatcagcggcacctttgtgccccagtgcctgcacggctactacagcaacaccaccaccagccagaagctgctgaacccctggatcctgaagtag

SEQ ID NO: 146845 - DNA, 687 bp, Artificial Sequence
  Description of Artificial Sequence: Synthetic coding sequence
atgcctgtgaagggcggcaccaagtgcatcaagtacctgctgtttggcttcaacttcatcttctggctggccggcattgctgtgctggccatcggcctgtggctgcgctttgacagccagaccaagagcatctttgagcaggagaccaacaacaacaacagcagcttctacacaggagtgtacatcctgattggagctggggccctgatgatgctggtgggcttcctgggctgctgcggggctgtgcaggagagccagtgcatgctgggcctcttcttcggcttcctgctggtgatctttgccatcgagattgctgctgccatctggggctacagccacaaggatgaagtcatcaaggaggtgcaggagttctacaaggacacctacaacaagctgaagaccaaggatgagccccagcgggagaccctgaaggccatccactacgccctgaactgctgcggcctggccggcggcgtggagcagttcatcagtgacatctgccccaagaaggatgtgctggagaccttcaccgtgaagagctgcccagatgccatcaaggaggtgtttgacaacaagttccacatcatcggggctgtgggcattggaattgctgtggtgatgatcttcggcatgatcttctccatgatcctgtgctgtgccatcagaagaaaccgggagatggtgtag

SEQ ID NO: 146846 - DNA, 480 bp, Artificial Sequence
  Description of Artificial Sequence: Synthetic coding sequence
atgatgctggtgggcttcctgggctgctgcggggctgtgcaggagagccagtgcatgctgggcctcttcttcggcttcctgctggtgatctttgccattgaaattgctgctgccatctggggctacagccacaaggatgaggtgatcaaggaggtgcaggagttctacaaggacacctacaacaagctgaagaccaaggatgagccccagcgggagaccctgaaggccatccactacgccctgaactgctgcggcctggccggcggcgtggagcagttcatcagtgacatctgccccaagaaggatgtgctggagaccttcaccgtgaagagctgcccagatgccatcaaggaggtgtttgacaacaagttccacatcattggagctgtgggcatcggcattgctgtggtgatgatcttcggcatgatcttctccatgatcctgtgctgtgccatcagaagaaaccgggagatggtgtag

SEQ ID NO: 146847 - DNA, 687 bp, Artificial Sequence; identical to SEQ ID NO: 146845
  Description of Artificial Sequence: Synthetic coding sequence

SEQ ID NO: 146848 - DNA, 687 bp, Artificial Sequence
  Description of Artificial Sequence: Synthetic coding sequence
atgcctgtgaagggcggcaccaagtgcatcaagtacctgctgtttggcttcaacttcatcttctggctggccggcattgctgtgctggccatcggcctgtggctgcgctttgacagccagaccaagagcatctttgagcaggagaccaacaacaacaacagcagcttctacacaggagtgtacatcctgattggagctggggccctgatgatgctggtgggcttcctgggctgctgcggggctgtgcaggagagccagtgcatgctgggcctggccaccaagaggaccatgtttcctcccttcctggaggaccacgtgtgcttcttcagcctgaacccccagttcttcggcttcctgctggtgatctttgccattgaaattgctgctgccatctggggctacagccacaaggatgaggtgatcaaggaggtgcaggagttctacaaggacacctacaacaagctgaagaccaaggatgagccccagcgggagaccctgaaggccatccactacgccctgaactgctgcggcctggccggcggcgtggagcagttcatcagtgacatctgccccaagaaggatgtgctggagaccttcaccgtgaagagctgcccagatgccatcaaggaggtgtttgacaacaagttccacatcattggagctgtgggcatcggcattgctgtgtag

SEQ ID NO: 146849 - DNA, 546 bp, Artificial Sequence
  Description of Artificial Sequence: Synthetic coding sequence
atgcctgtgaagggcggcaccaagtgcatcaagtacctgctgtttggcttcaacttcatcttctggctggccggcattgctgtgctggccatcggcctgtggctgcgctttgacagccagaccaagagcatctttgagcaggagaccaacaacaacaacagcagcttctacacaggagtgtacatcctgattggagctggggccctgatgatgctggtgggcttcctgggctgctgcggggctgtgcaggagagccagtgcatgctgggcctcttcttcggcttcctgctggtgatctttgccatcgagattgctgctgccatctggggctacagccacaaggatgaagtcatcaaggaggtgcaggagttctacaaggacacctacaacaagctgaagaccaaggatgagccccagcgggagaccctgaaggccatccactacgccctgaacctgtggtttggctggggccggggcaccgtgtacctgcggcacctgccccaggagggccgcaccaggaacctgcaccgggaggtgctgtcctag

SEQ ID NO: 146850 - DNA, 426 bp, Artificial Sequence
  Description of Artificial Sequence: Synthetic coding sequence
atgctgggcctcttcttcggcttcctgctggtgatctttgccattgaaattgctgctgccatctggggctacagccacaaggatgaggtgatcaaggaggtgcaggagttctacaaggacacctacaacaagctgaagaccaaggatgagccccagcgggagaccctgaaggccatccactacgccctgaactgctgcggcctggccggcggcgtggagcagttcatcagtgacatctgccccaagaaggatgtgctggagaccttcaccgtgaagagctgcccagatgccatcaaggaggtgtttgacaacaagttccacatcattggagctgtgggcatcggcattgctgtggtgatgatcttcggcatgatcttctccatgatcctgtgctgtgccatcagaagaaaccgggagatggtgtag

SEQ ID NO: 146851 - DNA, 1758 bp, Artificial Sequence
  Description of Artificial Sequence: Synthetic coding sequence
atggagaagaagtggaagtactgtgctgtgtactacatcatccagatccactttgtgaagggcgtgtgggagaagacagtgaacacagaagaaaatgtgtatgccaccctgggcagtgatgtgaacctgacctgccagacccagacagtgggcttctttgtgcagatgcagtggagcaaggtgaccaacaagattgacctgattgctgtgtaccacccccagtatggcttctactgtgcctacggccggccctgtgagagcctggtgaccttcacagagaccccagaaaatggcagcaagtggaccctgcacctgaggaacatgagctgcagcgtgtctggccgctatgagtgcatgctggtgctgtacccagagggcatccagaccaagatctacaacctgctgatccagacccacgtgacagcagatgagtggaacagcaaccacaccattgaaattgagatcaaccagaccctggagatcccctgcttccagaacagcagcagcaagatcagcagcgagttcacctacgcctggagcgtggagaacagcagcacagacagctgggtgctgctgagcaagggcatcaaggaggacaatggcacccaggagaccctcatcagccagaaccacctgatcagcaacagcaccctgctgaaggacagagtgaagctgggcacagactaccgcctgcacctgagccctgtgcagatctttgatgatggcaggaagttcagctgccacatccgggtgggccccaacaagatcctgcggagcagcaccaccgtgaaggtgtttgccaagccagagatccctgtgattgtggagaacaacagcacagatgtgctggtggagcggcgcttcacctgcctgctgaagaatgtgttccccaaggccaacatcacctggttcattgatggcagcttcctgcatgatgagaaggagggcatctacatcaccaatgaggagaggaagggcaaggatggcttcctggagctgaagtctgtgctgaccagggtgcacagcaacaagccagcccagagcgacaacctgaccatctggtgcatggccctgagccctgtgcccggcaacaaggtgtggaacatcagcagcgagaagatcaccttcctgctgggcagcgagatcagcagcacagatcctcccctgtctgtgacagagagcaccctggacacccagcccagccctgccagctctgtgtccccagcccgctacccagccaccagctctgtgaccctggtggatgtgtctgccctgcggcccaacaccaccccccagcccagcaacagctccatgaccacccggggcttcaactacccctggaccagcagcggcacagacaccaagaagtctgtgagccgcatccccagcgagacctacagcagcagccccagcggggccggcagcaccctgcatgacaacgtgttcaccagcacagcccgggccttcagcgaggtgcccaccacagccaacggcagcaccaagaccaaccacgtgcacatcaccggcatcgtggtgaacaagcccaaggatggcatgtcctggcctgtgattgtggccgccctgctcttctgctgcatgatcctgtttggcctgggcgtgaggaagtggtgccagtaccagaaggagatcatggagcggcccccacccttcaagcccccacctccacccatcaagtacacctgcatccaggagcccaatgaaagtgacctgccctaccacgagatggagaccctgtag

SEQ ID NO: 146852 - DNA, 1710 bp, Artificial Sequence
  Description of Artificial Sequence: Synthetic coding sequence
atggagaagaagtggaagtactgtgctgtgtactacatcatccagatccactttgtgaagggcgtgtgggagaagacagtgaacacagaagaaaatgtgtatgccaccctgggcagtgatgtgaacctgacctgccagacccagacagtgggcttctttgtgcagatgcagtggagcaaggtgaccaacaagattgacctgattgctgtgtaccacccccagtatggcttctactgtgcctacggccggccctgtgagagcctggtgaccttcacagagaccccagaaaatggcagcaagtggaccctgcacctgaggaacatgagctgcagcgtgtctggccgctatgagtgcatgctggtgctgtacccagagggcatccagaccaagatctacaacctgctgatccagacccacgtgacagcagatgagtggaacagcaaccacaccattgaaattgagatcaaccagaccctggagatcccctgcttccagaacagcagcagcaagatcagcagcgagttcacctacgcctggagcgtggaggacaatggcacccaggagaccctcatcagccagaaccacctgatcagcaacagcaccctgctgaaggacagagtgaagctgggcacagactaccgcctgcacctgagccctgtgcagatctttgatgatggcaggaagttcagctgccacatccgggtgggccccaacaagatcctgcggagcagcaccaccgtgaaggtgtttgccaagccagagatccctgtgattgtggagaacaacagcacagatgtgctggtggagcggcgcttcacctgcctgctgaagaatgtgttccccaaggccaacatcacctggttcattgatggcagcttcctgcatgatgagaaggagggcatctacatcaccaatgaggagaggaagggcaaggatggcttcctggagctgaagtctgtgctgaccagggtgcacagcaacaagccagcccagagcgacaacctgaccatctggtgcatggccctgagccctgtgcccggcaacaaggtgtggaacatcagcagcgagaagatcaccttcctgctgggcagcgagatcagcagcacagatcctcccctgtctgtgacagagagcaccctggacacccagcccagccctgccagctctgtgtccccagcccgctacccagccaccagctctgtgaccctggtggatgtgtctgccctgcggcccaacaccaccccccagcccagcaacagctccatgaccacccggggcttcaactacccctggaccagcagcggcacagacaccaagaagtctgtgagccgcatccccagcgagacctacagcagcagccccagcggggccggcagcaccctgcatgacaacgtgttcaccagcacagcccgggccttcagcgaggtgcccaccacagccaacggcagcaccaagaccaaccacgtgcacatcaccggcatcgtggtgaacaagcccaaggatggcatgtcctggcctgtgattgtggccgccctgctcttctgctgcatgatcctgtttggcctgggcgtgaggaagtggtgccagtaccagaaggagatcatggagcggcccccacccttcaagcccccacctccacccatcaagtacacctgcatccaggagcccaatgaaagtgacctgccctaccacgagatggagaccctgtag

SEQ ID NO: 146853 - DNA, 2508 bp, Artificial Sequence
  Description of Artificial Sequence: Synthetic coding sequence
atgggcggccgggtcttcctggccttctgtgtgtggctgaccctgcccggggctgagacccaggacagccggggctgtgcccgctggtgcccccagaacagcagctgtgtgaatgccacagcctgccgctgcaaccctggcttcagcagcttcagcgagatcatcaccacccccacagagacctgtgatgacatcaatgaatgtgccacccccagcaaggtgtcctgtgggaagttcagtgactgctggaacacagagggcagctatgactgtgtgtgcagccctggctatgagcctgtgtctggggccaagaccttcaagaatgaaagtgagaacacctgccaggatgtggatgagtgccagcagaacccccggctgtgcaagagctatggcacctgtgtgaacaccctgggcagctacacctgccagtgcctgcccggcttcaagttcatccctgaggaccccaaggtgtgcacagatgtgaatgaatgtaccagcggccagaacccctgccacagcagcacccactgcctgaacaacgtgggcagctaccagtgccgctgccggcccggctggcagcccatccctggcagccccaacggccccaacaacacagtgtgtgaagatgtggatgagtgcagcagcggccagcaccagtgtgacagcagcacagtgtgcttcaacacagtgggcagctacagctgccgctgcaggcctggctggaagcccaggcatggcatccccaacaaccagaaggacacagtgtgtgaggacatgaccttcagcacctggaccccacctcctggggtgcacagccagaccctgagccgcttctttgacaaggtgcaggacctgggccgggacagcaagaccagcagcgctgaggtgaccatccagaatgtcatcaagctggtggatgagctgatggaggcccctggagatgtggaggccctggcccctcctgtgcgccacctgattgccacccagctgctgagcaacctggaggacatcatgaggatcctggccaagagcctgcccaagggccccttcacctacatcagccccagcaacacagagctgaccctgatgatccaggagcggggggacaagaatgtgaccatgggccagagcagcgccaggatgaagctgaactgggccgtggccgccggggctgaggaccccggccctgctgtggccggcatcctgagcatccagaacatgaccaccctgctggccaatgccagcctgaacctgcacagcaagaagcaggccgagctggaggagatctatgagagcagcatccggggcgtgcagctgcggcggctgtctgctgtgaacagcatcttcctgagccacaacaacaccaaggagctgaacagccccatcctgtttgccttcagccacctggagagcagtgatggagaggccggccgggaccccccagccaaggatgtgatgcctggcccccggcaggagctgctgtgtgccttctggaagagtgacagcgacagaggaggccactgggccacagagggctgccaggtgctgggcagcaagaatggcagcaccacctgccagtgcagccacctgagcagctttgccatcctgatggcccactatgatgtggaggactggaagctgaccctcatcaccagggtgggcctggccctgagcctcttctgcctgctgctgtgcatcctgaccttcctgctggtgcggcccatccagggcagcaggaccaccatccacctgcacctgtgcatctgcctgtttgtgggcagcaccatcttcctggccggcattgaaaatgaaggaggccaggtgggcctgcgctgccgcctggtggccggcctgctgcactactgcttcctggccgccttctgctggatgagcctggagggcctggagctgtacttcctggtggtgcgggtcttccagggccagggcctgagcacccgctggctgtgcctgattggctacggcgtgcccctgctgattgtgggcgtgtctgctgccatctacagcaagggctacggccggccccgctactgctggctggactttgagcagggcttcctgtggagcttcctgggccctgtgaccttcatcatcctgtgcaatgctgtgatctttgtgaccaccgtgtggaagctgacccagaagttcagcgagatcaacccagacatgaagaagctgaagaaggcccgggccctgaccatcacagccatcgcccagctgttcctgctgggctgcacctgggtgtttggcctcttcatctttgatgacaggagcctggtgctgacctacgtgttcaccatcctgaactgcctgcagggcgccttcctgtacctgctgcactgcctgctgaacaagaaggtgcgggaggagtacaggaagtgggcctgcctggtggccggcggcagcaagtacagcgagttcaccagcaccaccagcggcaccggccacaaccagacccgggccctgcgggccagcgagagcggcatctag

SEQ ID NO: 146854 - DNA, 2361 bp, Artificial Sequence
  Description of Artificial Sequence: Synthetic coding sequence
atgggcggccgggtcttcctggccttctgtgtgtggctgaccctgcccggggctgagacccaggacagccggggctgtgcccgctggtgcccccagaacagcagctgtgtgaatgccacagcctgccgctgcaaccctggcttcagcagcttcagcgagatcatcaccacccccacagagacctgtgatgacatcaatgaatgtgccacccccagcaaggtgtcctgtgggaagttcagtgactgctggaacacagagggcagctatgactgtgtgtgcagccctggctatgagcctgtgtctggggccaagaccttcaagaatgaaagtgagaacacctgccaggatgtggatgagtgccagcagaacccccggctgtgcaagagctatggcacctgtgtgaacaccctgggcagctacacctgccagtgcctgcccggcttcaagttcatccctgaggaccccaaggtgtgcacagatgtggatgaatgtagcagcggccagcaccagtgtgacagcagcacagtgtgcttcaacacagtgggcagctacagctgccgctgccggcccggctggaagcccaggcatggcatccccaacaaccagaaggacacagtgtgtgaggacatgaccttcagcacctggaccccacctcctggggtgcacagccagaccctgagccgcttctttgacaaggtgcaggacctgggccgggacagcaagaccagcagcgctgaggtgaccatccagaatgtcatcaagctggtggatgagctgatggaggcccctggagatgtggaggccctggcccctcctgtgcgccacctgattgccacccagctgctgagcaacctggaggacatcatgaggatcctggccaagagcctgcccaagggccccttcacctacatcagccccagcaacacagagctgaccctgatgatccaggagcggggggacaagaatgtgaccatgggccagagcagcgccaggatgaagctgaactgggccgtggccgccggggctgaagatcctggccctgctgtggccggcatcctgagcatccagaacatgaccaccctgctggccaatgccagcctgaacctgcacagcaagaagcaggccgagctggaggagatctatgagagcagcatccggggcgtgcagctgcggcggctgtctgctgtgaacagcatcttcctgagccacaacaacaccaaggagctgaacagccccatcctgtttgccttcagccacctggagagcagtgatggagaggccggccgggaccccccagccaaggatgtgatgcctggcccccggcaggagctgctgtgtgccttctggaagagtgacagcgaccggggcggccactgggccacagagggctgccaggtgctgggcagcaagaatggcagcaccacctgccagtgcagccacctgagcagctttgccatcctgatggcccactatgatgtggaggactggaagctgaccctcatcaccagggtgggcctggccctgagcctcttctgcctgctgctgtgcatcctgaccttcctgctggtgcggcccatccagggcagcaggaccaccatccacctgcacctgtgcatctgcctgtttgtgggcagcaccatcttcctggccggcattgaaaatgaaggaggccaggtgggcctgcgctgccgcctggtggccggcctgctgcactactgcttcctggccgccttctgctggatgagcctggagggcctggagctgtacttcctggtggtgcgggtcttccagggccagggcctgagcacccgctggctgtgcctgattggctatggagtgcccctgctgattgtgggcgtgtctgctgccatctacagcaagggctacggccggccccgctactgctggctggactttgagcagggcttcctgtggagcttcctgggccctgtgaccttcatcatcctgtgcaatgctgtgatctttgtgaccaccgtgtggaagctgacccagaagttcagcgagatcaacccagacatgaagaagctgaagaaggcccgggccctgaccatcacagccatcgcccagctgttcctgctgggctgcacctgggtgtttggcctcttcatctttgatgacaggagcctggtgctgacctacgtgttcaccatcctgaactgcctgcagggcgccttcctgtacctgctgcactgcctgctgaacaagaaggtgcgggaggagtacaggaagtgggcctgcctggtggccggcggcagcaagtacagcgagttcaccagcaccaccagcggcaccggccacaaccagacccgggccctgcgggccagcgagagcggcatctag

SEQ ID NO: 146855 - DNA, 2229 bp, Artificial Sequence
  Description of Artificial Sequence: Synthetic coding sequence
atgggcggccgggtcttcctggccttctgtgtgtggctgaccctgcccggggctgagacccaggacagccggggctgtgcccgctggtgcccccagaacagcagctgtgtgaatgccacagcctgccgctgcaaccctggcttcagcagcttcagcgagatcatcaccacccccacagagacctgtgatgacatcaatgaatgtgccacccccagcaaggtgtcctgtgggaagttcagtgactgctggaacacagagggcagctatgactgtgtgtgcagccctggctatgagcctgtgtctggggccaagaccttcaagaatgaaagtgagaacacctgccaggatgtggatgaatgtagcagcggccagcaccagtgtgacagcagcacagtgtgcttcaacacagtgggcagctacagctgccgctgccggcccggctggaagcccaggcatggcatccccaacaaccagaaggacacagtgtgtgaggacatgaccttcagcacctggaccccacctcctggggtgcacagccagaccctgagccgcttctttgacaaggtgcaggacctgggccgggacagcaagaccagcagcgctgaggtgaccatccagaatgtcatcaagctggtggatgagctgatggaggcccctggagatgtggaggccctggcccctcctgtgcgccacctgattgccacccagctgctgagcaacctggaggacatcatgaggatcctggccaagagcctgcccaagggccccttcacctacatcagccccagcaacacagagctgaccctgatgatccaggagcggggggacaagaatgtgaccatgggccagagcagcgccaggatgaagctgaactgggccgtggccgccggggctgaagatcctggccctgctgtggccggcatcctgagcatccagaacatgaccaccctgctggccaatgccagcctgaacctgcacagcaagaagcaggccgagctggaggagatctatgagagcagcatccggggcgtgcagctgcggcggctgtctgctgtgaacagcatcttcctgagccacaacaacaccaaggagctgaacagccccatcctgtttgccttcagccacctggagagcagtgatggagaggccggccgggaccccccagccaaggatgtgatgcctggcccccggcaggagctgctgtgtgccttctggaagagtgacagcgaccggggcggccactgggccacagagggctgccaggtgctgggcagcaagaatggcagcaccacctgccagtgcagccacctgagcagctttgccatcctgatggcccactatgatgtggaggactggaagctgaccctcatcaccagggtgggcctggccctgagcctcttctgcctgctgctgtgcatcctgaccttcctgctggtgcggcccatccagggcagcaggaccaccatccacctgcacctgtgcatctgcctgtttgtgggcagcaccatcttcctggccggcattgaaaatgaaggaggccaggtgggcctgcgctgccgcctggtggccggcctgctgcactactgcttcctggccgccttctgctggatgagcctggagggcctggagctgtacttcctggtggtgcgggtcttccagggccagggcctgagcacccgctggctgtgcctgattggctatggagtgcccctgctgattgtgggcgtgtctgctgccatctacagcaagggctacggccggccccgctactgctggctggactttgagcagggcttcctgtggagcttcctgggccctgtgaccttcatcatcctgtgcaatgctgtgatctttgtgaccaccgtgtggaagctgacccagaagttcagcgagatcaacccagacatgaagaagctgaagaaggcccgggccctgaccatcacagccatcgcccagctgttcctgctgggctgcacctgggtgtttggcctcttcatctttgatgacaggagcctggtgctgacctacgtgttcaccatcctgaactgcctgcagggcgccttcctgtacctgctgcactgcctgctgaacaagaaggtgcgggaggagtacaggaagtgggcctgcctggtggccggcggcagcaagtacagcgagttcaccagcaccaccagcggcaccggccacaaccagacccgggccctgcgggccagcgagagcggcatctag

SEQ ID NO: 146856 - DNA, 2358 bp, Artificial Sequence
  Description of Artificial Sequence: Synthetic coding sequence
gggggccgcatcatgagggccttctgtgtgtggctgaccctgcctggagctgagacccaggacagccggggctgtgcccgctggtgcccccagaacagcagctgtgtgaatgccacagcctgccgctgcaaccctggcttcagcagcttcagcgagatcatcaccacccccacagagacctgtgatgacatcaatgaatgtgccacccccagcaaggtgtcctgtgggaagttcagtgactgctggaacacagagggcagctatgactgtgtgtgcagccctggctatgagcctgtgtctggggccaagaccttcaagaatgaaagtgagaacacctgccaggatgtggatgagtgccagcagaacccccggctgtgcaagagctatggcacctgtgtgaacaccctgggcagctacacctgccagtgcctgcccggcttcaagttcatccctgaggaccccaaggtgtgcacagatgtggatgagtgcagcagcggccagcaccagtgtgacagcagcacagtgtgcttcaacacagtgggcagctacagctgccgctgcaggcctggctggaagcccaggcatggcatccccaacaaccagaaggacacagtgtgtgaggacatgaccttcagcacctggaccccacctcctggggtgcacagccagaccctgagccgcttctttgacaaggtgcaggacctgggccgggacagcaagaccagcagcgctgaggtgaccatccagaatgtcatcaagctggtggatgagctgatggaggcccctggagatgtggaggccctggcccctcctgtgcgccacctgattgccacccagctgctgagcaacctggaggacatcatgaggatcctggccaagagcctgcccaagggccccttcacctacatcagccccagcaacacagagctgaccctgatgatccaggagcggggggacaagaatgtgaccatgggccagagcagcgccaggatgaagctgaactgggccgtggccgccggggctgaggaccccggccctgctgtggccggcatcctgagcatccagaacatgaccaccctgctggccaatgccagcctgaacctgcacagcaagaagcaggccgagctggaggagatctatgagagcagcatccggggcgtgcagctgcggcggctgtctgctgtgaacagcatcttcctgagccacaacaacaccaaggagctgaacagccccatcctgtttgccttcagccacctggagagcagtgatggagaggccggccgggaccccccagccaaggatgtgatgcctggcccccggcaggagctgctgtgtgccttctggaagagtgacagcgacagaggaggccactgggccacagagggctgccaggtgctgggcagcaagaatggcagcaccacctgccagtgcagccacctgagcagctttgccatcctgatggcccactatgatgtggaggactggaagctgaccctcatcaccagggtgggcctggccctgagcctcttctgcctgctgctgtgcatcctgaccttcctgctggtgcggcccatccagggcagcaggaccaccatccacctgcacctgtgcatctgcctgtttgtgggcagcaccatcttcctggccggcattgaaaatgaaggaggccaggtgggcctgcgctgccgcctggtggccggcctgctgcactactgcttcctggccgccttctgctggatgagcctggagggcctggagctgtacttcctggtggtgcgggtcttccagggccagggcctgagcacccgctggctgtgcctgattggctacggcgtgcccctgctgattgtgggcgtgtctgctgccatctacagcaagggctacggccggccccgctactgctggctggactttgagcagggcttcctgtggagcttcctgggccctgtgaccttcatcatcctgtgcaatgctgtgatctttgtgaccaccgtgtggaagctgacccagaagttcagcgagatcaacccagacatgaagaagctgaagaaggcccgggccctgaccatcacagccatcgcccagctgttcctgctgggctgcacctgggtgtttggcctcttcatctttgatgacaggagcctggtgctgacctacgtgttcaccatcctgaactgcctgcagggcgccttcctgtacctgctgcactgcctgctgaacaagaaggtgcgggaggagtacaggaagtgggcctgcctggtggccggcggcagcaagtacagcgagttcaccagcaccaccagcggcaccggccacaaccagacccgggccctgcgggccagcgagagcggcatctag

SEQ ID NO: 146857 - DNA, 297 bp, Artificial Sequence
  Description of Artificial Sequence: Synthetic coding sequence
atgtctgtgcggctgcacgtgcccagcggcagccggggcagcgagctgagcgccctgatccaggccatcggggccagcaccagcggcaagcccaagtgctttgtgtgcatcctgcggagcggcctgtctgtggccctgagcctgtctgtgtacttcctgctgctcttcagcaggacccggggcggcggccacggggagcccccagagtgccagaggcgggccagctgcagcgcctacagcttccgggagattgaggactgccggcagaagcagccccggcgctggcagcagggctag

SEQ ID NO: 146858 - DNA, 231 bp, Artificial Sequence
  Description of Artificial Sequence: Synthetic coding sequence
atggcccggggagctgccctggccctgctgctgtttggcctgctgggcgtgctggtggccgcccctggctttggagacctgcggctgcaggccgcccggggcggccggcctggggtggcctgccacagccacgccctgcggcccggccccaagtttggcatcgcccggagcctgcggcccggctggtggggcgagggcaaggagaagctggagaagaactttgagccctag

SEQ ID NO: 146859 - DNA, 534 bp, Artificial Sequence
  Description of Artificial Sequence: Synthetic coding sequence
atggcccggggagctgccctggccctgctgctgtttggcctgctgggcgtgctggtggccgccccagatggcggctttgacctgagtgatgccctgcctgacaatgaaaacaagaagcccacagccatccccaagaagcccagcgctggagatgactttgacctgggagatgctgtggtggatggagaaaatgatgaccccaggcctcccaacccccccaagcccatgcccaaccccaaccccaaccaccccagcagcagcggcagcttcagtgatgctgacctggctgatggagtgtctggaggagagggcaaaggaggcagtgatggcggcggcagccacaggaaggagggggaggaggctgatgcccctggggtcatccctggcatcgtgggcgctgtggtggtggccgtggccggggccatcagcagcttcatcgcctaccagaagaagaagctgtgcttcaaggaaaatggccagctggccggcagcctgggcccctgcatcggcatccggcgggaggctgatggatag

SEQ ID NO: 146860 - DNA, 510 bp, Artificial Sequence
  Description of Artificial Sequence: Synthetic coding sequence
atggcccggggagctgccctggccctgctgctgtttggcctgctgggcgtgctggtggccgccccagatggcggctttgacctgagtgatgccctgcctggagatgactttgacctgggagatgctgtggtggatggagaaaatgatgaccccaggcctcccaacccccccaagcccatgcccaaccccaaccccaaccaccccagcagcagcggcagcttcagtgatgctgacctggctgatggagtgtctggaggagagggcaaaggaggcagtgatggcggcggcagccacaggaaggagggggaggaggctgatgcccctggggtcatccctggcatcgtgggcgctgtggtggtggccgtggccggggccatcagcagcttcatcgcctaccagaagaagaagctgtgcttcaaggaaaatgctgagcagggcgaggtggacatggagagccacagaaatgccaatgctgagcctgctgtgcagaggaccctgctggagaagtag

SEQ ID NO: 146861 - DNA, 558 bp, Artificial Sequence
  Description of Artificial Sequence: Synthetic coding sequence
atggcccggggagctgccctggccctgctgctgtttggcctgctgggcgtgctggtggccgccccagatggcggctttgacctgagtgatgccctgcctgacaatgaaaacaagaagcccacagccatccccaagaagcccagcgctggagatgactttgacctgggagatgctgtggtggatggagaaaatgatgaccccaggcctcccaacccccccaagcccatgcccaaccccaaccccaaccaccccagcagcagcggcagcttcagtgatgctgacctggctgatggagtgtctggaggagagggcaaaggaggcagtgatggcggcggcagccacaggaaggagggggaggaggctgatgcccctggggtcatccctggcatcgtgggcgctgtggtggtggccgtggccggggccatcagcagcttcatcgcctaccagaagaagaagctgtgcttcaaggaaaatgctgagcagggcgaggtggacatggagagccacagaaatgccaatgctgagcctgctgtgcagaggaccctgctggagaagtag

SEQ ID NO: 146862 - DNA, 606 bp, Artificial Sequence
  Description of Artificial Sequence: Synthetic coding sequence
agacgctggggccggcctgctggcacccctggggccagcagcctgcccggccgcacccgctgtgcccatggaggccctggccctgaggaggcccccaccttcagccccaccctcttcctggagcccttccagcgggagaagagcgcctttgtggtgggcgtggccaacagctacatgtggggcggcctgggcagagatggcggctttgacctgagtgatgccctgcctgacaatgaaaacaagaagcccacagccatccccaagaagcccagcgctggagatgactttgacctgggagatgctgtggtggatggagaaaatgatgacccccggccccccaacccccccaagcccatgcccaaccccaaccccaaccaccccagcagcagcggcagcttcagtgatgctgacctggctgatggagtgtctggaggagagggcaagggcggcagtgatggcggcggcagccacaggaaggagggggaggaggctgatgcccctggggtcatccctggcatcgtgggcgctgtggtggtggccgtggccggggccatcagcagcttcatcgcctaccagaagaagaagctgtgcttcaaggagaactag

SEQ ID NO: 146863 - DNA, 438 bp, Artificial Sequence
  Description of Artificial Sequence: Synthetic coding sequence
atggtggcctggaggtctgccttcctggtgtgcctggccttcagcctggccaccctggtgcagaggggcagcggggactttgatgacttcaacctggaggatgctgtgaaggagaccagctctgtgaagccagccctgggcatgtaccacaagctggatggcctgaagcagcagaacttcatcctgagcctcttctggatgctggaggtgctgtaccagggcgtgggctgggccaccttcagcctgaaggccctgggcaagaacctgagcctgaccttccccaccagcggcggcagccgctgcagcctggtgtgtggctgcatcacccccatcagcgcctctgtggtgacctggtgcagccccttctgtgtgtccctgctgagcctgaccaagatgctggtgtctggcttcaaggcccacctggacaaccctggatag

SEQ ID NO: 146864 - DNA, 573 bp, Artificial Sequence
  Description of Artificial Sequence: Synthetic coding sequence
atggtggcctggaggtctgccttcctggtgtgcctggccttcagcctggccaccctggtgcagaggggcagcggggactttgatgacttcaacctggaggatgctgtgaaggagaccagctctgtgaagagaaatgactttgacctggctgatgccctggatgacagaaatgacagagatgatggaagaaggaagcccatcgccggcggcggcggcttcagtgacaaggacctggaggacatcgtgggcggcggggagtacaagccagacaagggcaaaggagatggccgctatggcagcaatgatgaccccggcagcggcatggtggccgagcccggcaccatcgccggcgtggccagcgccctggccatggccctgattggagctgtgagcagctacatctcctaccagcagaagaagttctgcttcagcatccagcagggcctgaatgctgactatgtgaagggggagaacctggaggccgtggtgtgtgaggagccccaggtgaagtacagcaccctgcacacccagagcgctgagcccccacctcctcctgagcccgcccgcatctag

SEQ ID NO: 146865 - DNA, 789 bp, Artificial Sequence
  Description of Artificial Sequence: Synthetic coding sequence
atggtggcctggaggtctgccttcctggtgtgcctggccttcagcctggccaccctggtgcagaggggcagcggggactttgatgacttcaacctggaggatgctgtgaaggagaccagctctgtgaagcagccctgggaccacaccaccaccaccaccaccaacagacctggcaccacccgggccccagccaagcccccaggcagcggcctggacctggctgatgccctggatgaccaggatgatggccgcaggaagccaggcattggaggccgggagcgctggaaccacgtgaccaccaccaccaagaggcctgtgaccacccgggccccagccaacaccctgggcaatgactttgacctggctgatgccctggatgacagaaatgacagagatgatggaagaaggaagcccatcgccggcggcggcggcttcagtgacaaggacctggaggacatcgtgggcggcggggagtacaagccagacaagggcaaaggagatggccgctatggcagcaatgatgaccccggcagcggcatggtggccgagcccggcaccatcgccggcgtggccagcgccctggccatggccctgattggagctgtgagcagctacatctcctaccagcagaagaagttctgcttcagcatccagcagggcctgaatgctgactatgtgaagggggagaacctggaggccgtggtgtgtgaggagccccaggtgaagtacagcaccctgcacacccagagcgctgagcccccacctcctcctgagcccgcccgcatctag

SEQ ID NO: 146866 - DNA, 474 bp, Artificial Sequence
  Description of Artificial Sequence: Synthetic coding sequence
gagaccagctctgtgaagcagccctgggaccacaccaccaccaccaccaccaaccggcccggcaccacccgggccccagccaagcccccaggcagcggcctggacctggctgatgccctggatgaccaggatgatggaagaaggaagccaggcatcggcggccgggagcgctggaaccacgtgaccaccaccaccaagaggcctgtgaccacccgggccccagccaacaccctgggcaatgactttgacctggctgatgccctggatgacagaaatgacagagatgatggccgcaggaagcccatcgccggcggcggcggcttcagtgacaaggacctggaggacatcgtgggcggcggggagtacaagccagacaagggcaaaggagatggccgctatggcagcaatgatgatcctggcagcggcggcttcctgaaccctgaggcccctgtgggccacgtgaagggcaagtag

SEQ ID NO: 146867 - DNA, 570 bp, Artificial Sequence
  Description of Artificial Sequence: Synthetic coding sequence
atggtggcctggaggtctgccttcctggtgtgcctggccttcagcctggccaccctggtgcagaggggcagcggggactttgatgacttcaacctggaggatgctgtgaaggagaccagctctgtgaagcagccctgggaccacaccaccaccaccaccaccaacagacctggcaccacccgggccccagccaagcccccaggcagcggcctggacctggctgatgccctggatgaccaggatgatggccgcaggaagccaggcattggaggaagaggagatggccgctatggcagcaatgatgatcctggcagcggcatggtggccgagcccggcaccatcgccggcgtggccagcgccctggccatggccctgattggagctgtgtcctcctacatctcctaccagcagaagaagttctgcttcagcatccagcagggcctgaatgctgactatgtgaagggggagaacctggaggccgtggtgtgtgaggagccccaggtgaagtacagcaccctgcacacccagagcgctgagcccccacctcctcctgagcccgcccgcatctag

SEQ ID NO: 146868 - DNA, 819 bp, Artificial Sequence
  Description of Artificial Sequence: Synthetic coding sequence
atggtggcctggaggtctgccttcctggtgtgcctggccttcagcctggccaccctggtgcagaggggcagcggggactttgatgacttcaacctggaggatgctgtgaaggagaccagctctgtgaagcagccctgggaccacaccaccaccaccaccaccaacagacctggcaccacccgggccccagccaagcccccaggccccacagagggcagcggcctggacctggctgatgccctggatgaccaggatgatggccgcaggaagccaggcattggaggccgggagcgctggaaccacgtgaccaccaccaccaagaggcctgtgaccacccgggccccagccaacaccctgggcaatgactttgacctggctgatgccctggatgacagaaatgacagagatgatggaagaaggaagcccatcgccggcggcggcggcttcagtgacaaggacctggaggacatcgtgggcggcggggagtacaagccagacaagggcaaaggagatggccgctatggcagcaatgatgaccccggcagcggcatggtggccgagcccggcaccatcgccggcgtggccagcgccctggccatggccctgattggagctgtgagcagctacatctcctaccagcagaagaagttctgcttcagcatccagcacgccgccgccggccaggagggcctgaatgctgactatgtgaagggggagaacctggaggccgtggtgtgtgaggagccccaggtgaagtacagcaccctgcacacccagagcgctgagcccccacctcctcctgagcccgcccgcatctag

SEQ ID NO: 146869 - DNA, 642 bp, Artificial Sequence
  Description of Artificial Sequence: Synthetic coding sequence
atggtggcctggaggtctgccttcctggtgtgcctggccttcagcctggccaccctggtgcagaggggcagcggggactttgatgacttcaacctggaggatgctgtgaaggagaccagctctgtgaagcagcgctggaaccacgtgaccaccaccaccaagaggcctgtgaccacccgggccccagccaacaccctgggcaatgactttgacctggctgatgccctggatgacagaaatgacagagatgatggccgcaggaagcccatcgccggcggcggcggcttcagtgacaaggacctggaggacatcgtgggcggcggggagtacaagccagacaagggcaaaggagatggccgctatggcagcaatgatgatcctggcagcggcatggtggccgagcccggcaccatcgccggcgtggccagcgccctggccatggccctgattggagctgtgtcctcctacatctcctaccagcagaagaagttctgcttcagcatccagcagggcctgaatgctgactatgtgaagggggagaacctggaggccgtggtgtgtgaggagccccaggtgaagtacagcaccctgcacacccagagcgctgagcccccacctcctcctgagcccgcccgcatctag

SEQ ID NO: 146870 - DNA, 1785 bp, Artificial Sequence
  Description of Artificial Sequence: Synthetic coding sequence
atggctgctgagagcggggagctgattggagcctgtgagttcatgaaggaccggctgtactttgccaccctgaggaaccggcccaagagcacagtgaacacccactacttcagcattgatgaggagctggtgtatgagaacttctacgccgactttggccccctgaacctggccatggtgtaccgctactgctgcaagctgaacaagaagctgaagagctacagcctgagcaggaagaagatcgtgcactacacctgctttgaccagaggaagagggccaatgctgccttcctgattggagcctatgctgtgatctacctgaagaagaccccagaggaggcctaccgggccctgctgagcggcagcaaccccccctacctgcccttcagagatgccagctttggaaactgcacctacaacctgaccatcctggactgcctgcagggcatcaggaagggcctgcagcacggcttctttgattttgagacctttgatgtggatgaatatgagcactatgaaagagtggagaatggagacttcaactggatcgtgcctgggaagttcctggccttcagcggcccccaccccaagagcaagattgaaaatggctaccccctgcacgcccctgaggcctacttcccctacttcaagaagcacaacgtgacagctgtggtgcggctgaacaagaagatctatgaggccaagcgcttcacagatgctggctttgagcactatgacctcttcttcattgatggcagcacccccagcgacaacatcgtgcggcgcttcctgaacatctgtgagaacacagagggcgccatcgctgtgcactgcaaggccggcctgggccgcacaggcaccctgattgcctgctacgtgatgaagcactaccgcttcacccacgccgagatcatcgcctggatccgcatctgcaggcctggcagcatcatcggcccccagcagcacttcctggaggagaagcaggccagcctgtgggtgcagggcgacatcttccgcagcaagctgaagaaccggcccagcagcgagggcagcatcaacaagatcctgagcggcctggatgacatgagcatcggcggcaacctgagcaagacccagaacatggagagatttggagaggacaacctggaggatgatgatgtggagatgaagaatggcatcacccagggcgacaagctgcgggccctgaagagccagaggcagcccaggaccagccccagctgtgccttcagaagtgatgacaccaagggccaccccagggctgtgtcccagcccttccggctgagcagcagcctgcagggcagcgctgtgaccctgaagaccagcaagatggccctgagccccagcgccacagccaagaggatcaacagaaccagcctgagcagcggggccaccgtgcgctccttcagcatcaacagccggctggccagcagcctgggcaacctgaatgctgccacagatgatcctgagaacaagaagaccagcagcagcagcaaggccggcttcaccgccagccccttcaccaacctgctgaatggcagcagccagcccaccaccaggaactacccagagctgaacaacaaccagtacaacagaagcagcaacagcaatggaggcaacctgaacagccccccaggcccccacagcgccaagacagaggagcacaccaccatcctgcggcccagctacacaggcctgagcagcagcagcgcccgcttcctgagccgcagcatccccagcctgcagagtgaatatgtgcactactag

SEQ ID NO: 146871 - DNA, 1872 bp, Artificial Sequence
  Description of Artificial Sequence: Synthetic coding sequence
atggctgctgagagcggggagctgattggagcctgtgagttcatgaaggaccggctgtactttgccaccctgaggaaccggcccaagagcacagtgaacacccactacttcagcattgatgaggagctggtgtatgagaacttctacgccgactttggccccctgaacctggccatggtgtaccgctactgctgcaagctgaacaagaagctgaagagctacagcctgagcaggaagaagatcgtgcactacacctgctttgaccagaggaagagggccaatgctgccttcctgattggagcctatgctgtgatctacctgaagaagaccccagaggaggcctaccgggccctgctgagcggcagcaaccccccctacctgcccttcagagatgccagctttggaaactgcacctacaacctgaccatcctggactgcctgcagggcatcaggaagggcctgcagcacggcttctttgattttgagacctttgatgtggatgaatatgagcactatgaaagagtggagaatggagacttcaactggatcgtgcctgggaagttcctggccttcagcggcccccaccccaagagcaagattgaaaatggctaccccctgcacgcccctgaggcctacttcccctacttcaagaagcacaacgtgacagctgtggtgcggctgaacaagaagatctatgaggccaagcgcttcacagatgctggctttgagcactatgacctcttcttcattgatggcagcacccccagcgacaacatcgtgcggcgcttcctgaacatctgtgagaacacagagggcgccatcgctgtgcactgcaaggccggcctgggccgcacaggcaccctgattgcctgctacgtgatgaagcactaccgcttcacccacgccgagatcatcgcctggatccgcatctgcaggcctggcagcatcatcggcccccagcagcacttcctggaggagaagcaggccagcctgtgggtgcagggcgacatcttccgcagcaagctgaagaaccggcccagcagcgagggcagcatcaacaagatcctgagcggcctggatgacatgagcatcggcggcaacctgagcaagacccagaacatggagagatttggagaggacaacctggaggatgatgatgtggagatgaagaatggcatcacccagggcgacaagctgcgggccctgaagagccagaggcagcccaggaccagccccagctgtgccttcagaagtgatgacaccaagggccaccccagggctgtgtcccagcccttccggctgagcagcagcctgcagggcagcgctgtgaccctgaagaccagcaagatggccctgagccccagcgccacagccaagaggatcaacagaaccagcctgagcagcggggccaccgtgcgctccttcagcatcaacagccggctggccagcagcctgggcaacctgaatgctgccacagatgatcctgagaacaagaagaccagcagcagcagcaaggccggcttcaccgccagccccttcaccaacctgctgaatggcagcagccagcccaccaccaggaactacccagagctgaacaacaaccagtacaacagaagcagcaacagcaatggaggcaacctgaacagccccccaggcccccacagcgccaagacagaggagcacaccaccatcctgcggcccagctacacaggcctgagcagcagcagcgcccgcttcctgagccgcagcatccctgtgtctgcccagaccccacctcctggcccccagaaccctgagtgcaacttctgtgccctgcccagccagccccggctgccccccaagaagttcaacagcgccaaggaggccttctag

SEQ ID NO: 146872 - DNA, 1152 bp, Artificial Sequence
  Description of Artificial Sequence: Synthetic coding sequence
atggctgctgagagcggggagctgattggagcctgtgagttcatgaaggaccggctgtactttgccaccctgaggaaccggcccaagagcacagtgaacacccactacttcagcattgatgaggagctggtgtatgagaacttctacgccgactttggccccctgaacctggccatggtgtaccgctactgctgcaagctgaacaagaagctgaagagctacagcctgagcaggaagaagatcgtgcactacacctgctttgaccagaggaagagggccaatgctgccttcctgattggagcctatgctgtgatctacctgaagaagaccccagaggaggcctaccgggccctgctgagcggcagcaaccccccctacctgcccttcagagatgccagctttggaaactgcacctacaacctgaccatcctggactgcctgcagggcatcaggaagggcctgcagcacggcttctttgattttgagacctttgatgtggatgaatatgagcactatgaaagagtggagaatggagacttcaactggatcgtgcctgggaagttcctggccttcagcggcccccaccccaagagcaagattgaaaatggctaccccctgcacgcccctgaggcctacttcccctacttcaagaagcacaacgtgacagctgtggtgcggctgaacaagaagatctatgaggccaagcgcttcacagatgctggctttgagcactatgacctcttcttcattgatggcagcacccccagcgacaacatcgtgcggcgcttcctgaacatctgtgagaacacagagggcgccatcgctgtgcactgcaaggccggcctgggccgcacaggcaccctgattgcctgctacgtgatgaagcactaccgcttcacccacgccgagatcatcgcctggatccgcatctgcaggcctggcagcatcatcggcccccagcagcacttcctggaggagaagcaggccagcctgtgggtgcagggcgacatcttccgcagcaagctgaagaaccggcccagcagcgagggcagcatcaacaagatcctgagcggcctggatgacatgagcatcggcggcaacctgagcaagacccagaacatggagagatttggagaggtgtccttcccctag

SEQ ID NO: 146873 - DNA, 576 bp, Artificial Sequence
  Description of Artificial Sequence: Synthetic coding sequence
atggctgctgagagcggggagctgattggagcctgtgagttcatgaaggaccggctgtactttgccaccctgaggaaccggcccaagagcacagtgaacacccactacttcagcattgatgaggagctggtgtatgagaacttctacgccgactttggccccctgaacctggccatggtgtaccgctactgctgcaagctgaacaagaagctgaagagctacagcctgagcaggaagaagatcgtgcactacacctgctttgaccagaggaagagggccaatgctgccttcctgattggagcctatgctgtgatctacctgaagaagaccccagaggaggcctaccgggccctgctgagcggcagcaaccccccctacctgcccttcagagatgccagctttggaaactgcacctacaacctgaccatcctggactgcctgcagggcatcaggaagggcctgcagcacggcttctttgattttgagacctttgatgtggatgaatatgagcactatgaggtgatcctcttcacccccctgaagcccaccttcctgatcagcaagagcatcatgtag

SEQ ID NO: 146874 - DNA, 822 bp, Artificial Sequence
  Description of Artificial Sequence: Synthetic coding sequence
atgggcaacttcctgagccgggagaacaaggtgcaggtgatcagcgagagtgaccggctgtactttgccaccctgaggaaccggcccaagagcacagtgaacacccactacttcagcattgatgaggagctggtgtatgagaacttctatgctgactttggccccctgaacctggccatggtgtaccgctactgctgcaagctgaacaagaagctgaagagctacagcctgagcaggaagaagatcgtgcactacacctgctttgaccagaggaagagggccaatgctgccttcctgattggagcctatgctgtgatctacctgaagaagaccccagaggaggcctaccgggccctgctgagcggcagcaaccccccctacctgcccttcagagatgccagctttggaaactgcacctacaacctgaccatcctggactgcctgcagggcatcaggaagggcctgcagcacggcttctttgattttgagacctttgatgtggatgaatatgagcactatgagcgggtggagaatggagacttcaactggatcgtgcctgggaagttcctggccttcagcggcccccaccccaagagcaagattgaaaatggctaccccctgcacgcccctgaggcctacttcccctacttcaagaagcacaacgtgacagctgtggtgcggctgaacaagaagatctatgaggccaagcgcttcacagatgctggctttgagcactatgacctcttcttcattgatggcagcacccccagcgacaacatcgtgcggcgcttcctgaacatctgtgaaaatacagagggctag

SEQ ID NO: 146875 - DNA, 1698 bp, Artificial Sequence
  Description of Artificial Sequence: Synthetic coding sequence
atggtgtaccgctactgctgcaagctgaacaagaagctgaagagctacagcctgagcaggaagaagatcgtgcactacacctgctttgaccagaggaagagggccaatgctgccttcctgattggagcctatgctgtgatctacctgaagaagaccccagaggaggcctaccgggccctgctgagcggcagcaaccccccctacctgcccttcagagatgccagctttggaaactgcacctacaacctgaccatcctggactgcctgcagggcatcaggaagggcctgcagcacggcttctttgattttgagacctttgatgtggatgaatatgagcactatgaaagagtggagaatggagacttcaactggatcgtgcctgggaagttcctggccttcagcggcccccaccccaagagcaagattgaaaatggctaccccctgcacgcccctgaggcctacttcccctacttcaagaagcacaacgtgacagctgtggtgcggctgaacaagaagatctatgaggccaagcgcttcacagatgctggctttgagcactatgacctcttcttcattgatggcagcacccccagcgacaacatcgtgcggcgcttcctgaacatctgtgagaacacagagggcgccatcgctgtgcactgcaaggccggcctgggccgcacaggcaccctgattgcctgctacgtgatgaagcactaccgcttcacccacgccgagatcatcgcctggatccgcatctgcaggcctggcagcatcatcggcccccagcagcacttcctggaggagaagcaggccagcctgtgggtgcagggcgacatcttccgcagcaagctgaagaaccggcccagcagcgagggcagcatcaacaagatcctgagcggcctggatgacatgagcatcggcggcaacctgagcaagacccagaacatggagagatttggagaggacaacctggaggatgatgatgtggagatgaagaatggcatcacccagggcgacaagctgcgggccctgaagagccagaggcagcccaggaccagccccagctgtgccttcagaagtgatgacaccaagggccaccccagggctgtgtcccagcccttccggctgagcagcagcctgcagggcagcgctgtgaccctgaagaccagcaagatggccctgagccccagcgccacagccaagaggatcaacagaaccagcctgagcagcggggccaccgtgcgctccttcagcatcaacagccggctggccagcagcctgggcaacctgaatgctgccacagatgatcctgagaacaagaagaccagcagcagcagcaaggccggcttcaccgccagccccttcaccaacctgctgaatggcagcagccagcccaccaccaggaactacccagagctgaacaacaaccagtacaacagaagcagcaacagcaatggaggcaacctgaacagccccccaggcccccacagcgccaagacagaggagcacaccaccatcctgcggcccagctacacaggcctgagcagcagcagcgcccgcttcctgagccgcagcatccctgtgtctgcccagaccccacctcctggcccccagaaccctgagtgcaacttctgtgccctgcccagccagccccggctgccccccaagaagttcaacagcgccaaggaggccttctag

SEQ ID NO: 146876 - DNA, 1833 bp, Artificial Sequence
  Description of Artificial Sequence: Synthetic coding sequence
atggctgctgagagcggggagctgattggagcctgtgagttcatgaaggaccggctgtactttgccaccctgaggaaccggcccaagagcacagtgaacacccactacttcagcattgatgaggagctggtgtatgagaacttctacgccgactttggccccctgaacctggccatggtgtaccgctactgctgcaagctgaacaagaagctgaagagctacagcctgagcaggaagaagatcgtgcactacacctgctttgaccagaggaagagggccaatgctgccttcctgattggagcctatgctgtgatctacctgaagaagaccccagaggaggcctaccgggccctgctgagcggcagcaaccccccctacctgcccttcagagatgccagctttggaaactgcacctacaacctgaccatcctggactgcctgcagggcatcaggaagggcctgcagcacggcttctttgattttgagacctttgatgtggatgaatatgagcactatgaaagagtggagaatggagacttcaactggatcgtgcctgggaagttcctggccttcagcggcccccaccccaagagcaagattgaaaatggctaccccctgcacgcccctgaggcctacttcccctacttcaagaagcacaacgtgacagctgtggtgcggctgaacaagaagatctatgaggccaagcgcttcacagatgctggctttgagcactatgacctcttcttcattgatggcagcacccccagcgacaacatcgtgcggcgcttcctgaacatctgtgagaacacagagggcgccatcgctgtgcactgcaaggccggcctgggccgcacaggcaccctgattgcctgctacgtgatgaagcactaccgcttcacccacgccgagatcatcgcctggatccgcatctgcaggcctggcagcatcatcggcccccagcagcacttcctggaggagaagcaggccagcctgtgggtgcagggcgacatcttccgcagcaagctgaagaaccggcccagcagcgagggcagcatcaacaagatcctgagcggcctggatgacatgagcatcggcggcaacctgagcaagacccagaacatggagagatttggagaggacaacctggaggatgatgatgtggagatgaagaatggcatcacccagggcgacaagctgcgggccctgaagagccagaggcagcccaggaccagccccagctgtgccttcagaagtgatgacaccaagggccaccccagggctgtgtcccagcccttccggctgagcagcagcctgcagggcagcgctgtgaccctgaagaccagcaagatggccctgagccccagcgccacagccaagaggatcaacagaaccagcctgagcagcggggccaccgtgcgctccttcagcatcaacagccggctggccagcagcctgggcaacctgaatgctgccacagatgatcctgagaacaagaagaccagcagcagcagcaaggccggcttcaccgccagccccttcaccaacctgctgaatggcagcagccagcccaccaccaggaactacccagagctgaacaacaaccagtacaacagaagcagcaacagcaatggaggcaacctgaacagccccccaggcccccacagcgccaagacagaggagcacaccaccatcctgcggcccagctacacaggcctgagcagcagcagcgcccgcttcctgagccgcagcatcccctgcagctgcctgctgctggtgttcaggaagcccttcctgggcagccccctgctgagcctgcccatcagccacctgtag

SEQ ID NO: 146877 - DNA, 1416 bp, Artificial Sequence
  Description of Artificial Sequence: Synthetic coding sequence
atgaagaggaagtcagaaagaagaagctcctgggccgccgccccaccctgcagccgccgctgcagcagcaccagccctggggtgaagaagatccgcagcagcacccagcaggaccccaggagaagagacccccaggatgatgtgtacctggacatcacagaccggctgtgctttgccatcctgtacagccggcccaagagcgccagcaatgtgcactacttcagcattgacaatgagctggagtatgagaacttctatgctgactttggccccctgaacctggccatggtgtaccgctactgctgcaagatcaacaagaagctgaagagcatcaccatgctgaggaagaagatcgtgcacttcaccggcagtgaccagaggaagcaggccaatgctgccttcctggtgggctgctacatggtgatctacctgggccgcaccccagaggaggcctaccgcatcctgatctttggagagaccagctacatccccttcagagatgctgcctacggcagctgcaacttctacatcaccctgctggactgcttccacgctgtgaagaaggccatgcagtatggcttcctgaacttcaacagcttcaacctggatgaatatgagcactatgagaaggccgagaatggagacctgaactggatcatcccagaccgcttcatcgccttctgtggcccccacagccgggcccggctggagagcggctaccaccagcacagccctgagacctacatccagtacttcaagaaccacaacgtgaccaccatcatccggctgaacaagaggatgtatgatgccaagcgcttcacagatgctggctttgaccaccacgacctcttctttgctgatggcagcacccccacagatgccatcgtgaaggagttcctggacatctgtgaaaatgctgagggcgccatcgctgtgcactgcaaggccggcctgggccgcacaggcaccctgattgcctgctacatcatgaagcactacaggatgacagctgctgagaccatcgcctgggtgcgcatctgcaggcctggctctgtgattggcccccagcagcagttcctggtgatgaagcagaccaacctgtggctggagggggactacttccggcagaagctgaagggccaggagaatggccagcaccgggccgccttcagcaagctgctgtctggagtggatgacatcagcatcaatggagtggagaaccaggaccagcaggagcctgagccctacagtgatgatgatgagatcaatggagtgacccagggcgaccggctgcgggccctgaagagccggcggcagagcaagaccaatgccatccccctgacagatggctggctgagccaggccgtgaccttcctggaccggctgctgatctggctgggcatccacaaggactag

SEQ ID NO: 146878 - DNA, 1458 bp, Artificial Sequence
  Description of Artificial Sequence: Synthetic coding sequence
atgaagaggaagtcagaaagaagaagctcctgggccgccgccccaccctgcagccgccgctgcagcagcaccagccctggggtgaagaagatccgcagcagcacccagcaggaccccaggagaagagacccccaggatgatgtgtacctggacatcacagaccggctgtgctttgccatcctgtacagccggcccaagagcgccagcaatgtgcactacttcagcattgacaatgagctggagtatgagaacttctatgctgactttggccccctgaacctggccatggtgtaccgctactgctgcaagatcaacaagaagctgaagagcatcaccatgctgaggaagaagatcgtgcacttcaccggcagtgaccagaggaagcaggccaatgctgccttcctggtgggctgctacatggtgatctacctgggccgcaccccagaggaggcctaccgcatcctgatctttggagagaccagctacatccccttcagagatgctgcctacggcagctgcaacttctacatcaccctgctggactgcttccacgctgtgaagaaggccatgcagtatggcttcctgaacttcaacagcttcaacctggatgaatatgagcactatgagaaggccgagaatggagacctgaactggatcatcccagaccgcttcatcgccttctgtggcccccacagccgggcccggctggagagcggctaccaccagcacagccctgagacctacatccagtacttcaagaaccacaacgtgaccaccatcatccggctgaacaagaggatgtatgatgccaagcgcttcacagatgctggctttgaccaccacgacctcttctttgctgatggcagcacccccacagatgccatcgtgaaggagttcctggacatctgtgaaaatgctgagggcgccatcgctgtgcactgcaaggccggcctgggccgcacaggcaccctgattgcctgctacatcatgaagcactacaggatgacagctgctgagaccatcgcctgggtgcgcatctgcaggcctggctctgtgattggcccccagcagcagttcctggtgatgaagcagaccaacctgtggctggagggggactacttccggcagaagctgaagggccaggagaatggccagcaccgggccgccttcagcaagctgctgtctggagtggatgacatcagcatcaatggagtggagaaccaggaccagcaggagcctgagccctacagtgatgatgatgagatcaatggagtgacccagggcgaccggctgcgggccctgaagagccggcggcagagcaagaccaatgccatccccctgacctgccccctggccgtgctgaccagcgccctgtgcagcgtggtgatctggtggatcgtgtgtgactacatcctgcccatcctgctcttctgcctggatggcttccgcacccagtag

SEQ ID NO: 146879 - DNA, 1380 bp, Artificial Sequence
  Description of Artificial Sequence: Synthetic coding sequence
atgaagaggaagtcagaaagaagaagctcctgggccgccgccccaccctgcagccgccgctgcagcagcaccagccctggggtgaagaagatccgcagcagcacccagcaggaccccaggagaagagacccccaggatgatgtgtacctggacatcacagaccggctgtgctttgccatcctgtacagccggcccaagagcgccagcaatgtgcactacttcagcattgacaatgagctggagtatgagaacttctatgctgactttggccccctgaacctggccatggtgtaccgctactgctgcaagatcaacaagaagctgaagagcatcaccatgctgaggaagaagatcgtgcacttcaccggcagtgaccagaggaagcaggccaatgctgccttcctggtgggctgctacatggtgatctacctgggccgcaccccagaggaggcctaccgcatcctgatctttggagagaccagctacatccccttcagagatgctgcctacggcagctgcaacttctacatcaccctgctggactgcttccacgctgtgaagaaggccatgcagtatggcttcctgaacttcaacagcttcaacctggatgaatatgagcactatgagaaggccgagaatggagacctgaactggatcatcccagaccgcttcatcgccttctgtggcccccacagccgggcccggctggagagcggctaccaccagcacagccctgagacctacatccagtacttcaagaaccacaacgtgaccaccatcatccggctgaacaagaggatgtatgatgccaagcgcttcacagatgctggctttgaccaccacgacctcttctttgctgatggcagcacccccacagatgccatcgtgaaggagttcctggacatctgtgaaaatgctgagggcgccatcgctgtgcactgcaaggccggcctgggccgcacaggcaccctgattgcctgctacatcatgaagcactacaggatgacagctgctgagaccatcgcctgggtgcgcatctgcaggcctggctctgtgattggcccccagcagcagttcctggtgatgaagcagaccaacctgtggctggagggggactacttccggcagaagctgaagggccaggagaatggccagcaccgggccgccttcagcaagctgctgtctggagtggatgacatcagcatcaatggagtggagaaccaggaccagcaggagcctgagccctacagtgatgatgatgagatcaatggagtgacccagggcgaccggctgcgggccctgaagagccggcggcagagcaagaccaatgccatccccctgaccctgagcatcagcaggaccaagacagtgctgaggtag

SEQ ID NO: 146880 - DNA, 1497 bp, Artificial Sequence
  Description of Artificial Sequence: Synthetic coding sequence
atgaagaggaagtcagaaagaagaagctcctgggccgccgccccaccctgcagccgccgctgcagcagcaccagccctggggtgaagaagatccgcagcagcacccagcaggaccccaggagaagagacccccaggatgatgtgtacctggacatcacagaccggctgtgctttgccatcctgtacagccggcccaagagcgccagcaatgtgcactacttcagcattgacaatgagctggagtatgagaacttctatgctgactttggccccctgaacctggccatggtgtaccgctactgctgcaagatcaacaagaagctgaagagcatcaccatgctgaggaagaagatcgtgcacttcaccggcagtgaccagaggaagcaggccaatgctgccttcctggtgggctgctacatggtgatctacctgggccgcaccccagaggaggcctaccgcatcctgatctttggagagaccagctacatccccttcagagatgctgcctacggcagctgcaacttctacatcaccctgctggactgcttccacgctgtgaagaaggccatgcagtatggcttcctgaacttcaacagcttcaacctggatgaatatgagcactatgagaaggccgagaatggagacctgaactggatcatcccagaccgcttcatcgccttctgtggcccccacagccgggcccggctggagagcggctaccaccagcacagccctgagacctacatccagtacttcaagaaccacaacgtgaccaccatcatccggctgaacaagaggatgtatgatgccaagcgcttcacagatgctggctttgaccaccacgacctcttctttgctgatggcagcacccccacagatgccatcgtgaaggagttcctggacatctgtgaaaatgctgagggcgccatcgctgtgcactgcaaggccggcctgggccgcacaggcaccctgattgcctgctacatcatgaagcactacaggatgacagctgctgagaccatcgcctgggtgcgcatctgcaggcctggctctgtgattggcccccagcagcagttcctggtgatgaagcagaccaacctgtggctggagggggactacttccggcagaagctgaagggccaggagaatggccagcaccgggccgccttcagcaagctgctgtctggagtggatgacatcagcatcaatggagtggagaaccaggaccagcaggagcctgagccctacagtgatgatgatgagatcaatggagtgacccagggcgaccggctgcgggccctgaagagccggcggcagagcaagaccaatgccatccccctgaccgtcatcctgcagagctctgtgcagagctgcaagaccagcgagcccaacatcagcggcagcgctggcatcaccaagaggaccaccaggtctgccagcaggaagagctctgtgaagagcctgagcatcagcaggaccaagacagtgctgaggtag

SEQ ID NO: 146881 - DNA, 1386 bp, Artificial Sequence
  Description of Artificial Sequence: Synthetic coding sequence
atgagccgggagggcgctggggccgccctggtggccgaggtgatcaaggaccggctgtgctttgccatcctgtacagccggcccaagagcgccagcaatgtgcactacttcagcattgacaatgagctggagtatgagaacttctacgccgactttggccccctgaacctggccatggtgtaccgctactgctgcaagatcaacaagaagctgaagagcatcaccatgctgaggaagaagatcgtgcacttcaccggcagtgaccagaggaagcaggccaatgctgccttcctggtgggctgctacatggtgatctacctgggccgcaccccagaggaggcctaccgcatcctgatctttggagagaccagctacatccccttcagagatgctgcctacggcagctgcaacttctacatcaccctgctggactgcttccacgctgtgaagaaggccatgcagtatggcttcctgaacttcaacagcttcaacctggatgaatatgagcactatgagaaggcagaaaatggagacctgaactggatcatcccagaccgcttcatcgccttctgtggcccccacagccgggcccggctggagagcggctaccaccagcacagccctgagacctacatccagtacttcaagaaccacaacgtgaccaccatcatccggctgaacaagaggatgtatgatgccaagcgcttcacagatgctggctttgaccaccacgacctcttctttgctgatggcagcacccccacagatgccatcgtgaaggagttcctggacatctgtgaaaatgctgagggcgccatcgctgtgcactgcaaggccggcctgggccgcacaggcaccctcatcgcctgctacatcatgaagcactacaggatgacagctgctgagaccatcgcctgggtgcgcatctgccggcccggcagcgtcatcggcccccagcagcagttcctggtgatgaagcagaccaacctgtggctggagggggactacttccggcagaagctgaagggccaggagaatggccagcacagagctgccttcagcaagctgctgagcggcgtggatgacatcagcatcaacggggtggagaaccaggaccagcaggagcctgagccctacagtgatgatgatgagatcaacggggtgacccagggcgaccggctgcgggccctgaagagccggcggcagagcaagaccaatgccatccccctgaccgtcatcctgcagagctctgtgcagagctgcaagaccagcgagcccaacatcagcggcagcgctggcatcaccaagaggaccaccaggtctgccagcaggaagagctctgtgaagagcctgagcatcagcaggaccaagacagtgctgaggtag

SEQ ID NO: 146882 - DNA, 1458 bp, Artificial Sequence; identical to SEQ ID NO: 146878
  Description of Artificial Sequence: Synthetic coding sequence

SEQ ID NO: 146883 - DNA, 5346 bp, Artificial Sequence
  Description of Artificial Sequence: Synthetic coding sequence
atgtctggagaggtgcggctgcggcagctggagcagttcatcctggatggccctgcccagaccaacggccagtgcttctctgtggagaccctgctggacatcctgatctgcctgtatgatgagtgcaacaacagccccctgcggcgggagaagaacatcctggagtacctggagtgggccaagcccttcaccagcaaggtgaagcagatgaggctgcacagagaagattttgagatcctgaaggtgattggccgcggggccttcggggaggtggccgtggtgaagctgaagaatgctgacaaggtgtttgccatgaagatcctgaacaagtgggagatgctgaagagagctgagacagcctgcttccgggaggagagagatgtgctggtgaatggagacaacaagtggatcaccaccctgcactacgccttccaggatgacaacaacctgtacctggtgatggactactacgtgggcggggacctgctgaccctgctgagcaagtttgaggaccggctgcctgaggacatggcccgcttctacctggccgagatggtgattgccattgattctgtgcaccagctgcactacgtgcaccgggacatcaagccagacaacatcctgatggacatgaatggccacatccggctggccgactttggcagctgcctgaagctgatggaggatggcaccgtgcagagctctgtggccgtgggcaccccagactacatcagccctgagatcctgcaggccatggaggatggcaagggccgctatggcccagaatgtgactggtggagcctgggcgtgtgcatgtatgagatgctgtatggagagacccccttctacgccgagagcctggtggagacctacggcaagatcatgaaccacaaggagcgcttccagtttcctgcccaggtgacagatgtgtctgaaaatgccaaggacctgatcagaagactcatctgcagccgggagcaccggctgggccagaatggaattgaggacttcaagaagcaccccttcttcagcggcatcgactgggacaacatccggaactgtgaggccccctacatccctgaggtgagcagccccacagacaccagcaactttgatgtggatgatgactgcctgaagaacagcgagaccatgcccccacccacccacacagccttcagcggccaccacctgccctttgtgggcttcacctacaccagcagctgtgtgctgagtgacaggagctgcctgcgggtgacagctggccccaccagcctggacctggatgtgaatgtgcagaggaccctggacaacaacctggccacagaggcctatgaaagacgcatcaagaggctggagcaggagaagctggagctgagcaggaagctgcaggagagcacccagacagtgcaggccctgcagtacagcacagtggatggccccctgacagccagcaaggacctggagatcaagaacctgaaggaggagattgagaagctgaggaagcaggtgacagagagcagccacctggagcagcagctggaggaggccaatgctgtgcggcaggagctggatgatgccttccggcagatcaaggcctatgagaagcagatcaagaccctgcagcaggagcgggaggacctgaacaaggagctggtgcaggccagcgagcggctgaagaaccagagcaaggagctgaaggatgcccactgccagaggaagctggccatgcaggagttcatggagatcaatgaaaggctgacagagctgcacacccagaagcagaagctggcccggcacgtgcgggacaaggaggaggaggtggacctggtgatgcagaaggtggagagcctgcggcaggagctgcggaggacagagcgggccaagaaggagctggaggtgcacacagaggccctggccgctgaggccagcaaggacaggaagctgcgggagcagagcgagcactacagcaagcagctggagaatgagctggagggcctgaagcagaagcagatctcctacagccctggggtgtgcagcattgagcaccagcaggagatcaccaagctgaagacagacctggagaagaagagcatcttctatgaggaggagctgagcaagcgggagggcatccacgccaatgagatcaagaacctgaagaaggagctgcatgattctgagggccagcagctggccctgaacaaggagatcatgatcctgaaggacaagctggagaagacccggcgggagagccagagcgagcgggaggagtttgaaagtgagttcaagcagcagtatgagcgggagaaggtgctgctgacagaggagaacaagaagctgaccagcgagctggacaagctgaccaccctgtatgagaacctgagcatccacaaccagcagctggaggaggaggtgaaggacctggccgacaagaaggagagcgtggcccactgggaggcccagatcacagagatcatccagtgggtgtctgatgagaaggatgcccggggctacctgcaggccctggccagcaagatgacagaggagctggaggccctgaggaacagcagcctgggcacccgggccacagacatgccctggaagatgagaagatttgccaagctggacatgtctgcccggctggagctgcagagcgccctggatgctgagatccgggccaagcaggccatccaggaggagctgaacaaggtgaaggccagcaacatcatcacagagtgcaagctgaaggacagcgagaagaagaacctggagctgctgtctgaaattgagcagctgatcaaggacacagaggagctgcggtctgagaagggcatcgagcaccaggacagccagcacagcttcctggccttcctgaacacccccacagatgccctggaccagtttgaaacagtggacagcacccccctgtctgtgcacacccccaccctgaggaagaagggctgccccggcagcacaggcttcccccccaagaggaagacccaccagttctttgtgaagagcttcaccacccccaccaagtgccaccagtgcaccagcctgatggtgggcctcatccggcagggctgcagctgtgaggtgtgtggcttcagctgccacatcacctgtgtgaacaaggcccccaccacctgccctgtgcccccagagcagaccaagggccccctgggcatcgacccccagaagggcatcggcacagcctatgagggccacgtgcgcatccccaagccagctggggtgaagaagggctggcagagggccctggccatcgtgtgtgacttcaagctgttcctgtatgacattgctgagggcaaggccagccagcccagcgtggtgatcagccaggtgattgacatgagagatgaggagttctctgtgtcctctgtgctggccagtgatgtgatccacgccagcaggaaggacatcccctgcatcttccgggtgacagccagccagctgagcgccagcaacaacaagtgcagcatcctgatgctggccgacacagaaaatgagaagaacaagtgggtgggcgtgctgtctgagctgcacaagatcctgaagaagaacaagttccgggacagatctgtgtatgtgcccaaggaggcctatgacagcaccctgcccctcatcaagaccacccaggccgccgccatcatcgaccacgagcgcatcgccctgggcaatgaggagggcctgtttgtggtgcacgtgaccaaggatgagatcatccgggtgggggacaacaagaagatccaccagatcgagctgatccccaatgaccagctggtggccgtcatctctggaagaaacagacatgtgcggctcttccccatgtctgccctggatggccgggagacagacttctacaagctgtctgagaccaagggctgccagacagtgaccagcggcaaggtgagacatggagccctgacctgcctgtgtgtggccatgaagaggcaggtgctgtgctatgagctgttccagagcaagaccaggcacaggaagttcaaggagatccaggtgccctacaacgtgcagtggatggccatcttcagcgagcagctgtgtgtgggcttccagagcggcttcctgcgctaccccctgaatggagagggcaacccctacagcatgctgcacagcaatgaccacaccctgtccttcatcgcccaccagcccatggatgccatctgtgctgtggagatcagcagcaaggagtacctgctgtgcttcaacagcatcggcatctacacagactgccagggccgccgcagccggcagcaggagctgatgtggccagccaaccccagcagctgctgctacaatgccccctacctgtctgtgtacagtgaaaatgctgtggacatctttgatgtgaacagcatggagtggatccagaccctgcccctgaagaaggtgcggcccctgaacaatgaaggcagcctgaacctgctgggcctggagaccatccgcctcatctacttcaagaacaagatggccgagggagatgagctggtggtgcctgagaccagtgacaacagcaggaagcagatggtgaggaacatcaacaacaagaggcgctacagcttccgggtgcctgaggaggagaggatgcagcagaggcgggagatgctgcgggaccctgagatgaggaacaagctgatcagcaaccccaccaacttcaaccacatcgcccacatgggccctggagatggcatccagatcctgaaggacctgcccatgcctggcttcccctaccccagcccccaccaccacagcggcctcatcagcagccccatcaactttgagcacatctaccacatgacagtgaacagcgctgagaagttcctgagcccagacagcatcaaccctgagtacagccccagcctgcggtctgtgcccggcacccccagcttcatgaccctgaggaacccccggccccaggagagcaggacagtgttcagcggctctgtgtccatccccagcatcaccaagagcaggcctgagcccggccgctccatgtctgccagcagcggcctgagcgcccggagcagcgcccagaatggaagtgccctgaagcgggagttcagcggcggcagctacagcgccaagaggcagcccatgcccagccccagcgagggcagcctgagcagcggcggcatggaccagggcagtgatgccccagcccgggactttgatggagaggacagcgacagccccaggcacagcacagccagcaacagcagcaacctgagcagcccccccagccctgccagccccaggaagaccaagagcctgagcctggagagcacagaccggggctcctgggacccctag

SEQ ID NO: 146884 - DNA, 2457 bp, Artificial Sequence
  Description of Artificial Sequence: Synthetic coding sequence
atgatcctgaaggacaagctggagaagacccggcgggagagccagagcgagcgggaggagtttgaaagtgagttcaagcagcagtatgagcgggagaaggtgctgctgacagaggagaacaagaagctgaccagcgagctggacaagctgaccaccctgtatgagaacctgagcatccacaaccagcagctggaggaggaggtgaaggacctggccgacaagaaggagagcgtggcccactgggaggcccagatcacagagatcatccagtgggtgtctgatgagaaggatgcccggggctacctgcaggccctggccagcaagatgacagaggagctggaggccctgaggaacagcagcctgggcacccgggccacagacatgccctggaagatgagaagatttgccaagctggacatgtctgcccggctggagctgcagagcgccctggatgctgagatccgggccaagcaggccatccaggaggagctgaacaaggtgaaggccagcaacatcatcacagagtgcaagctgaaggacagcgagaagaagaacctggagctgctgtctgaaattgagcagctgatcaaggacacagaggagctgcggtctgagaagggcatcgagcaccaggacagccagcacagcttcctggccttcctgaacacccccacagatgccctggaccagtttgaggacagcttcagcagcagcagcagcagcctgattgacttcctggatgacacagatcctgtggagaacacctacgtgtggaaccccagcgtgaagttccacatccagagccgcagcaccagccccagcaccagcagcgaggccgagcctgtgaagacagtggacagcacccccctgtctgtgcacacccccaccctgaggaagaagggctgccccggcagcacaggcttcccccccaagaggaagacccaccagttctttgtgaagagcttcaccacccccaccaagtgccaccagtgcaccagcctgatggtgggcctcatccggcagggctgcagctgtgaggtgtgtggcttcagctgccacatcacctgtgtgaacaaggcccccaccacctgccctgtgcccccagagcagaccaagggccccctgggcatcgacccccagaagggcattggaacagcctatgagggccacgtgcgcatccccaagccagctggggtgaagaagggctggcagagggccctggccatcgtgtgtgacttcaagctgttcctgtatgacattgctgagggcaaggccagccagcccagcgtggtgatcagccaggtgattgacatgagagatgaggagttctctgtgtcctctgtgctggccagtgatgtgattcatgccagcaggaaggacatcccctgcatcttccgggtgacagccagccagctgagcgccagcaacaacaagtgcagcatcctgatgctggccgacacagaaaatgagaagaacaagtgggtgggcgtgctgtctgagctgcacaagatcctgaagaagaacaagttccgggacagatctgtgtatgtgcccaaggaggcctatgacagcaccctgcccctcatcaagaccacccaggccgccgccatcatcgaccacgagagaattgccctgggcaatgaggagggcctgtttgtggtgcacgtgaccaaggatgagatcatccgggtgggggacaacaagaagatccaccagatcgagctgatccccaatgaccagctggtggccgtcatcagcggcaggaacagacatgtgcggctcttccccatgtctgccctggatggccgggagacagacttctacaagctgtctgagaccaagggctgccagacagtgaccagcggcaaggtgcgccacggggccctgacctgcctgtgtgtggccatgaagaggcaggtgctgtgctatgagctgttccagagcaagaccaggcacaggaagttcaaggagatccaggtgccctacaacgtgcagtggatggccatcttcagcgagcagctgtgtgtgggcttccagagcggcttcctgcgctaccccctgaatggagagggcaacccctacagcatgctgcacagcaatgaccacaccctgtccttcatcgcccaccagcccatggatgccatctgtgctgtggagatcagcagcaaggagtacctgctgtgcttcaacagcatcggcatctacacagactgccagggcagaagaagccggcagcaggagctgatgtggccagccaaccccagcagctgctgctacaatgccccctacctgtctgtgtacagtgaaaatgctgtggacatctttgatgtgaacagcatggagtggatccagaccctgcccctgaagaaggtgcggcccctgaacaatgaaggcagcctgaacctgctgggcctggagaccatccgcctcatctacttcaagaacaagatggcctag

SEQ ID NO: 146885 - DNA, 5076 bp, Artificial Sequence
  Description of Artificial Sequence: Synthetic coding sequence
atgtctggagaggtgcggctgcggcagctggagcagttcatcctggatggccctgcccagaccaacggccagtgcttctctgtggagaccctgctggacatcctgatctgcctgtatgatgagtgcaacaacagccccctgcggcgggagaagaacatcctggagtacctggagtgggccaagcccttcaccagcaaggtgaagcagatgaggctgcacagagaagattttgagatcctgaaggtgattggccgcggggccttcggggaggtggccgtggtgaagctgaagaatgctgacaaggtgtttgccatgaagatcctgaacaagtgggagatgctgaagagagctgagacagcctgcttccgggaggagagagatgtgctggtgaatggagacaacaagtggatcaccaccctgcactacgccttccaggatgacaacaacctgtacctggtgatggactactacgtgggcggggacctgctgaccctgctgagcaagtttgaggaccggctgcctgaggacatggcccgcttctacctggccgagatggtgattgccattgattctgtgcaccagctgcactacgtgcaccgggacatcaagccagacaacatcctgatggacatgaatggccacatccggctggccgactttggcagctgcctgaagctgatggaggatggcaccgtgcagagctctgtggccgtgggcaccccagactacatcagccctgagatcctgcaggccatggaggatggcaagggccgctatggcccagaatgtgactggtggagcctgggcgtgtgcatgtatgagatgctgtatggagagacccccttctacgccgagagcctggtggagacctacggcaagatcatgaaccacaaggagcgcttccagtttcctgcccaggtgacagatgtgtctgaaaatgccaaggacctgatcagaagactcatctgcagccgggagcaccggctgggccagaatggaattgaggacttcaagaagcaccccttcttcagcggcatcgactgggacaacatccggaactgtgaggccccctacatccctgaggtgagcagccccacagacaccagcaactttgatgtggatgatgactgcctgaagaacagcgagaccatgcccccacccacccacacagccttcagcggccaccacctgccctttgtgggcttcacctacaccagcagctgtgtgctgagtgacaggagctgcctgcgggtgacagctggccccaccagcctggacctggatgtgaatgtgcagaggaccctggacaacaacctggccacagaggcctatgaaagacgcatcaagaggctggagcaggagaagctggagctgagcaggaagctgcaggagagcacccagacagtgcaggccctgcagtacagcacagtggatggccccctgacagccagcaaggacctggagatcaagaacctgaaggaggagattgagaagctgaggaagcaggtgacagagagcagccacctggagcagcagctggaggaggccaatgctgtgcggcaggagctggatgatgccttccggcagatcaaggcctatgagaagcagatcaagaccctgcagcaggagcgggaggacctgaacaaggagctggtgcaggccagcgagcggctgaagaaccagagcaaggagctgaaggatgcccactgccagaggaagctggccatgcaggagttcatggagatcaatgaaaggctgacagagctgcacacccagaagcagaagctggcccggcacgtgcgggacaaggaggaggaggtggacctggtgatgcagaaggtggagagcctgcggcaggagctgcggaggacagagcgggccaagaaggagctggaggtgcacacagaggccctggccgctgaggccagcaaggacaggaagctgcgggagcagagcgagcactacagcaagcagctggagaatgagctggagggcctgaagcagaagcagatctcctacagccctggggtgtgcagcattgagcaccagcaggagatcaccaagctgaagacagacctggagaagaagagcatcttctatgaggaggagctgagcaagcgggagggcatccacgccaatgagatcaagaacctgaagaaggagctgcatgattctgagggccagcagctggccctgaacaaggagatcatgatcctgaaggacaagctggagaagacccggcgggagagccagagcgagcgggaggagtttgaaagtgagttcaagcagcagtatgagcgggagaaggtgctgctgacagaggagaacaagaagctgaccagcgagctggacaagctgaccaccctgtatgagaacctgagcatccacaaccagcagctggaggaggaggtgaaggacctggccgacaagaaggagagcgtggcccactgggaggcccagatcacagagatcatccagtgggtgtctgatgagaaggatgcccggggctacctgcaggccctggccagcaagatgacagaggagctggaggccctgaggaacagcagcctgggcacccgggccacagacatgccctggaagatgagaagatttgccaagctggacatgtctgcccggctggagctgcagagcgccctggatgctgagatccgggccaagcaggccatccaggaggagctgaacaaggtgaaggccagcaacatcatcacagagtgcaagctgaaggacagcgagaagaagaacctggagctgctgtctgaaattgagcagctgatcaaggacacagaggagctgcggtctgagaagggcatcgagcaccaggacagccagcacagcttcctggccttcctgaacacccccacagatgccctggaccagtttgagaggaagacccaccagttctttgtgaagagcttcaccacccccaccaagtgccaccagtgcaccagcctgatggtgggcctcatccggcagggctgcagctgtgaggtgtgtggcttcagctgccacatcacctgtgtgaacaaggcccccaccacctgccctgtgcccccagagcagaccaagggccccctgggcatcgacccccagaagggcatcggcacagcctatgagggccacgtgcgcatccccaagccagctggggtgaagaagggctggcagagggccctggccatcgtgtgtgacttcaagctgttcctgtatgacattgctgagggcaaggccagccagcccagcgtggtgatcagccaggtgattgacatgagagatgaggagttctctgtgtcctctgtgctggccagtgatgtgatccacgccagcaggaaggacatcccctgcatcttccgggtgacagccagccagctgagcgccagcaacaacaagtgcagcatcctgatgctggccgacacagaaaatgagaagaacaagtgggtgggcgtgctgtctgagctgcacaagatcctgaagaagaacaagttccgggacagatctgtgtatgtgcccaaggaggcctatgacagcaccctgcccctcatcaagaccacccaggccgccgccatcatcgaccacgagcgcatcgccctgggcaatgaggagggcctgtttgtggtgcacgtgaccaaggatgagatcatccgggtgggggacaacaagaagatccaccagatcgagctgatccccaatgaccagctggtggccgtcatctctggaagaaacagacatgtgcggctcttccccatgtctgccctggatggccgggagacagacttctacaagctgtctgagaccaagggctgccagacagtgaccagcggcaaggtgagacatggagccctgacctgcctgtgtgtggccatgaagaggcaggtgctgtgctatgagctgttccagagcaagaccaggcacaggaagttcaaggagatccaggtgccctacaacgtgcagtggatggccatcttcagcgagcagctgtgtgtgggcttccagagcggcttcctgcgctaccccctgaatggagagggcaacccctacagcatgctgcacagcaatgaccacaccctgtccttcatcgcccaccagcccatggatgccatctgtgctgtggagatcagcagcaaggagtacctgctgtgcttcaacagcatcggcatctacacagactgccagggccgccgcagccggcagcaggagctgatgtggccagccaaccccagcagctgctgctacaatgccccctacctgtctgtgtacagtgaaaatgctgtggacatctttgatgtgaacagcatggagtggatccagaccctgcccctgaagaaggtgcggcccctgaacaatgaaggcagcctgaacctgctgggcctggagaccatccgcctcatctacttcaagaacaagatggccgagggagatgagctggtggtgcctgagaccagtgacaacagcaggaagcagatggtgaggaacatcaacaacaagaggcgctacagcttccgggtgcctgaggaggagaggatgcagcagaggcgggagatgctgcgggaccctgagatgaggaacaagctgatcagcaaccccaccaacttcaaccacatcgcccacatgggccctggagatggcatccagatcctgaaggacctgcccatgaacccccggccccaggagagcaggacagtgttcagcggctctgtgtccatccccagcatcaccaagagcaggcctgagcccggccgctccatgtctgccagcagcggcctgagcgcccggagcagcgcccagaatggaagtgccctgaagcgggagttcagcggcggcagctacagcgccaagaggcagcccatgcccagccccagcgagggcagcctgagcagcggcggcatggaccagggcagtgatgccccagcccgggactttgatggagaggacagcgacagccccaggcacagcacagccagcaacagcagcaacctgagcagcccccccagccctgccagccccaggaagaccaagagcctgagcctggagagcacagaccggggctcctgggacccctag

SEQ ID NO: 146886 - DNA, 5199 bp, Artificial Sequence
  Description of Artificial Sequence: Synthetic coding sequence
atgtctggagaggtgcggctgcggcagctggagcagttcatcctggatggccctgcccagaccaacggccagtgcttctctgtggagaccctgctggacatcctgatctgcctgtatgatgagtgcaacaacagccccctgcggcgggagaagaacatcctggagtacctggagtgggccaagcccttcaccagcaaggtgaagcagatgaggctgcacagagaagattttgagatcctgaaggtgattggccgcggggccttcggggaggtggccgtggtgaagctgaagaatgctgacaaggtgtttgccatgaagatcctgaacaagtgggagatgctgaagagagctgagacagcctgcttccgggaggagagagatgtgctggtgaatggagacaacaagtggatcaccaccctgcactacgccttccaggatgacaacaacctgtacctggtgatggactactacgtgggcggggacctgctgaccctgctgagcaagtttgaggaccggctgcctgaggacatggcccgcttctacctggccgagatggtgattgccattgattctgtgcaccagctgcactacgtgcaccgggacatcaagccagacaacatcctgatggacatgaatggccacatccggctggccgactttggcagctgcctgaagctgatggaggatggcaccgtgcagagctctgtggccgtgggcaccccagactacatcagccctgagatcctgcaggccatggaggatggcaagggccgctatggcccagaatgtgactggtggagcctgggcgtgtgcatgtatgagatgctgtatggagagacccccttctacgccgagagcctggtggagacctacggcaagatcatgaaccacaaggagcgcttccagtttcctgcccaggtgacagatgtgtctgaaaatgccaaggacctgatcagaagactcatctgcagccgggagcaccggctgggccagaatggaattgaggacttcaagaagcaccccttcttcagcggcatcgactgggacaacatccggaactgtgaggccccctacatccctgaggtgagcagccccacagacaccagcaactttgatgtggatgatgactgcctgaagaacagcgagaccatgcccccacccacccacacagccttcagcggccaccacctgccctttgtgggcttcacctacaccagcagctgtgtgctgagtgacaggagctgcctgcgggtgacagctggccccaccagcctggacctggatgtgaatgtgcagaggaccctggacaacaacctggccacagaggcctatgaaagacgcatcaagaggctggagcaggagaagctggagctgagcaggaagctgcaggagagcacccagacagtgcaggccctgcagtacagcacagtggatggccccctgacagccagcaaggacctggagatcaagaacctgaaggaggagattgagaagctgaggaagcaggtgacagagagcagccacctggagcagcagctggaggaggccaatgctgtgcggcaggagctggatgatgccttccggcagatcaaggcctatgagaagcagatcaagaccctgcagcaggagcgggaggacctgaacaaggagctggtgcaggccagcgagcggctgaagaaccagagcaaggagctgaaggatgcccactgccagaggaagctggccatgcaggagttcatggagatcaatgaaaggctgacagagctgcacacccagaagcagaagctggcccggcacgtgcgggacaaggaggaggaggtggacctggtgatgcagaaggtggagagcctgcggcaggagctgcggaggacagagcgggccaagaaggagctggaggtgcacacagaggccctggccgctgaggccagcaaggacaggaagctgcgggagcagagcgagcactacagcaagcagctggagaatgagctggagggcctgaagcagaagcagatctcctacagccctggggtgtgcagcattgagcaccagcaggagatcaccaagctgaagacagacctggagaagaagagcatcttctatgaggaggagctgagcaagcgggagggcatccacgccaatgagatcaagaacctgaagaaggagctgcatgattctgagggccagcagctggccctgaacaaggagatcatgatcctgaaggacaagctggagaagacccggcgggagagccagagcgagcgggaggagtttgaaagtgagttcaagcagcagtatgagcgggagaaggtgctgctgacagaggagaacaagaagctgaccagcgagctggacaagctgaccaccctgtatgagaacctgagcatccacaaccagcagctggaggaggaggtgaaggacctggccgacaagaaggagagcgtggcccactgggaggcccagatcacagagatcatccagtgggtgtctgatgagaaggatgcccggggctacctgcaggccctggccagcaagatgacagaggagctggaggccctgaggaacagcagcctgggcacccgggccacagacatgccctggaagatgagaagatttgccaagctggacatgtctgcccggctggagctgcagagcgccctggatgctgagatccgggccaagcaggccatccaggaggagctgaacaaggtgaaggccagcaacatcatcacagagtgcaagctgaaggacagcgagaagaagaacctggagctgctgtctgaaattgagcagctgatcaaggacacagaggagctgcggtctgagaagggcatcgagcaccaggacagccagcacagcttcctggccttcctgaacacccccacagatgccctggaccagtttgagaggagccccagctgcaccccagccagcaagggccgcaggacagtggacagcacccccctgtctgtgcacacccccaccctgaggaagaagggctgccccggcagcacaggcttcccccccaagaggaagacccaccagttctttgtgaagagcttcaccacccccaccaagtgccaccagtgcaccagcctgatggtgggcctcatccggcagggctgcagctgtgaggtgtgtggcttcagctgccacatcacctgtgtgaacaaggcccccaccacctgccctgtgcccccagagcagaccaagggccccctgggcatcgacccccagaagggcattggaacagcctatgagggccacgtgcgcatccccaagccagctggggtgaagaagggctggcagagggccctggccatcgtgtgtgacttcaagctgttcctgtatgacattgctgagggcaaggccagccagcccagcgtggtgatcagccaggtgattgacatgagagatgaggagttctctgtgtcctctgtgctggccagtgatgtgattcatgccagcaggaaggacatcccctgcatcttccgggtgacagccagccagctgagcgccagcaacaacaagtgcagcatcctgatgctggccgacacagaaaatgagaagaacaagtgggtgggcgtgctgtctgagctgcacaagatcctgaagaagaacaagttccgggacagatctgtgtatgtgcccaaggaggcctatgacagcaccctgcccctcatcaagaccacccaggccgccgccatcatcgaccacgagagaattgccctgggcaatgaggagggcctgtttgtggtgcacgtgaccaaggatgagatcatccgggtgggggacaacaagaagatccaccagatcgagctgatccccaatgaccagctggtggccgtcatcagcggcaggaacagacatgtgcggctcttccccatgtctgccctggatggccgggagacagacttctacaagctgtctgagaccaagggctgccagacagtgaccagcggcaaggtgcgccacggggccctgacctgcctgtgtgtggccatgaagaggcaggtgctgtgctatgagctgttccagagcaagaccaggcacaggaagttcaaggagatccaggtgccctacaacgtgcagtggatggccatcttcagcgagcagctgtgtgtgggcttccagagcggcttcctgcgctaccccctgaatggagagggcaacccctacagcatgctgcacagcaatgaccacaccctgtccttcatcgcccaccagcccatggatgccatctgtgctgtggagatcagcagcaaggagtacctgctgtgcttcaacagcatcggcatctacacagactgccagggcagaagaagccggcagcaggagctgatgtggccagccaaccccagcagctgctgctacaatgccccctacctgtctgtgtacagtgaaaatgctgtggacatctttgatgtgaacagcatggagtggatccagaccctgcccctgaagaaggtgcggcccctgaacaatgaaggcagcctgaacctgctgggcctggagaccatccgcctcatctacttcaagaacaagatggccgagggagatgagctggtggtgcctgagaccagtgacaacagcaggaagcagatggtgaggaacatcaacaacaagaggcgctacagcttccgggtgcctgaggaggagaggatgcagcagaggcgggagatgctgcgggaccctgagatgaggaacaagctgatcagcaaccccaccaacttcaaccacatcgcccacatgggccctggagatggcatccagatcctgaaggacctgcccatgaacccccggccccaggagagcaggacagtgttttctggctctgtgtccatccccagcatcaccaagagcaggcctgagcccggccgctccatgtctgccagcagcggcctgagcgcccggagcagcgcccagaatggcagcgccctgaagcgggagttcagcggcggcagctacagcgccaagaggcagcccatgcccagccccagcgagggcagcctgagcagcggcggcatggaccagggcagtgatgccccagcccgggactttgatggagaagattctgacagccccaggcacagcacagccagcaacagcagcaacctgagcagcccccccagccctgccagccccaggaagaccaagagcctgagcctggagagcacagaccggggctcctgggacccctag

SEQ ID NO: 146887 - DNA, 5265 bp, Artificial Sequence
  Description of Artificial Sequence: Synthetic coding sequence
atgtctggagaggtgcggctgcggcagctggagcagttcatcctggatggccctgcccagaccaacggccagtgcttctctgtggagaccctgctggacatcctgatctgcctgtatgatgagtgcaacaacagccccctgcggcgggagaagaacatcctggagtacctggagtgggccaagcccttcaccagcaaggtgaagcagatgaggctgcacagagaagattttgagatcctgaaggtgattggccgcggggccttcggggaggtggccgtggtgaagctgaagaatgctgacaaggtgtttgccatgaagatcctgaacaagtgggagatgctgaagagagctgagacagcctgcttccgggaggagagagatgtgctggtgaatggagacaacaagtggatcaccaccctgcactacgccttccaggatgacaacaacctgtacctggtgatggactactacgtgggcggggacctgctgaccctgctgagcaagtttgaggaccggctgcctgaggacatggcccgcttctacctggccgagatggtgattgccattgattctgtgcaccagctgcactacgtgcaccgggacatcaagccagacaacatcctgatggacatgaatggccacatccggctggccgactttggcagctgcctgaagctgatggaggatggcaccgtgcagagctctgtggccgtgggcaccccagactacatcagccctgagatcctgcaggccatggaggatggcaagggccgctatggcccagaatgtgactggtggagcctgggcgtgtgcatgtatgagatgctgtatggagagacccccttctacgccgagagcctggtggagacctacggcaagatcatgaaccacaaggagcgcttccagtttcctgcccaggtgacagatgtgtctgaaaatgccaaggacctgatcagaagactcatctgcagccgggagcaccggctgggccagaatggaattgaggacttcaagaagcaccccttcttcagcggcatcgactgggacaacatccggaactgtgaggccccctacatccctgaggtgagcagccccacagacaccagcaactttgatgtggatgatgactgcctgaagaacagcgagaccatgcccccacccacccacacagccttcagcggccaccacctgccctttgtgggcttcacctacaccagcagctgtgtgctgagtgacaggagctgcctgcgggtgacagctggccccaccagcctggacctggatgtgaatgtgcagaggaccctggacaacaacctggccacagaggcctatgaaagacgcatcaagaggctggagcaggagaagctggagctgagcaggaagctgcaggagagcacccagacagtgcaggccctgcagtacagcacagtggatggccccctgacagccagcaaggacctggagatcaagaacctgaaggaggagattgagaagctgaggaagcaggtgacagagagcagccacctggagcagcagctggaggaggccaatgctgtgcggcaggagctggatgatgccttccggcagatcaaggcctatgagaagcagatcaagaccctgcagcaggagcgggaggacctgaacaaggagctggtgcaggccagcgagcggctgaagaaccagagcaaggagctgaaggatgcccactgccagaggaagctggccatgcaggagttcatggagatcaatgaaaggctgacagagctgcacacccagaagcagaagctggcccggcacgtgcgggacaaggaggaggaggtggacctggtgatgcagaaggtggagagcctgcggcaggagctgcggaggacagagcgggccaagaaggagctggaggtgcacacagaggccctggccgctgaggccagcaaggacaggaagctgcgggagcagagcgagcactacagcaagcagctggagaatgagctggagggcctgaagcagaagcagatctcctacagccctggggtgtgcagcattgagcaccagcaggagatcaccaagctgaagacagacctggagaagaagagcatcttctatgaggaggagctgagcaagcgggagggcatccacgccaatgagatcaagaacctgaagaaggagctgcatgattctgagggccagcagctggccctgaacaaggagatcatgatcctgaaggacaagctggagaagacccggcgggagagccagagcgagcgggaggagtttgaaagtgagttcaagcagcagtatgagcgggagaaggtgctgctgacagaggagaacaagaagctgaccagcgagctggacaagctgaccaccctgtatgagaacctgagcatccacaaccagcagctggaggaggaggtgaaggacctggccgacaagaaggagagcgtggcccactgggaggcccagatcacagagatcatccagtgggtgtctgatgagaaggatgcccggggctacctgcaggccctggccagcaagatgacagaggagctggaggccctgaggaacagcagcctgggcacccgggccacagacatgccctggaagatgagaagatttgccaagctggacatgtctgcccggctggagctgcagagcgccctggatgctgagatccgggccaagcaggccatccaggaggagctgaacaaggtgaaggccagcaacatcatcacagagtgcaagctgaaggacagcgagaagaagaacctggagctgctgtctgaaattgagcagctgatcaaggacacagaggagctgcggtctgagaagggcatcgagcaccaggacagccagcacagcttcctggccttcctgaacacccccacagatgccctggaccagtttgaaacagatcctgtggagaacacctacgtgtggaaccccagcgtgaagttccacatccagagccgcagcaccagccccagcaccagcagcgaggccgagcctgtgaagacagtggacagcacccccctgtctgtgcacacccccaccctgaggaagaagggctgccccggcagcacaggcttcccccccaagaggaagacccaccagttctttgtgaagagcttcaccacccccaccaagtgccaccagtgcaccagcctgatggtgggcctcatccggcagggctgcagctgtgaggtgtgtggcttcagctgccacatcacctgtgtgaacaaggcccccaccacctgccctgtgcccccagagcagaccaagggccccctgggcatcgacccccagaagggcattggaacagcctatgagggccacgtgcgcatccccaagccagctggggtgaagaagggctggcagagggccctggccatcgtgtgtgacttcaagctgttcctgtatgacattgctgagggcaaggccagccagcccagcgtggtgatcagccaggtgattgacatgagagatgaggagttctctgtgtcctctgtgctggccagtgatgtgattcatgccagcaggaaggacatcccctgcatcttccgggtgacagccagccagctgagcgccagcaacaacaagtgcagcatcctgatgctggccgacacagaaaatgagaagaacaagtgggtgggcgtgctgtctgagctgcacaagatcctgaagaagaacaagttccgggacagatctgtgtatgtgcccaaggaggcctatgacagcaccctgcccctcatcaagaccacccaggccgccgccatcatcgaccacgagagaattgccctgggcaatgaggagggcctgtttgtggtgcacgtgaccaaggatgagatcatccgggtgggggacaacaagaagatccaccagatcgagctgatccccaatgaccagctggtggccgtcatcagcggcaggaacagacatgtgcggctcttccccatgtctgccctggatggccgggagacagacttctacaagctgtctgagaccaagggctgccagacagtgaccagcggcaaggtgcgccacggggccctgacctgcctgtgtgtggccatgaagaggcaggtgctgtgctatgagctgttccagagcaagaccaggcacaggaagttcaaggagatccaggtgccctacaacgtgcagtggatggccatcttcagcgagcagctgtgtgtgggcttccagagcggcttcctgcgctaccccctgaatggagagggcaacccctacagcatgctgcacagcaatgaccacaccctgtccttcatcgcccaccagcccatggatgccatctgtgctgtggagatcagcagcaaggagtacctgctgtgcttcaacagcatcggcatctacacagactgccagggcagaagaagccggcagcaggagctgatgtggccagccaaccccagcagctgctgctacaatgccccctacctgtctgtgtacagtgaaaatgctgtggacatctttgatgtgaacagcatggagtggatccagaccctgcccctgaagaaggtgcggcccctgaacaatgaaggcagcctgaacctgctgggcctggagaccatccgcctcatctacttcaagaacaagatggccgagggagatgagctggtggtgcctgagaccagtgacaacagcaggaagcagatggtgaggaacatcaacaacaagaggcgctacagcttccgggtgcctgaggaggagaggatgcagcagaggcgggagatgctgcgggaccctgagatgaggaacaagctgatcagcaaccccaccaacttcaaccacatcgcccacatgggccctggagatggcatccagatcctgaaggacctgcccatgaacccccggccccaggagagcaggacagtgttttctggctctgtgtccatccccagcatcaccaagagcaggcctgagcccggccgctccatgtctgccagcagcggcctgagcgcccggagcagcgcccagaatggcagcgccctgaagcgggagttcagcggcggcagctacagcgccaagaggcagcccatgcccagccccagcgagggcagcctgagcagcggcggcatggaccagggcagtgatgccccagcccgggactttgatggagaagattctgacagccccaggcacagcacagccagcaacagcagcaacctgagcagcccccccagccctgccagccccaggaagaccaagagcctgagcctggagagcacagaccggggctcctgggacccctag

SEQ ID NO: 146888 - DNA, 4917 bp, Artificial Sequence
  Description of Artificial Sequence: Synthetic coding sequence
atgtctggagaggtgcggctgcggcagctggagcagttcatcctggatggccctgcccagaccaacggccagtgcttctctgtggagaccctgctggacatcctgatctgcctgtatgatgagtgcaacaacagccccctgcggcgggagaagaacatcctggagtacctggagtgggccaagcccttcaccagcaaggtgaagcagatgaggctgcacagagaagattttgagatcctgaaggtgattggccgcggggccttcggggaggtggccgtggtgaagctgaagaatgctgacaaggtgtttgccatgaagatcctgaacaagtgggagatgctgaagagagctgagacagcctgcttccgggaggagagagatgtgctggtgaatggagacaacaagtggatcaccaccctgcactacgccttccaggatgacaacaacctgtacctggtgatggactactacgtgggcggggacctgctgaccctgctgagcaagtttgaggaccggctgcctgaggacatggcccgcttctacctggccgagatggtgattgccattgattctgtgcaccagctgcactacgtgcaccgggacatcaagccagacaacatcctgatggacatgaatggccacatccggctggccgactttggcagctgcctgaagctgatggaggatggcaccgtgcagagctctgtggccgtgggcaccccagactacatcagccctgagatcctgcaggccatggaggatggcaagggccgctatggcccagaatgtgactggtggagcctgggcgtgtgcatgtatgagatgctgtatggagagacccccttctacgccgagagcctggtggagacctacggcaagatcatgaaccacaaggagcgcttccagtttcctgcccaggtgacagatgtgtctgaaaatgccaaggacctgatcagaagactcatctgcagccgggagcaccggctgggccagaatggaattgaggacttcaagaagcaccccttcttcagcggcatcgactgggacaacatccggaactgtgaggccccctacatccctgaggtgagcagccccacagacaccagcaactttgatgtggatgatgactgcctgaagaacagcgagaccatgcccccacccacccacacagccttcagcggccaccacctgccctttgtgggcttcacctacaccagcagctgtgtgctgagtgacaggagctgcctgcgggtgacagctggccccaccagcctggacctggatgtgaatgtgcagaggaccctggacaacaacctggccacagaggcctatgaaagacgcatcaagaggctggagcaggagaagctggagctgagcaggaagctgcaggagagcacccagacagtgcaggccctgcagtacagcacagtggatggccccctgacagccagcaaggacctggagatcaagaacctgaaggaggagattgagaagctgaggaagcaggtgacagagagcagccacctggagcagcagctggaggaggccaatgctgtgcggcaggagctggatgatgccttccggcagatcaaggcctatgagaagcagatcaagaccctgcagcaggagcgggaggacctgaacaagctggaggtgcacacagaggccctggccgctgaggccagcaaggacaggaagctgcgggagcagagcgagcactacagcaagcagctggagaatgagctggagggcctgaagcagaagcagatctcctacagccctggggtgtgcagcattgagcaccagcaggagatcaccaagctgaagacagacctggagaagaagagcatcttctatgaggaggagctgagcaagcgggagggcatccacgccaatgagatcaagaacctgaagaaggagctgcatgacagcgagggccagcagctggccctgaacaaggagatcatgatcctgaaggacaagctggagaagacccggcgggagagccagagcgagcgggaggagtttgagagcgagttcaagcagcagtatgaaagagagaaggtgctgctgacagaggagaacaagaagctgaccagcgagctggacaagctgaccaccctgtatgagaacctgagcatccacaaccagcagctggaggaggaggtgaaggacctggccgacaagaaggagagcgtggcccactgggaggcccagatcacagagatcatccagtgggtgtctgatgagaaggatgcccggggctacctgcaggccctggccagcaagatgacagaggagctggaggccctgaggaacagcagcctgggcacccgggccacagacatgccctggaagatgagaagatttgccaagctggacatgtctgcccggctggagctgcagagcgccctggatgctgagatccgggccaagcaggccatccaggaggagctgaacaaggtgaaggccagcaacatcatcacagagtgcaagctgaaggacagcgagaagaagaacctggagctgctgtctgaaattgagcagctgatcaaggacacagaggagctgcggtctgagaagggcatcgagcaccaggacagccagcacagcttcctggccttcctgaacacccccacagatgccctggaccagtttgagaccgtggacagcacccccctgtctgtgcacacccccaccctgaggaagaagggctgccccggcagcacaggcttcccccccaagaggaagacccaccagttctttgtgaagagcttcaccacccccaccaagtgccaccagtgcaccagcctgatggtgggcctcatccggcagggctgcagctgtgaggtgtgtggcttcagctgccacatcacctgtgtgaacaaggcccccaccacctgccctgtgcccccagagcagaccaagggccccctgggcatcgacccccagaagggcattggaacagcctatgagggccacgtgcgcatccccaagccagctggggtgaagaagggctggcagagggccctggccatcgtgtgtgacttcaagctgttcctgtatgacattgctgagggcaaggccagccagcccagcgtggtgatcagccaggtgattgacatgagagatgaggagttctctgtgtcctctgtgctggccagtgatgtgattcatgccagcaggaaggacatcccctgcatcttccgggtgacagccagccagctgagcgccagcaacaacaagtgcagcatcctgatgctggccgacacagaaaatgagaagaacaagtgggtgggcgtgctgtctgagctgcacaagatcctgaagaagaacaagttccgggacagatctgtgtatgtgcccaaggaggcctatgacagcaccctgcccctcatcaagaccacccaggccgccgccatcatcgaccacgagagaattgccctgggcaatgaggagggcctgtttgtggtgcacgtgaccaaggatgagatcatccgggtgggggacaacaagaagatccaccagatcgagctgatccccaatgaccagctggtggccgtcatcagcggcaggaacagacatgtgcggctcttccccatgtctgccctggatggccgggagacagacttctacaagctgtctgagaccaagggctgccagacagtgaccagcggcaaggtgcgccacggggccctgacctgcctgtgtgtggccatgaagaggcaggtgctgtgctatgagctgttccagagcaagaccaggcacaggaagttcaaggagatccaggtgccctacaacgtgcagtggatggccatcttcagcgagcagctgtgtgtgggcttccagagcggcttcctgcgctaccccctgaatggagagggcaacccctacagcatgctgcacagcaatgaccacaccctgtccttcatcgcccaccagcccatggatgccatctgtgctgtggagatcagcagcaaggagtacctgctgtgcttcaacagcatcggcatctacacagactgccagggcagaagaagccggcagcaggagctgatgtggccagccaaccccagcagctgctgctacaatgccccctacctgtctgtgtacagtgaaaatgctgtggacatctttgatgtgaacagcatggagtggatccagaccctgcccctgaagaaggtgcggcccctgaacaatgaaggcagcctgaacctgctgggcctggagaccatccgcctcatctacttcaagaacaagatggccgagggagatgagctggtggtgcctgagaccagtgacaacagcaggaagcagatggtgaggaacatcaacaacaagaggcgctacagcttccgggtgcctgaggaggagaggatgcagcagaggcgggagatgctgcgggaccctgagatgaggaacaagctgatcagcaaccccaccaacttcaaccacatcgcccacatgggccctggagatggcatccagatcctgaaggacctgcccatgaacccccggccccaggagagcaggacagtgttttctggctctgtgtccatccccagcatcaccaagagcaggcctgagcccggccgctccatgtctgccagcagcggcctgagcgcccggagcagcgcccagaatggcagcgccctgaagcgggagttcagcggcggcagctacagcgccaagaggcagcccatgcccagccccagcgagggcagcctgagcagcggcggcatggaccagggcagtgatgccccagcccgggactttgatggagaagattctgacagccccaggcacagcacagccagcaacagcagcaacctgagcagcccccccagccctgccagccccaggaagaccaagagcctgagcctggagagcacagaccggggctcctgggacccctag

SEQ ID NO: 146889 - DNA, 5160 bp, Artificial Sequence
  Description of Artificial Sequence: Synthetic coding sequence
atgtctggagaggtgcggctgcggcagctggagcagttcatcctggatggccctgcccagaccaacggccagtgcttctctgtggagaccctgctggacatcctgatctgcctgtatgatgagtgcaacaacagccccctgcggcgggagaagaacatcctggagtacctggagtgggccaagcccttcaccagcaaggtgaagcagatgaggctgcacagagaagattttgagatcctgaaggtgattggccgcggggccttcggggaggtggccgtggtgaagctgaagaatgctgacaaggtgtttgccatgaagatcctgaacaagtgggagatgctgaagagagctgagacagcctgcttccgggaggagagagatgtgctggtgaatggagacaacaagtggatcaccaccctgcactacgccttccaggatgacaacaacctgtacctggtgatggactactacgtgggcggggacctgctgaccctgctgagcaagtttgaggaccggctgcctgaggacatggcccgcttctacctggccgagatggtgattgccattgattctgtgcaccagctgcactacgtgcaccgggacatcaagccagacaacatcctgatggacatgaatggccacatccggctggccgactttggcagctgcctgaagctgatggaggatggcaccgtgcagagctctgtggccgtgggcaccccagactacatcagccctgagatcctgcaggccatggaggatggcaagggccgctatggcccagaatgtgactggtggagcctgggcgtgtgcatgtatgagatgctgtatggagagacccccttctacgccgagagcctggtggagacctacggcaagatcatgaaccacaaggagcgcttccagtttcctgcccaggtgacagatgtgtctgaaaatgccaaggacctgatcagaagactcatctgcagccgggagcaccggctgggccagaatggaattgaggacttcaagaagcaccccttcttcagcggcatcgactgggacaacatccggaactgtgaggccccctacatccctgaggtgagcagccccacagacaccagcaactttgatgtggatgatgactgcctgaagaacagcgagaccatgcccccacccacccacacagccttcagcggccaccacctgccctttgtgggcttcacctacaccagcagctgtgtgctgagtgacaggagctgcctgcgggtgacagctggccccaccagcctggacctggatgtgaatgtgcagaggaccctggacaacaacctggccacagaggcctatgaaagacgcatcaagaggctggagcaggagaagctggagctgagcaggaagctgcaggagagcacccagacagtgcaggccctgcagtacagcacagtggatggccccctgacagccagcaaggacctggagatcaagaacctgaaggaggagattgagaagctgaggaagcaggtgacagagagcagccacctggagcagcagctggaggaggccaatgctgtgcggcaggagctggatgatgccttccggcagatcaaggcctatgagaagcagatcaagaccctgcagcaggagcgggaggacctgaacaaggagctggtgcaggccagcgagcggctgaagaaccagagcaaggagctgaaggatgcccactgccagaggaagctggccatgcaggagttcatggagatcaatgaaaggctgacagagctgcacacccagaagcagaagctggcccggcacgtgcgggacaaggaggaggaggtggacctggtgatgcagaaggtggagagcctgcggcaggagctgcggaggacagagcgggccaagaaggagctggaggtgcacacagaggccctggccgctgaggccagcaaggacaggaagctgcgggagcagagcgagcactacagcaagcagctggagaatgagctggagggcctgaagcagaagcagatctcctacagccctggggtgtgcagcattgagcaccagcaggagatcaccaagctgaagacagacctggagaagaagagcatcttctatgaggaggagctgagcaagcgggagggcatccacgccaatgagatcaagaacctgaagaaggagctgcatgattctgagggccagcagctggccctgaacaaggagatcatgatcctgaaggacaagctggagaagacccggcgggagagccagagcgagcgggaggagtttgaaagtgagttcaagcagcagtatgagcgggagaaggtgctgctgacagaggagaacaagaagctgaccagcgagctggacaagctgaccaccctgtatgagaacctgagcatccacaaccagcagctggaggaggaggtgaaggacctggccgacaagaaggagagcgtggcccactgggaggcccagatcacagagatcatccagtgggtgtctgatgagaaggatgcccggggctacctgcaggccctggccagcaagatgacagaggagctggaggccctgaggaacagcagcctgggcacccgggccacagacatgccctggaagatgagaagatttgccaagctggacatgtctgcccggctggagctgcagagcgccctggatgctgagatccgggccaagcaggccatccaggaggagctgaacaaggtgaaggccagcaacatcatcacagagtgcaagctgaaggacagcgagaagaagaacctggagctgctgtctgaaattgagcagctgatcaaggacacagaggagctgcggtctgagaagggcatcgagcaccaggacagccagcacagcttcctggccttcctgaacacccccacagatgccctggaccagtttgaaacagtggacagcacccccctgtctgtgcacacccccaccctgaggaagaagggctgccccggcagcacaggcttcccccccaagaggaagacccaccagttctttgtgaagagcttcaccacccccaccaagtgccaccagtgcaccagcctgatggtgggcctcatccggcagggctgcagctgtgaggtgtgtggcttcagctgccacatcacctgtgtgaacaaggcccccaccacctgccctgtgcccccagagcagaccaagggccccctgggcatcgacccccagaagggcatcggcacagcctatgagggccacgtgcgcatccccaagccagctggggtgaagaagggctggcagagggccctggccatcgtgtgtgacttcaagctgttcctgtatgacattgctgagggcaaggccagccagcccagcgtggtgatcagccaggtgattgacatgagagatgaggagttctctgtgtcctctgtgctggccagtgatgtgatccacgccagcaggaaggacatcccctgcatcttccgggtgacagccagccagctgagcgccagcaacaacaagtgcagcatcctgatgctggccgacacagaaaatgagaagaacaagtgggtgggcgtgctgtctgagctgcacaagatcctgaagaagaacaagttccgggacagatctgtgtatgtgcccaaggaggcctatgacagcaccctgcccctcatcaagaccacccaggccgccgccatcatcgaccacgagcgcatcgccctgggcaatgaggagggcctgtttgtggtgcacgtgaccaaggatgagatcatccgggtgggggacaacaagaagatccaccagatcgagctgatccccaatgaccagctggtggccgtcatctctggaagaaacagacatgtgcggctcttccccatgtctgccctggatggccgggagacagacttctacaagctgtctgagaccaagggctgccagacagtgaccagcggcaaggtgagacatggagccctgacctgcctgtgtgtggccatgaagaggcaggtgctgtgctatgagctgttccagagcaagaccaggcacaggaagttcaaggagatccaggtgccctacaacgtgcagtggatggccatcttcagcgagcagctgtgtgtgggcttccagagcggcttcctgcgctaccccctgaatggagagggcaacccctacagcatgctgcacagcaatgaccacaccctgtccttcatcgcccaccagcccatggatgccatctgtgctgtggagatcagcagcaaggagtacctgctgtgcttcaacagcatcggcatctacacagactgccagggccgccgcagccggcagcaggagctgatgtggccagccaaccccagcagctgctgctacaatgccccctacctgtctgtgtacagtgaaaatgctgtggacatctttgatgtgaacagcatggagtggatccagaccctgcccctgaagaaggtgcggcccctgaacaatgaaggcagcctgaacctgctgggcctggagaccatccgcctcatctacttcaagaacaagatggccgagggagatgagctggtggtgcctgagaccagtgacaacagcaggaagcagatggtgaggaacatcaacaacaagaggcgctacagcttccgggtgcctgaggaggagaggatgcagcagaggcgggagatgctgcgggaccctgagatgaggaacaagctgatcagcaaccccaccaacttcaaccacatcgcccacatgggccctggagatggcatccagatcctgaaggacctgcccatgaacccccggccccaggagagcaggacagtgttcagcggctctgtgtccatccccagcatcaccaagagcaggcctgagcccggccgctccatgtctgccagcagcggcctgagcgcccggagcagcgcccagaatggaagtgccctgaagcgggagttcagcggcggcagctacagcgccaagaggcagcccatgcccagccccagcgagggcagcctgagcagcggcggcatggaccagggcagtgatgccccagcccgggactttgatggagaggacagcgacagccccaggcacagcacagccagcaacagcagcaacctgagcagcccccccagccctgccagccccaggaagaccaagagcctgagcctggagagcacagaccggggctcctgggacccctag

SEQ ID NO: 146890 - DNA, 1641 bp, Artificial Sequence
  Description of Artificial Sequence: Synthetic coding sequence
tgagatattgctgagggcaaggccagccagcccagcgtggtgatcagccaggtgattgacatgagagatgaggagttctctgtgtcctctgtgctggccagtgatgtgatccacgccagcaggaaggacatcccctgcatcttccgggtgacagccagccagctgagcgccagcaacaacaagtgcagcatcctgatgctggccgacacagaaaatgagaagaacaagtgggtgggcgtgctgtctgagctgcacaagatcctgaagaagaacaagttccgggacagatctgtgtatgtgcccaaggaggcctatgacagcaccctgcccctcatcaagaccacccaggccgccgccatcatcgaccacgagcgcatcgccctgggcaatgaggagggcctgtttgtggtgcacgtgaccaaggatgagatcatccgggtgggggacaacaagaagatccaccagatcgagctgatccccaatgaccagctggtggccgtcatctctggaagaaacagacatgtgcggctcttccccatgtctgccctggatggccgggagacagacttctacaagctgtctgagaccaagggctgccagacagtgaccagcggcaaggtgagacatggagccctgacctgcctgtgtgtggccatgaagaggcaggtgctgtgctatgagctgttccagagcaagaccaggcacaggaagttcaaggagatccaggtgccctacaacgtgcagtggatggccatcttcagcgagcagctgtgtgtgggcttccagagcggcttcctgcgctaccccctgaatggagagggcaacccctacagcatgctgcacagcaatgaccacaccctgtccttcatcgcccaccagcccatggatgccatctgtgctgtggagatcagcagcaaggagtacctgctgtgcttcaacagcatcggcatctacacagactgccagggccgccgcagccggcagcaggagctgatgtggccagccaaccccagcagctgctgctacaatgccccctacctgtctgtgtacagtgaaaatgctgtggacatctttgatgtgaacagcatggagtggatccagaccctgcccctgaagaaggtgcggcccctgaacaatgaaggcagcctgaacctgctgggcctggagaccatccgcctcatctacttcaagaacaagatggccgagggagatgagctggtggtgcctgagaccagtgacaacagcaggaagcagatggtgaggaacatcaacaacaagaggcgctacagcttccgggtgcctgaggaggagaggatgcagcagaggcgggagatgctgcgggaccctgagatgaggaacaagctgatcagcaaccccaccaacttcaaccacatcgcccacatgggccctggagatggcatccagatcctgaaggacctgcccatgaacccccggccccaggagagcaggacagtgttcagcggctctgtgtccatccccagcatcaccaagagcaggcctgagcccggccgctccatgtctgccagcagcggcctgagcgccagcaaatgtcggggctacaggaaggtgcccctgcggcagggcgacccccagctgccccccctgctgagccggggctag

SEQ ID NO: 146891 - DNA, 2187 bp, Artificial Sequence
  Description of Artificial Sequence: Synthetic coding sequence
tgagtgtctgatgagaaggatgcccggggctacctgcaggccctggccagcaagatgacagaggagctggaggccctgaggaacagcagcctgggcacccgggccacagacatgccctggaagatgagaagatttgccaagctggacatgtctgcccggctggagctgcagagcgccctggatgctgagatccgggccaagcaggccatccaggaggagctgaacaaggtgaaggccagcaacatcatcacagagtgcaagctgaaggacagcgagaagaagaacctggagctgctgtctgaaattgagcagctgatcaaggacacagaggagctgcggtctgagaagggcatcgagcaccaggacagccagcacagcttcctggccttcctgaacacccccacagatgccctggaccagtttgaggacagcttcagcagcagcagcagcagcctgattgacttcctggatgacacagatcctgtggagaacacctacgtgtggaaccccagcgtgaagttccacatccagagccgcagcaccagccccagcaccagcagcgaggccgagcctgtgaagacagtggacagcacccccctgtctgtgcacacccccaccctgaggaagaagggctgccccggcagcacaggcttcccccccaagaggaagacccaccagttctttgtgaagagcttcaccacccccaccaagtgccaccagtgcaccagcctgatggtgggcctcatccggcagggctgcagctgtgaggtgtgtggcttcagctgccacatcacctgtgtgaacaaggcccccaccacctgccctgtgcccccagagcagaccaagggccccctgggcatcgacccccagaagggcattggaacagcctatgagggccacgtgcgcatccccaagccagctggggtgaagaagggctggcagagggccctggccatcgtgtgtgacttcaagctgttcctgtatgacattgctgagggcaaggccagccagcccagcgtggtgatcagccaggtgattgacatgagagatgaggagttctctgtgtcctctgtgctggccagtgatgtgattcatgccagcaggaaggacatcccctgcatcttccgggtgacagccagccagctgagcgccagcaacaacaagtgcagcatcctgatgctggccgacacagaaaatgagaagaacaagtgggtgggcgtgctgtctgagctgcacaagatcctgaagaagaacaagttccgggacagatctgtgtatgtgcccaaggaggcctatgacagcaccctgcccctcatcaagaccacccaggccgccgccatcatcgaccacgagagaattgccctgggcaatgaggagggcctgtttgtggtgcacgtgaccaaggatgagatcatccgggtgggggacaacaagaagatccaccagatcgagctgatccccaatgaccagctggtggccgtcatcagcggcaggaacagacatgtgcggctcttccccatgtctgccctggatggccgggagacagacttctacaagctgtctgagaccaagggctgccagacagtgaccagcggcaaggtgcgccacggggccctgacctgcctgtgtgtggccatgaagaggcaggtgctgtgctatgagctgttccagagcaagaccaggcacaggaagttcaaggagatccaggtgccctacaacgtgcagtggatggccatcttcagcgagcagctgtgtgtgggcttccagagcggcttcctgcgctaccccctgaatggagagggcaacccctacagcatgctgcacagcaatgaccacaccctgtccttcatcgcccaccagcccatggatgccatctgtgctgtggagatcagcagcaaggagtacctgctgtgcttcaacagcatcggcatctacacagactgccagggcagaagaagccggcagcaggagctgatgtggccagccaaccccagcagctgctgctacaatgccccctacctgtctgtgtacagtgaaaatgctgtggacatctttgatgtgaacagcatggagtggatccagaccctgcccctgaagaaggtgcggcccctgaacaatgaaggcagcctgaacctgctgggcctggagaccatccgcctcatctacttcaagaacaagatggcctag

SEQ ID NO: 146892 - DNA, 3147 bp, Artificial Sequence
  Description of Artificial Sequence: Synthetic coding sequence
tgagaaggcatccacgccaatgagatcaagaacctgaagaaggagctgcatgattctgagggccagcagctggccctgaacaaggagatcatgatcctgaaggacaagctggagaagacccggcgggagagccagagcgagcgggaggagtttgaaagtgagttcaagcagcagtatgagcgggagaaggtgctgctgacagaggagaacaagaagctgaccagcgagctggacaagctgaccaccctgtatgagaacctgagcatccacaaccagcagctggaggaggaggtgaaggacctggccgacaagaaggagagcgtggcccactgggaggcccagatcacagagatcatccagtgggtgtctgatgagaaggatgcccggggctacctgcaggccctggccagcaagatgacagaggagctggaggccctgaggaacagcagcctgggcacccgggccacagacatgccctggaagatgagaagatttgccaagctggacatgtctgcccggctggagctgcagagcgccctggatgctgagatccgggccaagcaggccatccaggaggagctgaacaaggtgaaggccagcaacatcatcacagagtgcaagctgaaggacagcgagaagaagaacctggagctgctgtctgaaattgagcagctgatcaaggacacagaggagctgcggtctgagaagggcatcgagcaccaggacagccagcacagcttcctggccttcctgaacacccccacagatgccctggaccagtttgaaacagatcctgtggagaacacctacgtgtggaaccccagcgtgaagttccacatccagagccgcagcaccagccccagcaccagcagcgaggccgagcctgtgaagacagtggacagcacccccctgtctgtgcacacccccaccctgaggaagaagggctgccccggcagcacaggcttcccccccaagaggaagacccaccagttctttgtgaagagcttcaccacccccaccaagtgccaccagtgcaccagcctgatggtgggcctcatccggcagggctgcagctgtgaggtgtgtggcttcagctgccacatcacctgtgtgaacaaggcccccaccacctgccctgtgcccccagagcagaccaagggccccctgggcatcgacccccagaagggcattggaacagcctatgagggccacgtgcgcatccccaagccagctggggtgaagaagggctggcagagggccctggccatcgtgtgtgacttcaagctgttcctgtatgacattgctgagggcaaggccagccagcccagcgtggtgatcagccaggtgattgacatgagagatgaggagttctctgtgtcctctgtgctggccagtgatgtgattcatgccagcaggaaggacatcccctgcatcttccgggtgacagccagccagctgagcgccagcaacaacaagtgcagcatcctgatgctggccgacacagaaaatgagaagaacaagtgggtgggcgtgctgtctgagctgcacaagatcctgaagaagaacaagttccgggacagatctgtgtatgtgcccaaggaggcctatgacagcaccctgcccctcatcaagaccacccaggccgccgccatcatcgaccacgagagaattgccctgggcaatgaggagggcctgtttgtggtgcacgtgaccaaggatgagatcatccgggtgggggacaacaagaagatccaccagatcgagctgatccccaatgaccagctggtggccgtcatcagcggcaggaacagacatgtgcggctcttccccatgtctgccctggatggccgggagacagacttctacaagctgtctgagaccaagggctgccagacagtgaccagcggcaaggtgcgccacggggccctgacctgcctgtgtgtggccatgaagaggcaggtgctgtgctatgagctgttccagagcaagaccaggcacaggaagttcaaggagatccaggtgccctacaacgtgcagtggatggccatcttcagcgagcagctgtgtgtgggcttccagagcggcttcctgcgctaccccctgaatggagagggcaacccctacagcatgctgcacagcaatgaccacaccctgtccttcatcgcccaccagcccatggatgccatctgtgctgtggagatcagcagcaaggagtacctgctgtgcttcaacagcatcggcatctacacagactgccagggcagaagaagccggcagcaggagctgatgtggccagccaaccccagcagctgctgctacaatgccccctacctgtctgtgtacagtgaaaatgctgtggacatctttgatgtgaacagcatggagtggatccagaccctgcccctgaagaaggtgcggcccctgaacaatgaaggcagcctgaacctgctgggcctggagaccatccgcctcatctacttcaagaacaagatggccgagggagatgagctggtggtgcctgagaccagtgacaacagcaggaagcagatggtgaggaacatcaacaacaagaggcgctacagcttccgggtgcctgaggaggagaggatgcagcagaggcgggagatgctgcgggaccctgagatgaggaacaagctgatcagcaaccccaccaacttcaaccacatcgcccacatgggccctggagatggcatccagatcctgaaggacctgcccatgaacccccggccccaggagagcaggacagtgttttctggctctgtgtccatccccagcatcaccaagagcaggcctgagcccggccgctccatgtctgccagcagcggcctgagcgcccggagcagcgcccagaatggcagcgccctgaagcgggagttcagcggcggcagctacagcgccaagaggcagcccatgcccagccccagcgagggcagcctgagcagcggcggcatggaccagggcagtgatgccccagcccgggactttgatggagaagattctgacagccccaggcacagcacagccagcaacagcagcaacctgagcagcccccccagccctgccagccccaggaagaccaagagcctgagcctggagagcacagaccggggctcctgggacccctag

SEQ ID NO: 146893 - DNA, 2955 bp, Artificial Sequence
  Description of Artificial Sequence: Synthetic coding sequence
tgacagctggaggaggaggtgaaggacctggccgacaagaaggagagcgtggcccactgggaggcccagatcacagagatcatccagtgggtgtctgatgagaaggatgcccggggctacctgcaggccctggccagcaagatgacagaggagctggaggccctgaggaacagcagcctgggcacccgggccacagacatgccctggaagatgagaagatttgccaagctggacatgtctgcccggctggagctgcagagcgccctggatgctgagatccgggccaagcaggccatccaggaggagctgaacaaggtgaaggccagcaacatcatcacagagtgcaagctgaaggacagcgagaagaagaacctggagctgctgtctgaaattgagcagctgatcaaggacacagaggagctgcggtctgagaagggcatcgagcaccaggacagccagcacagcttcctggccttcctgaacacccccacagatgccctggaccagtttgagaccgtggacagcacccccctgtctgtgcacacccccaccctgaggaagaagggctgccccggcagcacaggcttcccccccaagaggaagacccaccagttctttgtgaagagcttcaccacccccaccaagtgccaccagtgcaccagcctgatggtgggcctcatccggcagggctgcagctgtgaggtgtgtggcttcagctgccacatcacctgtgtgaacaaggcccccaccacctgccctgtgcccccagagcagaccaagggccccctgggcatcgacccccagaagggcattggaacagcctatgagggccacgtgcgcatccccaagccagctggggtgaagaagggctggcagagggccctggccatcgtgtgtgacttcaagctgttcctgtatgacattgctgagggcaaggccagccagcccagcgtggtgatcagccaggtgattgacatgagagatgaggagttctctgtgtcctctgtgctggccagtgatgtgattcatgccagcaggaaggacatcccctgcatcttccgggtgacagccagccagctgagcgccagcaacaacaagtgcagcatcctgatgctggccgacacagaaaatgagaagaacaagtgggtgggcgtgctgtctgagctgcacaagatcctgaagaagaacaagttccgggacagatctgtgtatgtgcccaaggaggcctatgacagcaccctgcccctcatcaagaccacccaggccgccgccatcatcgaccacgagagaattgccctgggcaatgaggagggcctgtttgtggtgcacgtgaccaaggatgagatcatccgggtgggggacaacaagaagatccaccagatcgagctgatccccaatgaccagctggtggccgtcatcagcggcaggaacagacatgtgcggctcttccccatgtctgccctggatggccgggagacagacttctacaagctgtctgagaccaagggctgccagacagtgaccagcggcaaggtgcgccacggggccctgacctgcctgtgtgtggccatgaagaggcaggtgctgtgctatgagctgttccagagcaagaccaggcacaggaagttcaaggagatccaggtgccctacaacgtgcagtggatggccatcttcagcgagcagctgtgtgtgggcttccagagcggcttcctgcgctaccccctgaatggagagggcaacccctacagcatgctgcacagcaatgaccacaccctgtccttcatcgcccaccagcccatggatgccatctgtgctgtggagatcagcagcaaggagtacctgctgtgcttcaacagcatcggcatctacacagactgccagggcagaagaagccggcagcaggagctgatgtggccagccaaccccagcagctgctgctacaatgccccctacctgtctgtgtacagtgaaaatgctgtggacatctttgatgtgaacagcatggagtggatccagaccctgcccctgaagaaggtgcggcccctgaacaatgaaggcagcctgaacctgctgggcctggagaccatccgcctcatctacttcaagaacaagatggccgagggagatgagctggtggtgcctgagaccagtgacaacagcaggaagcagatggtgaggaacatcaacaacaagaggcgctacagcttccgggtgcctgaggaggagaggatgcagcagaggcgggagatgctgcgggaccctgagatgaggaacaagctgatcagcaaccccaccaacttcaaccacatcgcccacatgggccctggagatggcatccagatcctgaaggacctgcccatgcctggcttcccctaccccagcccccaccaccacagcggcctcatcagcagccccatcaactttgagcacatctaccacatgacagtgaacagcgctgagaagttcctgagcccagacagcatcaaccctgagtacagccccagcctgcggtctgtgcccggcacccccagcttcatgaccctgaggaacccccggccccaggagagcaggacagtgttttctggctctgtgtccatccccagcatcaccaagagcaggcctgagcccggccgctccatgtctgccagcagcggcctgagcgcccggagcagcgcccagaatggcagcgccctgaagcgggagttcagcggcggcagctacagcgccaagaggcagcccatgcccagccccagcgagggcagcctgagcagcggcggcatggaccagggcagtgatgccccagcccgggactttgatggagaagattctgacagccccaggcacagcacagccagcaacagcagcaacctgagcagcccccccagccctgccagccccaggaagaccaagagcctgagcctggagagcacagaccggggctcctgggacccctag

SEQ ID NO: 146894 - DNA, 5100 bp, Artificial Sequence
  Description of Artificial Sequence: Synthetic coding sequence
atgtctggagaggtgcggctgcggcagctggagcagttcatcctggatggccctgcccagaccaacggccagtgcttctctgtggagaccctgctggacatcctgatctgcctgtatgatgagtgcaacaacagccccctgcggcgggagaagaacatcctggagtacctggagtgggccaagcccttcaccagcaaggtgaagcagatgaggctgcacagagaagattttgagatcctgaaggtgattggccgcggggccttcggggaggtggccgtggtgaagctgaagaatgctgacaaggtgtttgccatgaagatcctgaacaagtgggagatgctgaagagagctgagacagcctgcttccgggaggagagagatgtgctggtgaatggagacaacaagtggatcaccaccctgcactacgccttccaggatgacaacaacctgtacctggtgatggactactacgtgggcggggacctgctgaccctgctgagcaagtttgaggaccggctgcctgaggacatggcccgcttctacctggccgagatggtgattgccattgattctgtgcaccagctgcactacgtgcaccgggacatcaagccagacaacatcctgatggacatgaatggccacatccggctggccgactttggcagctgcctgaagctgatggaggatggcaccgtgcagagctctgtggccgtgggcaccccagactacatcagccctgagatcctgcaggccatggaggatggcaagggccgctatggcccagaatgtgactggtggagcctgggcgtgtgcatgtatgagatgctgtatggagagacccccttctacgccgagagcctggtggagacctacggcaagatcatgaaccacaaggagcgcttccagtttcctgcccaggtgacagatgtgtctgaaaatgccaaggacctgatcagaagactcatctgcagccgggagcaccggctgggccagaatggaattgaggacttcaagaagcaccccttcttcagcggcatcgactgggacaacatccggaactgtgaggccccctacatccctgaggtgagcagccccacagacaccagcaactttgatgtggatgatgactgcctgaagaacagcgagaccatgcccccacccacccacacagccttcagcggccaccacctgccctttgtgggcttcacctacaccagcagctgtgtgctgagtgacaggagctgcctgcgggtgacagctggccccaccagcctggacctggatgtgaatgtgcagaggaccctggacaacaacctggccacagaggcctatgaaagacgcatcaagaggctggagcaggagaagctggagctgagcaggaagctgcaggagagcacccagacagtgcaggccctgcagtacagcacagtggatggccccctgacagccagcaaggacctggagatcaagaacctgaaggaggagattgagaagctgaggaagcaggtgacagagagcagccacctggagcagcagctggaggaggccaatgctgtgcggcaggagctggatgatgccttccggcagatcaaggcctatgagaagcagatcaagaccctgcagcaggagcgggaggacctgaacaaggagctggtgcaggccagcgagcggctgaagaaccagagcaaggagctgaaggatgcccactgccagaggaagctggccatgcaggagttcatggagatcaatgaaaggctgacagagctgcacacccagaagcagaagctggcccggcacgtgcgggacaaggaggaggaggtggacctggtgatgcagaaggtggagagcctgcggcaggagctgcggaggacagagcgggccaagaaggagctggaggtgcacacagaggccctggccgctgaggccagcaaggacaggaagctgcgggagcagagcgagcactacagcaagcagctggagaatgagctggagggcctgaagcagaagcagatctcctacagccctggggtgtgcagcattgagcaccagcaggagatcaccaagctgaagacagacctggagaagaagagcatcttctatgaggaggagctgagcaagcgggagggcatccacgccaatgagatcaagaacctgaagaaggagctgcatgattctgagggccagcagctggccctgaacaaggagatcatgatcctgaaggacaagctggagaagacccggcgggagagccagagcgagcgggaggagtttgaaagtgagttcaagcagcagtatgagcgggagaaggtgctgctgacagaggagaacaagaagctgaccagcgagctggacaagctgaccaccctgtatgagaacctgagcatccacaaccagcagctggaggaggaggtgaaggacctggccgacaagaaggagagcgtggcccactgggaggcccagatcacagagatcatccagtgggtgtctgatgagaaggatgcccggggctacctgcaggccctggccagcaagatgacagaggagctggaggccctgaggaacagcagcctgggcacccgggccacagacatgccctggaagatgagaagatttgccaagctggacatgtctgcccggctggagctgcagagcgccctggatgctgagatccgggccaagcaggccatccaggaggagctgaacaaggtgaaggccagcaacatcatcacagagtgcaagctgaaggacagcgagaagaagaacctggagctgctgtctgaaattgagcagctgatcaaggacacagaggagctgcggtctgagaaggccagcaaaggaagaagaacagtggacagcacccccctgtctgtgcacacccccaccctgaggaagaagggctgccccggcagcacaggcttcccccccaagaggaagacccaccagttctttgtgaagagcttcaccacccccaccaagtgccaccagtgcaccagcctgatggtgggcctcatccggcagggctgcagctgtgaggtgtgtggcttcagctgccacatcacctgtgtgaacaaggcccccaccacctgccctgtgcccccagagcagaccaagggccccctgggcatcgacccccagaagggcatcggcacagcctatgagggccacgtgcgcatccccaagccagctggggtgaagaagggctggcagagggccctggccatcgtgtgtgacttcaagctgttcctgtatgacattgctgagggcaaggccagccagcccagcgtggtgatcagccaggtgattgacatgagagatgaggagttctctgtgtcctctgtgctggccagtgatgtgatccacgccagcaggaaggacatcccctgcatcttccgggtgacagccagccagctgagcgccagcaacaacaagtgcagcatcctgatgctggccgacacagaaaatgagaagaacaagtgggtgggcgtgctgtctgagctgcacaagatcctgaagaagaacaagttccgggacagatctgtgtatgtgcccaaggaggcctatgacagcaccctgcccctcatcaagaccacccaggccgccgccatcatcgaccacgagcgcatcgccctgggcaatgaggagggcctgtttgtggtgcacgtgaccaaggatgagatcatccgggtgggggacaacaagaagatccaccagatcgagctgatccccaatgaccagctggtggccgtcatctctggaagaaacagacatgtgcggctcttccccatgtctgccctggatggccgggagacagacttctacaagctgtctgagaccaagggctgccagacagtgaccagcggcaaggtgagacatggagccctgacctgcctgtgtgtggccatgaagaggcaggtgctgtgctatgagctgttccagagcaagaccaggcacaggaagttcaaggagatccaggtgccctacaacgtgcagtggatggccatcttcagcgagcagctgtgtgtgggcttccagagcggcttcctgcgctaccccctgaatggagagggcaacccctacagcatgctgcacagcaatgaccacaccctgtccttcatcgcccaccagcccatggatgccatctgtgctgtggagatcagcagcaaggagtacctgctgtgcttcaacagcatcggcatctacacagactgccagggccgccgcagccggcagcaggagctgatgtggccagccaaccccagcagctgctgctacaatgccccctacctgtctgtgtacagtgaaaatgctgtggacatctttgatgtgaacagcatggagtggatccagaccctgcccctgaagaaggtgcggcccctgaacaatgaaggcagcctgaacctgctgggcctggagaccatccgcctcatctacttcaagaacaagatggccgagggagatgagctggtggtgcctgagaccagtgacaacagcaggaagcagatggtgaggaacatcaacaacaagaggcgctacagcttccgggtgcctgaggaggagaggatgcagcagaggcgggagatgctgcgggaccctgagatgaggaacaagctgatcagcaaccccaccaacttcaaccacatcgcccacatgggccctggagatggcatccagatcctgaaggacctgcccatgaacccccggccccaggagagcaggacagtgttcagcggctctgtgtccatccccagcatcaccaagagcaggcctgagcccggccgctccatgtctgccagcagcggcctgagcgcccggagcagcgcccagaatggaagtgccctgaagcgggagttcagcggcggcagctacagcgccaagaggcagcccatgcccagccccagcgagggcagcctgagcagcggcggcatggaccagggcagtgatgccccagcccgggactttgatggagaggacagcgacagccccaggcacagcacagccagcaacagcagcaacctgagcagcccccccagccctgccagccccaggaagaccaagagcctgagcctggagagcacagaccggggctcctgggacccctag

SEQ ID NO: 146895 - DNA, 5136 bp, Artificial Sequence
  Description of Artificial Sequence: Synthetic coding sequence
atgtctgccaaggtgcggctgaagaagctggagcagctgctgctggatggcccctggagaaatgaaagtgccctgtctgtggagaccctgctggatgtgctggtgtgcctgtacacagagtgcagccacagcgccctgcggcgggacaagtatgtggccgagttcctggagtgggccaagcccttcacccagctggtgaaggagatgcagctgcaccgggaggactttgagatcatcaaggtgattggccgcggggcctttggagaggtggccgtggtgaagatgaagaacacagagcgcatctatgccatgaagatcctgaacaagtgggagatgctgaagagagctgagacagcctgcttccgggaggagagagatgtgctggtgaatggagactgccagtggatcacagccctgcactacgccttccaggatgagaaccacctgtacctggtgatggactactacgtgggcggggacctgctgaccctgctgagcaagtttgaggacaagctgcctgaggacatggcccgcttctacatcggggagatggtgctggccatcgacagcatccaccagctgcactacgtgcaccgggacatcaagccagacaacgtgctgctggatgtgaatggccacatccggctggccgactttggcagctgcctgaagatgaatgatgatggcaccgtgcagagctctgtggccgtgggcaccccagactacatcagccctgagatcctgcaggccatggaggatggcatgggcaagtatggcccagaatgtgactggtggagcctgggcgtgtgcatgtatgagatgctgtatggagagacccccttctatgcagagagcctggtggagacctacggcaagatcatgaaccacgaggagcgcttccagttccccagccacgtgacagatgtgtctgaggaggccaaggacctgatccagaggctcatctgcagccgggagcggcggctgggccagaatggaattgaggacttcaagaagcacgccttctttgagggcctgaactgggagaacatccggaacctggaggccccctacatcccagatgtgagcagccccagcgacaccagcaactttgatgtggatgatgatgtgctgaggaacacagagatcctgcccccaggcagccacacaggcttcagcggcctgcacctgcccttcatcggcttcaccttcaccacagagagctgcttcagtgaccggggcagcctgaagagcatcatgcagagcaacaccctgaccaaggatgaagatgtgcagagggacctggagcacagcctgcagatggaggcctatgaaagacgcatccggcggctggagcaggagaagctggagctgagcaggaagctgcaggagagcacccagacagtgcagagcctgcacggcagcagccgggccctgagcaacagcaacagagacaaggagatcaagaagctgaatgaggagattgaaaggctgaagaacaagattgctgacagcaaccggctggagcggcagctggaggacacagtggccctgcggcaggagcgggaggacagcacccagaggctgcggggcctggagaagcagcaccgggtggtgcggcaggagaaggaggagctgcacaagcagctggtggaggccagcgagcggctgaagagccaggccaaggagctgaaggatgcccaccagcagaggaagctggccctgcaggagttcagcgagctgaatgaaagaatggccgagctgcgggcccagaagcagaaggtgtcccggcagctgcgggacaaggaggaggagatggaggtggccacccagaaggtggatgccatgaggcaggagatgagaagagctgagaagctgaggaaggagctggaggcccagctggatgatgctgtggccgaggccagcaaggagaggaagctgcgggagcacagcgagaacttctgcaagcagatggagagcgagctggaggccctgaaggtgaagcagggcggcagaggagctggggccaccctggagcaccagcaggagatcagcaagatcaagtctgagctggagaagaaggtgctcttctatgaggaggagctggtgagaagagaggccagccacgtgctggaggtgaagaatgtgaagaaggaggtgcatgacagcgagagccaccagctggccctgcagaaggagatcctgatgctgaaggacaagctggagaagagcaagcgggagcggcacaatgagatggaggaggccgtgggcaccatcaaggacaagtatgaaagagagcgggccatgctgtttgatgagaacaagaagctgacagcagaaaatgagaagctgtgcagctttgtggacaagctgacagcccagaaccggcagctggaggatgagctgcaggacctggccgccaagaaggagagcgtggcccactgggaggcccagattgctgagatcatccagtgggtgtctgatgagaaggatgcccggggctacctgcaggccctggccagcaagatgacagaggagctggaggccctgcggagcagcagcctgggcagcaggaccctggaccccctgtggaaggtgcggcgcagccagaagctggacatgtctgcccggctggagctgcagagcgccctggaggccgagatccgggccaagcagctggtgcaggaggagctgaggaaggtgaaggatgccaacctgaccctggagagcaagctgaaggacagcgaggccaagaaccgggagctgctggaggagatggagatcctgaagaagaagatggaggagaagttccgggctgacaccggcctgaagctgcctgacttccaggacagcatctttgagtacttcaacacagcccccctggcccatgacctgaccttccgcaccagcagcgccagcgagcaggagacccaggcccccaagccagaggccagccccagcatgtctgtggccgccagcgagcagcaggaggacatggcccggcccccccagaggcccagcgctgtgcccctgcccaccacccaggccctggccctggccggccccaagcccaaggcccaccagttcagcatcaagagcttcagcagccccacccagtgcagccactgcaccagcctgatggtgggcctcatccggcagggctacgcctgtgaggtgtgcagctttgcctgccacgtgtcctgcaaggatggagccccccaggtgtgccccatccccccagagcagagcaagaggcccctgggcgtggatgtgcagaggggcatcggcacagcctacaagggccacgtgaaggtgcccaagcccaccggggtgaagaagggctggcagagggcctatgctgtggtgtgtgactgcaagctgttcctgtatgacctgcctgagggcaagagcacccagcccggggtcatcgccagccaggtgctggacctgagagatgatgagttctctgtgtcctctgtgctggccagtgatgtgatccacgccacccggcgggacatcccctgcatcttccgggtgacagccagcctgctgggcgcccccagcaagaccagcagcctgctgatcctgacagaaaatgaaaatgagaagaggaagtgggtgggcatcctggagggcctgcagagcatcctgcacaagaaccggctgaggaaccaggtggtgcacgtgcccctggaggcctatgacagcagcctgcccctcatcaaggccatcctgacagctgccatcgtggatgctgacagaattgctgtgggcctggaggagggcctgtatgtgattgaggtgaccagagatgtgattgtgcgggctgctgactgcaagaaggtgcaccagatcgagctggccccccgggagaagatcgtcatcctgctgtgtggcaggaaccaccacgtgcacctgtacccctggagcagcctggatggagctgagggcagctttgacatcaagctgcctgagaccaagggctgccagctgatggccacagccaccctgaagaggaacagcggcacctgcctgtttgtggccgtgaagaggctcatcctgtgctatgagatccagaggaccaagcccttccacaggaagttcaatgagatcgtggcccctggctctgtgcagtgcctggccgtgctgcgggaccggctgtgtgtgggctaccccagcggcttctgcctgctgagcatccagggagatggccagcccctgaacctggtgaaccccaatgaccccagcctggccttcctgagccagcagagctttgatgccctgtgtgctgtggagctggagagcgaggagtacctgctgtgcttcagccacatgggcctgtatgtggacccccagggcagaagagcccgggcccaggagctgatgtggccagctgcccctgtggcctgcagctgcagccccacccacgtgacagtgtacagtgaatatggagtggatgtgtttgatgtgaggaccatggagtgggtgcagaccatcggcctgcggcgcatccggcccctgaacagcgagggcaccctgaacctgctgaactgtgagccccccaggctcatctacttcaagagcaagttcagcggggctgtgctgaatgtgcctgacaccagtgacaacagcaagaagcagatgctgcggaccaggagcaagagaagatttgtgttcaaggtgcctgaggaggagcggctgcagcagaggcgggagatgctgcgggaccctgagctgcggagcaagatgatcagcaaccccaccaacttcaaccacgtggcccacatgggccctggagatggcatgcaggtgctgatggacctgcccctgtctgctgtgccccccagccaggaggagcggcccggccctgcccccaccaacctggcccggcagccccccagcaggaacaagccctacatctcctggcccagcagcggcggcagcgagcccagcgtgacagtgcccctgcgctccatgtctgaccctgaccaggactttgacaaggagccagacagcgacagcaccaagcacagcacccccagcaacagcagcaaccccagcggcccccccagccccaacagcccccacaggagccagctgcccctggagggcctggagcagcctgcctgtgacacctag

SEQ ID NO: 146896 - DNA, 1593 bp, Artificial Sequence
  Description of Artificial Sequence: Synthetic coding sequence
aaggtgagaagaagccagaagctggacatgtctgcccggctggagctgcagagcgccctggaggccgagatccgggccaagcagctggtgcaggaggagctgaggaaggtgaaggatgccaacctgaccctggagagcaagctgaaggacagcgaggccaagaaccgggagctgctggaggagatggagatcctgaagaagaagatggaggagaagttccgggctgacaccggcctgaagctgcctgacttccaggacagcatctttgagtacttcaacacagcccccctggcccatgacctgaccttccgcaccagcagcgccagcgagcaggagacccaggcccccaagccagaggccagccccagcatgtctgtggccgccagcgagcagcaggagcccaaggcccaccagttcagcatcaagagcttcagcagccccacccagtgcagccactgcaccagcctgatggtgggcctcatccggcagggctacgcctgtgaggtgtgcagctttgcctgccacgtgtcctgcaaggatggagccccccaggtgtgccccatccccccagagcagagcaagaggcccctgggcgtggatgtgcagaggggcattggaacagcctacaagggccacgtgaaggtgcccaagcccactggagtgaagaagggctggcagagggcctatgctgtggtgtgtgactgcaagctgttcctgtatgacctgcctgagggcaagagcacccagcccggggtgattgccagccaggtgctggacctgagagatgatgagttctctgtgtcctctgtgctggccagtgatgtgattcatgccacccggcgggacatcccctgcatcttccgggtgacagccagcctgctgggcgcccccagcaagaccagcagcctgctgatcctgacagaaaatgaaaatgagaagaggaagtgggtgggcatcctggagggcctgcagagcatcctgcacaagaaccggctgaggaaccaggtggtgcacgtgcccctggaggcctatgacagcagcctgcccctcatcaaggccatcctgacagctgccatcgtggatgctgacagaattgctgtgggcctggaggagggcctgtatgtgattgaggtgaccagagatgtgattgtgcgggctgctgactgcaagaaggtgcaccagatcgagctggccccccgggagaagatcgtcatcctgctgtgtggcaggaaccaccacgtgcacctgtacccctggagcagcctggatggagctgagggcagctttgacatcaagctgcctgagaccaagggctgccagctgatggccacagccaccctgaagagaaattctggcacctgcctgtttgtggccgtgaagaggctcatcctgtgctatgagatccagaggaccaagcccttccacaggaagttcaatgaaattgtggcccctggctctgtgcagtgcctggccgtgctgcgggaccggctgtgtgtgggctaccccagcggcttctgcctgctgagcatccagggagatggccagcccctgaacctggtgaaccccaatgaccccagcctggccttcctgtag

SEQ ID NO: 146897 - DNA, 4656 bp, Artificial Sequence
  Description of Artificial Sequence: Synthetic coding sequence
atggagcggcggctgcgggccctggagcagctggcccggggggaggccggcggctgccccggcctggatggcctgctggacctgctgctggccctgcaccacgagctgagcagcggccccctgcggcgggagaggtctgtggcccagttcctgtcctgggccagcccctttgtgtccaaggtgaaggagctgcggctgcagagagatgactttgagatcctgaaggtgattggccgcggggccttcggggaggtgacagtggtgcggcagagggacaccggccagatctttgccatgaagatgctgcacaagtgggagatgctgaagagagctgagacagcctgcttccgggaggagagagatgtgctggtgaagggggacagccgctgggtgaccaccctgcactacgccttccaggatgaggagtacctgtacctggtgatggactactatgctggaggagacctgctgaccctgctgagcagatttgaggaccggctgcccccagagctggcccagttctacctggccgagatggtgctggccatccacagcctgcaccagctgggctacgtgcacagagatgtgaagccagacaacgtgctgctggatgtgaatggccacatccggctggccgactttggcagctgcctgcggctgaacaccaacggcatggtggacagctctgtggccgtgggcaccccagactacatcagccctgagatcctgcaggccatggaggagggcaagggccactacggcccccagtgtgactggtggagcctgggcgtgtgtgcctatgagctgctgtttggagagacccccttctacgccgagagcctggtggagacctacggcaagatcatgaaccacgaggaccacctgcagttccccccagatgtgcctgatgtgcctgccagcgcccaggacctgatccggcagctgctgtgccggcaggaggagcggctgggccggggcggcctggatgacttcaggaaccaccccttctttgaaggagtggactgggagcggctggccagcagcacagccccctacatccctgagctgcggggccccatggacaccagcaactttgatgtggatgatgacaccctgaaccaccctggcaccctgcccccacccagccatggagccttcagcggccaccacctgccctttgtgggcttcacctacaccagcggcagccacagccctgagagcagcagcgaggcctgggccgccctggagaggaagctgcagtgcctggagcaggagaaggtggagctgagcaggaagcaccaggaggccctgcacgcccccacagaccaccgggagctggagcagctgaggaaggaggtgcagaccctgcgggaccggctgcctgagatgctgcgggacaaggccagcctgagccagacagatggccccccagctggcagccctggccaggacagcgacctgcggcaggagctggaccggctgcaccgggagctggccgagggccgggccggcctgcaggcccaggagcaggagctgtgccgggcccagggccagcaggaggagctgctgcagaggctgcaggaggcccaggagcgggaggccgccacagccagccagacccgggccctgagcagccagctggaggaggcccgggccgcccagcgggagctggaggcccaggtgagcagcctgagccggcaggtgacccagctgcagggccagtgggagcagaggctggaggagagcagccaggccaagaccatccacacagccagcgagaccaacggcatgggccccccagagggcggcccccaggaggcccagctgaggaaggaggtggccgccctgcgggagcagctggagcaggcccacagccaccggcccagcggcaaggaggaggccctgtgccagctgcaggaggagaacagaaggctgagccgggagcaggagcggctggaggccgagctggcccaggagcaggagagcaagcagaggctggagggggagcggcgggagacagagagcaactgggaggcccagctggccgacatcctgtcctgggtgaatgatgagaaggtgtcccggggctacctgcaggccctggccaccaagatggccgaggagctggagagcctgagaaatgtgggcacccagaccctgcctgcccggcccctggaccaccagtggaaggcccggcggctgcagaagatggaggccagcgcccggctggagctgcagagcgccctggaggccgagatccgggccaagcagggcctgcaggagcggctgacccaggtgcaggaggcccagctgcaggccgagcggcggctgcaggaggccgagaagcagagccaggccctgcagcaggagctggccatgctgcgggaggagctgcgggcccggggccctgtggacaccaagcccagcaacagcctcatccccttcctgtccttccgcagcagcgagaaggacagcgccaaggaccccggcatcagcggggaggccaccaggcatggaggagagccagacctgcggcctgagggcagaagaagcctgaggatgggcgctgtgttcccccgggcccccacagccaacacagccagcacagagggcctgcctgccaagccaggcagccacaccctgcggcccaggagcttccccagccccaccaagtgcctgcgctgcaccagcctgatgctgggcctgggccggcagggcctgggctgtgatgcctgtggctacttctgccacaccacctgtgccccccaggccccaccctgccctgtgcccccagacctgctgaggacagccctgggcgtgcaccctgagaccggcaccggcacagcctatgagggcttcctgtctgtgccccggcccagcggcgtgagaagaggctggcagagggtgtttgctgccctgagtgacagccggctgctgctgtttgatgccccagacctgcggctgagcccccccagcggggccctgctgcaggtgctggacctgcgggacccccagttcagcgccacccctgtgctggccagtgatgtgatccacgcccagagccgggacctgccccgcatcttccgggtgaccaccagccagctggccgtgccccccaccacctgcaccgtgctgctgctggccgagagcgagggggagcgggagcgctggctgcaggtgctgggggagctgcagaggctgctgctggatgcccggccccggcccaggcctgtgtacaccctgaaggaggcctatgacaatggcctgcccctgctgccccacaccctgtgtgccgccatcctggaccaggaccggctggccctgggcacagaggagggcctgtttgtgatccacctgcggagcaatgacatcttccaggtgggagaatgtagaagagtgcagcagctgaccctgagccccagcgctggcctgctggtggtgctgtgtggccggggccccagcgtgcggctgtttgccctggccgagctggagaacatcgaggtggccggggccaagatccctgagagccggggctgccaggtgctggccgccggcagcatcctgcaggcccggacccctgtgctgtgtgtggccgtgaagaggcaggtgctgtgctaccagctgggccctggccctggcccctggcagaggcgcatccgggagctgcaggccccagccaccgtgcagagcctgggcctgctgggggaccggctgtgtgtgggcgctgctgggggctttgccctgtaccccctgctgaatgaagctgcccccctggccctgggcgccggcctggtgcctgaggagctgccccccagccggggcggcctgggggaggccctgggcgctgtggagctgagcctgtctgagttcctgctgctcttcaccacagctggcatctacgtggatggagctggcaggaagagccggggccacgagctgctgtggccagctgcccccatgggctggggctatgctgccccctacctgaccgtcttcagcgagaacagcattgatgtgtttgatgtgagaagagctgagtgggtgcagacagtgcccctgaagaaggtgcggcccctgaaccctgagggcagcctcttcctgtatggaacagagaaggtgcggctgacctacctgaggaaccagctggccgagaaggatgaatttgacatcccagacctgacagacaacagccggcggcagctgttccgcaccaagagcaagaggcgcttcttcttccgggtgtctgaggagcagcagaagcagcagaggcgggagatgctgaaggacccctttgtgcgcagcaagctgatcagcccccccaccaacttcaaccacctggtgcacgtgggccctgccaacggccggcctggggcccgggacaagagccctgcccctgaggagaagggccgggtggcccggggcagcggcccccagaggccccacagcttcagcgaggccctgcggcggcctgcctccatgggcagcgagggcctgggcggagatgctgaccccatgaagaggaagccctggaccagcctgagcagcgagagcgtgtcctgcccccagggcagcctgagccctgccaccagcctgatgcaggtgtctgagcggcccaggagcctgcccctgagccctgagctggagagcagcccctag

SEQ ID NO: 146898 - DNA, 1176 bp, Artificial Sequence
  Description of Artificial Sequence: Synthetic coding sequence
atgcctggcccccagggcggccgcggggccgccaccatgagcctgggcaagctgagccctgtgggctgggtgagcagcagccagggcaagaggcggctgacagctgacatgatcagccaccccctgggggacttccgccacaccatgcacgtgggcagaggaggagatgtgtttggagacaccagcttcctgagcaaccacggcggcagcagcggcagcacccacaggagccccaggagcttcctggccaagaagctgcagctggtgcggcgggtgggcgccccacccaggaggatggccagccccccagcccccagccctgcccccccagccatcagccccatcatcaagaatgccatcagcctgccccagctgaaccaggccgcctatgacagcctggtggtgggcaagctgagctttgacagcagccccaccagcagcacagatggccacagcagctatggcctggacagcggcttctgcaccatcagccggctgcccaggtctgagaagccccatgaccgggacagagatggcagcttccccagcgagcccggcctgcggcggagtgacagcctgctgtccttccggctggacctggacctgggccccagcctgctgtctgagctgctgggcgtgatgagcctgcctgaggccccagctgctgagaccccagccccagctgccaaccccccagcccccacagccaaccccactggacctgctgccaaccccccagccaccacagccaaccccccagccccagctgccaaccccagcgccccagctgccacccccactggacctgctgccaaccccccagccccagctgccagcagcacccctcatggccactgccccaacggggtgacagctggcctgggccctgtggccgaggtgaagagcagccctgtgggcggcggcccccggggccctgctggccctgccctgggccgccactggggcgccggctgggatggcggccaccactacccagagatggatgcccggcaggagcgggtggaggtgctgccccaggcccgggcctcctgggagagcctggatgaggagtggagggccccccaggccggcagcaggacccctgtgcccagcacagtgcaggccaacacctttgaatttgctgatgctgaagaagatgatgaggtgaaggtgtag

SEQ ID NO: 146899 - DNA, 183 bp, Artificial Sequence
  Description of Artificial Sequence: Synthetic coding sequence
atgcctggcccccagggcggccgcggggccgccaccatgagcctgggcaagctgagccctgtgggctgggtgagcagcagccagggcaagaggcggctgacagctgacatgatcagccaccccctgggggacttccgccacaccatgcacgtgggcagaggaggagatgtgtttggagactag

SEQ ID NO: 146900 - DNA, 213 bp, Artificial Sequence
  Description of Artificial Sequence: Synthetic coding sequence
atgcctggcccccagggcggccgcggggccgccaccatgagcctgggcaagctgagccctgtgggctgggtgagcagcagccagggcaagaggcggctgacagctgacatgatcagccaccccctgggggacttccgccacaccatgcacgtgggcagaggaggagatgtgtttggagacaccagcttcctgagcaaccacggcggcagctag

SEQ ID NO: 146901 - DNA, 147 bp, Artificial Sequence
  Description of Artificial Sequence: Synthetic coding sequence
atgcctggcccccagggcggccgcggggccgccaccatgagcctgggcaagctgagccctgtgggctgggtgagcagcagccagggcaagaggcggctgacagctgacatgatcagccaccccctgggggacttccgccacacctag

SEQ ID NO: 146902 - DNA, 633 bp, Artificial Sequence
  Description of Artificial Sequence: Synthetic coding sequence
atgagcaccaaggtgcccatctacctgaagaggggcagcaggaagggcaagaaggagaagctgcgggacctgctgagcagtgacatgatcagcccccccctgggggacttccgccacaccatccacatcggcagcggcggcggcagtgacatgtttggagacatctccttcctgcagggcaagttccacctgctgcccggcaccatggtggagggcccagaagaagatggcacctttgacctgcccttccagttcaccaggacagccaccgtgtgtggccgggagctgcctgatggccccagccccctgctgaagaatgccatcagcctgcctgtgattggaggcccccaggccctgaccctgcccacagcccaggccccacccaagccaccccggctgcacctggagaccccccagcccagcccccaggagggcggctctgtggacatctggagaattcctgagaccggcagccccaacagcggcctgaccccagagagcggggctgaggagcccttcctgagcaatgccagcagcctgctgagcctgcacgtggacctgggccccagcatcctggatgatgtgctgcagatcatggaccaggacctggacagcatgcagatccccacctag

SEQ ID NO: 146903 - DNA, 633 bp, Artificial Sequence; identical to SEQ ID NO: 146902
  Description of Artificial Sequence: Synthetic coding sequence

SEQ ID NO: 146904 - DNA, 633 bp, Artificial Sequence; identical to SEQ ID NO: 146902
  Description of Artificial Sequence: Synthetic coding sequence

SEQ ID NO: 146905 - DNA, 765 bp, Artificial Sequence
  Description of Artificial Sequence: Synthetic coding sequence
atgcctgccaagacccccatctacctgaaggccgccaacaacaagaagggcaagaagttcaagctgcgggacatcctgagcccagacatgatcagcccccccctgggggacttccgccacaccatccacatcggcaaggagggccagcatgatgtgtttggagacatctccttcctgcagggcaactatgagctgctgcccggcaaccaggagaaggcccacctgggccagtttcctggccacaatgagttcttccgggccaacagcaccagtgacagcgtcttcacagagacccccagccctgtgctgaagaatgccatcagcctgcccaccatcggcggcagccaggccctgatgctgcccctgctgagccctgtgaccttcaacagcaagcaggagagctttggacctgccaagctgccccggctgagctgtgagcctgtgatggaggagaaggcccaggagaagagcagcctgctggagaatggcaccgtgcaccagggcgacacctcctggggcagcagcggcagcgccagccagagcagccagggccgggacagccacagcagcagcctgtctgagcagtacccagactggccagctgaggacatgtttgaccaccccaccccctgtgagctgatcaagggcaagaccaagtctgaggagagcctgagtgacctgaccggcagcctgctgagcctgcagctggacctgggccccagcctgctggatgaggtgctgaatgtgatggacaagaacaagtag

SEQ ID NO: 146906 - DNA, 45 bp, Artificial Sequence
  Description of Artificial Sequence: Synthetic coding sequence
atgcctgccaagacccccatctacctgaaggccgccaacaactag

SEQ ID NO: 146907 - DNA, 108 bp, Artificial Sequence
  Description of Artificial Sequence: Synthetic coding sequence
atgcctgccaagacccccatctacctgaaggccgccaacaacaagaagggcaagaagttcaagctgcgggacatcctgagcccagacatgatcagcccccccctgtag

SEQ ID NO: 146908 - DNA, 651 bp, Artificial Sequence
  Description of Artificial Sequence: Synthetic coding sequence
atgcctgccaagacccccatctacctgaaggccgccaacaacaagaagggcaagaagttcaagctgcgggacatcctgagcccagacatgatcagcccccccctgggggacttccgccacaccatccacatcggcaaggagggccagcatgatgtgtttggagacatctccttcctgcagggcaactatgagctgctgcccggcaaccaggagaaggcccacctgggccagtttcctggccacaatgagttcttccgggccaacagcaccagtgacagcgtcttcacagagacccccagccctgtgctgaagaatgccatcagcctgcccaccatcggcggcagccaggccctgatgctgcccctgctgagccctgtgaccttcaacagcaagcaggagagctttggacctgccaagctgccccggctgagctgtgagcctgtgatggaggagaaggcccaggagaagagcagcctgctggagaatggcaccgtgcaccagggcgacacctcctggggcagcagcggcagcgccagccagagcagccagggccgggacagccacagcagcagcctgtctgagcagtacccagactggccagctgaggacatgtttgaccaccccaccccctgtgagctgatcaagggctag

SEQ ID NO: 146909 - DNA, 1071 bp, Artificial Sequence
  Description of Artificial Sequence: Synthetic coding sequence
atgcccatcctgaagcagctggtgagcagctctgtgcacagcaagaggaggagcagagctgacctgacagctgagatgatcagcgcccccctgggggacttccgccacaccatgcacgtgggccgggctggagatgcctttggagacaccagcttcctgaacagcaaggccggggagccagatggagagagcctggatgagcagcccagcagcagcagcagcaagaggagcctgctgagcaggaagttccggggcagcaagaggagccagagcgtgaccagaggagagcgggagcagagggacatgctgggcagcctgcgggacagcgccctgtttgtgaagaatgccatgagcctgccccagctgaatgagaaggaggccgctgagaagggcaccagcaagctgcccaagagcctgagcagcagccctgtgaagaaggccaatgatggagagggcggagatgaggaggccggcacagaggaggccgtgcccaggagaaatggagctgctggcccccacagcccagaccccctgctggatgagcaggccttcggggacctgacagacctgcctgtggtgcccaaggccacctacggcctgaagcatgctgagagcatcatgtccttccacatcgacctgggccccagcatgctgggagatgtgctgagcatcatggacaaggaggagtgggaccctgaggagggggagggcggctaccatggagatgagggcgccgccggcaccatcacccaggccccaccctatgctgtggccgccccacccctggcccggcaggagggcaaggccggccctgacctgcccagcctgcccagccacgccctggaggatgagggctgggccgctgctgcccccagccctggcagcgcccgctccatgggcagccacaccacccgggacagcagcagcctgagcagctgcaccagcggcatcctggaggagaggagccctgccttccggggccctgaccgggcccgggctgctgtgtcccggcagcctgacaaggagttctccttcatggatgaggaggaggaggatgagatccgggtgtag

SEQ ID NO: 146910 - DNA, 861 bp, Artificial Sequence
  Description of Artificial Sequence: Synthetic coding sequence
atgcccatcctgaagcagctggtgagcagctctgtgcacagcaagaggaggagcagagctgacctgacagctgagatgatcagcgcccccctgggggacttccgccacaccatgcacgtgggccgggctggagatgcctttggagacaccagcttcctgaacagcaaggctgctgagaagggcaccagcaagctgcccaagagcctgagcagcagccctgtgaagaaggccaatgatggagagggcggagatgaggaggccggcacagaggaggccgtgcccaggagaaatggagctgctggcccccacagcccagaccccctgctggatgagcaggccttcggggacctgacagacctgcctgtggtgcccaaggccacctacggcctgaagcatgctgagagcatcatgtccttccacatcgacctgggccccagcatgctgggagatgtgctgagcatcatggacaaggaggagtgggaccctgaggagggggagggcggctaccatggagatgagggcgccgccggcaccatcacccaggccccaccctatgctgtggccgccccacccctggcccggcaggagggcaaggccggccctgacctgcccagcctgcccagccacgccctggaggatgagggctgggccgctgctgcccccagccctggcagcgcccgctccatgggcagccacaccacccgggacagcagcagcctgagcagctgcaccagcggcatcctggaggagaggagccctgccttccggggccctgaccgggcccgggctgctgtgtcccggcagcctgacaaggagttctccttcatggatgaggaggaggaggatgagatccgggtgtag

SEQ ID NO: 146911 - DNA, 1551 bp, Artificial Sequence
  Description of Artificial Sequence: Synthetic coding sequence
atgaccctgctgatcaccggggacagcatcgtgtctgctgaggccgtgtgggaccacgtgaccatggccaaccgggagctggccttcaaggctggagatgtgatcaaggtgctggatgccagcaacaaggactggtggtggggccagattgatgatgaggagggctggttccctgccagctttgtgcggctgtgggtgaaccaggaggatgaggtggaggagggccccagtgatgtgcagaatggccacctggaccccaacagcgactgcctgtgcctgggccggcccctgcagaacagagaccagatgagggccaacgtcatcaatgagatcatgagcacagagcggcactacatcaagcacctgaaggacatctgtgagggctacctgaagcagtgcaggaagaggcgggacatgttcagtgatgagcagctgaaggtgatctttggaaatattgaggacatctaccgcttccagatgggctttgtgcgggacctggagaagcagtacaacaatgatgacccccacctgtctgagatcggcccctgcttcctggagcaccaggacggcttctggatctacagcgagtactgcaacaaccacctggatgcctgcatggagctgagcaagctgatgaaggacagccgctaccagcacttctttgaggcctgccgcctgctgcagcagatgattgatattgccattgatggcttcctgctgacccctgtgcagaagatctgcaagtaccccctgcagctggccgagctgctgaagtacacagcccaggaccacagcgactaccgctacgtggccgccgccctggccgtgatgagaaatgtgacccagcagatcaatgaaaggaagaggcggctggagaacatcgacaagatcgcccagtggcaggcctctgtgctggactgggagggggaggacatcctggacaggagcagcgagctgatctacaccggggagatggcctggatctaccagccctacggcaggaaccagcagagggtcttcttcctgtttgaccaccagatggtgctgtgcaagaaggacctgatccggcgggacatcctgtactacaagggcagaattgacatggacaagtatgaggtggtggacattgaagatggaagagatgatgacttcaacgtgtccatgaagaatgccttcaagctgcacaacaaggagacagaggagatccacctgttctttgccaagaagctggaggagaagatccgctggctgcgggccttccgggaggagaggaagatggtgcaggaggatgagaagattggatttgagatcagcgagaaccagaagaggcaggccgccatgacagtgaggaaggtgcccaagcagaagggcgtgaacagcgcccggtctgtgcccccatcctaccccccaccccaggaccccctgaaccacggccagtacctggtgcctgatggcatcgcccagagccaggtgtttgagttcacagagcccaagaggagccagagccccttctggcagaacttcagccggctgacccccttcaagaagtag

SEQ ID NO: 146912 - DNA, 1245 bp, Artificial Sequence
  Description of Artificial Sequence: Synthetic coding sequence
atgagggccaacgtcatcaatgagatcatgagcacagagcggcactacatcaagcacctgaaggacatctgtgagggctacctgaagcagtgcaggaagaggcgggacatgttcagtgatgagcagctgaaggtgatctttggaaatattgaggacatctaccgcttccagatgggctttgtgcgggacctggagaagcagtacaacaatgatgacccccacctgtctgagatcggcccctgcttcctggagcaccaggacggcttctggatctacagcgagtactgcaacaaccacctggatgcctgcatggagctgagcaagctgatgaaggacagccgctaccagcacttctttgaggcctgccgcctgctgcagcagatgattgatattgccattgatggcttcctgctgacccctgtgcagaagatctgcaagtaccccctgcagctggccgagctgctgaagtacacagcccaggaccacagcgactaccgctacgtggccgccgccctggccgtgatgagaaatgtgacccagcagatcaatgaaaggaagaggcggctggagaacatcgacaagatcgcccagtggcaggcctctgtgctggactgggagggggaggacatcctggacaggagcagcgagctgatctacaccggggagatggcctggatctaccagccctacggcaggaaccagcagagggtcttcttcctgtttgaccaccagatggtgctgtgcaagaaggacctgatccggcgggacatcctgtactacaagggcagaattgacatggacaagtatgaggtggtggacattgaagatggaagagatgatgacttcaacgtgtccatgaagaatgccttcaagctgcacaacaaggagacagaggagatccacctgttctttgccaagaagctggaggagaagatccgctggctgcgggccttccgggaggagaggaagatggtgcaggaggatgagaagattggatttgagatcagcgagaaccagaagaggcaggccgccatgacagtgaggaaggtgcccaagcagaagggcgtgaacagcgcccggtctgtgcccccatcctaccccccaccccaggaccccctgaaccacggccagtacctggtgcctgatggcatcgcccagagccaggtgtttgagttcacagagcccaagaggagccagagccccttctggcagaacttcagccggctgacccccttcaagaagtag

SEQ ID NO: 146913 - DNA, 1488 bp, Artificial Sequence
  Description of Artificial Sequence: Synthetic coding sequence
atggccaaccgggagctggccttcaaggctggagatgtgatcaaggtgctggatgccagcaacaaggactggtggtggggccagattgatgatgaggagggctggttccctgccagctttgtgcggctgtgggtgaaccaggaggatgaggtggaggagggccccagtgatgtgcagaatggccacctggaccccaacagcgactgcctgtgcctgggccggcccctgcagaacagagaccagatgagggccaacgtcatcaatgagatcatgagcacagagcggcactacatcaagcacctgaaggacatctgtgagggctacctgaagcagtgcaggaagagaagagacatgttcagtgatgagcagctgaaggtgatcttcggcaacatcgaggacatctaccgcttccagatgggctttgtgcgggacctggagaagcagtacaacaatgatgacccccacctgtctgaaattggcccctgcttcctggagcaccaggacggcttctggatctacagcgagtactgcaacaaccacctggatgcctgcatggagctgagcaagctgatgaaggacagccgctaccagcacttctttgaggcctgccgcctgctgcagcagatgattgacatcgccattgatggcttcctgctgacccctgtgcagaagatctgcaagtaccccctgcagctggccgagctgctgaagtacacagcccaggaccacagcgactaccgctacgtggccgccgccctggccgtgatgagaaatgtgacccagcagatcaatgaaaggaagaggcggctggagaacatcgacaagatcgcccagtggcaggcctctgtgctggactgggagggggaggacatcctggacaggagcagcgagctgatctacacaggagagatggcctggatctaccagccctatggaagaaaccagcagagggtcttcttcctgtttgaccaccagatggtgctgtgcaagaaggacctgatcagaagagacatcctgtactacaagggcagaattgacatggacaagtatgaggtggtggacattgaagatggaagagatgatgacttcaacgtgtccatgaagaatgccttcaagctgcacaacaaggagacagaggagatccacctgttctttgccaagaagctggaggagaagatccgctggctgcgggccttccgggaggagaggaagatggtgcaggaggatgagaagattggatttgagatcagcgagaaccagaagaggcaggccgccatgacagtgaggaaggtgcccaagcagaagggcgtgaacagcgcccggtctgtgccccccagctaccccccaccccaggaccccctgaaccacggccagtacctggtgcctgatggcatcgcccagagccaggtgtttgagttcacagagcccaagaggagccagagccccttctggcagaacttcagccggctgacccccttcaagaagtag

SEQ ID NO: 146914 - DNA, 1437 bp, Artificial Sequence
  Description of Artificial Sequence: Synthetic coding sequence
atgctgatcaccggggacagcatcgtgtctgctgaggccgtgtgggaccacgtgaccatggccaaccgggagctggccttcaaggctggagatgtgatcaaggtgctggatgccagcaacaaggactggtggtggggccagattgatgatgaggagggctggttccctgccagctttgtgcggctgtgggtgaaccaggaggatgaggtggaggagggccccagtgatgtgcagaatggccacctggaccccaacagcgactgcctgtgcctgggccggcccctgcagaacagagaccagatgagggccaacgtcatcaatgagatcatgagcacagagcggcactacatcaagcacctgaaggacatctgtgagggctacctgaagcagtgcaggaagaggcgggacatgttcagtgatgagcagctgaaggtgatctttggaaatattgaggacatctaccgcttccagatgggctttgtgcgggacctggagaagcagtacaacaatgatgacccccacctgtctgagatcggcccctgcttcctggagcaccaggacggcttctggatctacagcgagtactgcaacaaccacctggatgcctgcatggagctgagcaagctgatgaaggacagccgctaccagcacttctttgaggcctgccgcctgctgcagcagatgattgatattgccattgatggcttcctgctgacccctgtgcagaagatctgcaagtaccccctgcagctggccgagctgctgaagtacacagcccaggaccacagcgactaccgctacgtggccgccgccctggccgtgatgagaaatgtgacccagcagatcaatgaaaggaagaggcggctggagaacatcgacaagatcgcccagtggcaggcctctgtgctggactgggagggggaggacatcctggacaggagcagcgagctgatctacaccggggagatggcctggatctaccagccctacggcaggaaccagcagagggtcttcttcctgtttgaccaccagatggtgctgtgcaagaaggacctgatccggcgggacatcctgtactacaagggcagaattgacatggacaagtatgaggtggtggacattgaagatggaagagatgatgacttcaacgtgtccatgaagaatgccttcaagctgcacaacaaggagacagaggagatccacctgttctttgccaagaagctggaggagaagatccgctggctgcgggccttccgggaggagaggaagatggtgcaggaggatgagaagattggatttgagatcagcgagaaccagaagaggcaggccgccatgacagtgaggaagctgcccttcccccagctgtctgaggcccgcatctgcagccccaagggctttgccagcgtcttcaacggcacctgctgcggggagagctag

SEQ ID NO: 146915 - DNA, 732 bp, Artificial Sequence
  Description of Artificial Sequence: Synthetic coding sequence
atgattgacatcgccattgatggcttcctgctgacccctgtgcagaagatctgcaagtaccccctgcagctggccgagctgctgaagtacacagcccaggaccacagcgactaccgctacgtggccgccgccctggccgtgatgagaaatgtgacccagcagatcaatgaaaggaagaggcggctggagaacatcgacaagatcgcccagtggcaggcctctgtgctggactgggaggacctgatcagaagagacatcctgtactacaagggcagaattgacatggacaagtatgaggtggtggacattgaagatggaagagatgatgacttcaacgtgtccatgaagaatgccttcaagctgcacaacaaggagacagaggagatccacctgttctttgccaagaagctggaggagaagatccgctggctgcgggccttccgggaggagaggaagatggtgcaggaggatgagaagattggatttgagatcagcgagaaccagaagaggcaggccgccatgacagtgaggaaggtgcccaagcagaagggcgtgaacagcgcccggtctgtgccccccagctaccccccaccccaggaccccctgaaccacggccagtacctggtgcctgatggcatcgcccagagccaggtgtttgagttcacagagcccaagaggagccagagccccttctggcagaacttcagccggctgacccccttcaagaagtag

SEQ ID NO: 146916 - DNA, 1392 bp, Artificial Sequence
  Description of Artificial Sequence: Synthetic coding sequence
atgcagtggatccggggcggcagcggcatgctgtgggtgaaccaggaggatgaggtggaggagggccccagtgatgtgcagaatggccacctggaccccaacagcgactgcctgtgcctgggccggcccctgcagaacagagaccagatgagggccaacgtcatcaatgagatcatgagcacagagcggcactacatcaagcacctgaaggacatctgtgagggctacctgaagcagtgcaggaagagaagagacatgttcagtgatgagcagctgaaggtgatcttcggcaacatcgaggacatctaccgcttccagatgggctttgtgcgggacctggagaagcagtacaacaatgatgacccccacctgtctgaaattggcccctgcttcctggagcaccaggacggcttctggatctacagcgagtactgcaacaaccacctggatgcctgcatggagctgagcaagctgatgaaggacagccgctaccagcacttctttgaggcctgccgcctgctgcagcagatgattgacatcgccattgatggcttcctgctgacccctgtgcagaagatctgcaagtaccccctgcagctggccgagctgctgaagtacacagcccaggaccacagcgactaccgctacgtggccgccgccctggccgtgatgagaaatgtgacccagcagatcaatgaaaggaagaggcggctggagaacatcgacaagatcgcccagtggcaggcctctgtgctggactgggagggggaggacatcctggacaggagcagcgagctgatctacacaggagagatggcctggatctaccagccctatggaagaaaccagcagagggtcttcttcctgtttgaccaccagatggtgctgtgcaagaaggacctgatcagaagagacatcctgtactacaagggcagaattgacatggacaagtatgaggtggtggacattgaagatggaagagatgatgacttcaacgtgtccatgaagaatgccttcaagctgcacaacaaggagacagaggagatccacctgttctttgccaagaagctggaggagaagatccgctggctgcgggccttccgggaggagaggaagatggtgcaggaggatgagaagattggatttgagatcagcgagaaccagaagaggcaggccgccatgacagtgaggaaggtgcccaagcagaagggcgtgaacagcgcccggtctgtgccccccagctaccccccaccccaggaccccctgaaccacggccagtacctggtgcctgatggcatcgcccagagccaggtgtttgagttcacagagcccaagaggagccagagccccttctggcagaacttcagccggctgacccccttcaagaagtag

SEQ ID NO: 146917 - DNA, 2409 bp, Artificial Sequence
  Description of Artificial Sequence: Synthetic coding sequence
atgccccgcatcatgatcaagggcggcgtgtggaggaacacagaagatgagatcctgaaggctgctgtgatgaagtatggcaagaaccagtggagccgcatcgccagcctgctgcacaggaagagcgccaagcagtgcaaggcccgctggtatgagtggctggaccccagcatcaagaagacagagtggagccgggaggaggaggagaagctgctgcacctggccaagctgatgcccacccagtggaggaccatcgcccccatcattggaagaacagctgcccagtgcctggagcactatgagttcctgctggacaaggccgcccagagggacaatgaggaggagaccacagatgaccccaggaagctgaagccaggagaaattgaccccaaccctgagaccaagccagcccggccagaccccatcgacatggatgaagatgagctggagatgctgtctgaggcccgggcccggctggccaacacccagggcaagaaggccaagaggaaggcccgggagaagcagctggaggaggcccggcggctggccgccctgcagaagaggcgggagctgcgggccgccggcatcgagatccagaagaagaggaagaggaagaggggcgtggactacaatgctgagatcccctttgagaagaagccagccctgggcttctatgacaccagcgaggagaactaccaggccctggatgctgacttcaggaagctgcggcagcaggacctggatggagagctgcggtctgagaaggagggccgggacaggaagaaggacaagcagcacctgaagaggaagaaggagagtgacctgcccagcgccatcctgcagaccagcggcgtgtctgagttcaccaagaagaggagcaagctggtgctgcctgccccccagatcagtgatgctgagctgcaggaggtggtgaaggtgggccaggccagcgagatcgcccggcagacagctgaggagagcggcatcaccaacagcgccagcagcaccctgctgtctgagtacaacgtgaccaacaacagcgtggccctgcggacccccaggaccccagccagccaggaccgcatcctgcaggaggcccagaacctgatggccctgaccaacgtggacacccccctgaagggcggcctgaacacccccctgcacgagagtgacttctctggagtgaccccccagaggcaggtggtgcagacccccaacacagtgctgagcacccccttccgcacccccagcaatggagctgagggcctgacccccaggagcggcaccacccccaagcctgtgatcaacagcaccccaggccgcacccccctgcgggacaagctgaacatcaacccagaagatggcatggctgactacagcgaccccagctatgtgaagcagatggagcgggagagccgggagcacctgcggctgggcctgctgggcctgcctgcccccaagaatgactttgagatcgtgctgcctgaaaatgctgagaaggagctggaggagcgggagattgatgacacctacattgaagatgctgctgatgtggatgccaggaagcaggccatcagagatgctgagcgggtgaaggagatgaagaggatgcacaaggctgtgcagaaggacctgccccggcccagcgaggtgaatgagaccatcctgcggcccctgaatgtggagccccccctgacagacctgcagaagtctgaggagctgatcaagaaggagatgatcaccatgctgcactatgacctgctgcaccacccctatgagcccagcggcaacaagaagggcaagacagtgggcttcggcaccaacaacagcgagcacatcacctacctggagcacaacccctatgagaagttcagcaaggaggagctgaagaaggcccaggatgtgctggtgcaggagatggaggtggtgaagcagggcatgagccatggagagctgagcagcgaggcctacaaccaggtgtgggaggagtgctacagccaggtgctgtacctgcccggccagagccgctacacccgggccaacctggccagcaagaaggacagaattgagagcctggagaagaggctggagatcaacagaggccacatgaccacagaggccaagagagctgccaagatggagaagaagatgaagatcctgctgggcggctaccagagccgggccatgggcctgatgaagcagctgaatgacctgtgggaccagatcgagcaggcccacctggagctgcggacctttgaggagctgaagaagcatgaagattctgccatcccccggcggctggagtgcctgaaggaggatgtgcagaggcagcaggagcgggagaaggagctgcagcacagatatgctgacctgctgctggagaaggagaccctgaagagcaagttctag

SEQ ID NO: 146918 - DNA, 1455 bp, Artificial Sequence
  Description of Artificial Sequence: Synthetic coding sequence
atgaggcacagcaagaggacctactgcccagactgggatgacaaggactgggactatggcaagtggaggagcagcagcagccacaagaggaggaagaggagccacagcagcgcccaggagaacaagcgctgcaagtacaaccacagcaagatgtgtgacagccactacctggagagccgcagcatcaatgagaaggactaccacagccgccgctacattgatgagtacagaaatgactacacccagggctgtgagcccggccaccggcagagggaccacgagagccgctaccagaaccacagcagcaagagcagcggccgcagcggccgcagcagctacaagagcaagcaccgcatccaccacagcaccagccaccggcgcagccacggcaagagccacaggaggaagaggaccaggtctgtggaggatgatgaggagggccacctgatctgccagagcggagatgtgctgagcgcccgctatgaaattgtggacaccctgggggagggcgccttcggcaaggtggtggagtgcatcgaccacaaggccggcggcagacatgtggccgtgaagatcgtgaagaatgtggaccgctactgtgaggccgcccggtctgagatccaggtgctggagcacctgaacaccacagaccccaacagcaccttccgctgtgtgcagatgctggagtggtttgagcaccacggccacatctgcatcgtgtttgagctgctgggcctgagcacctatgacttcatcaaggaaaatggcttcctgcccttccggctggaccacatcaggaagatggcctaccagatctgcaagtctgtgaacttcctgcacagcaacaagctgacccacacagacctgaagccagagaacatcctgtttgtgcagagcgactacacagaggcctacaaccccaagatcaagagagatgagaggaccctcatcaacccagacatcaaggtggtggactttggcagcgccacctatgatgatgagcaccacagcaccctggtgtccaccaggcactaccgggcccctgaggtgatcctggccctgggctggagccagccctgtgatgtgtggagcatcggctgcatcctgattgagtactacctgggcttcaccgtcttccccacccatgacagcaaggagcacctggccatgatggagcgcatcctgggccccctgcccaagcacatgatccagaagaccaggaagaggaagtacttccaccacgaccggctggactgggatgagcacagcagcgctggccgctacgtgtcccggcgctgcaagcccctgaaggagttcatgctgagccaggatgtggagcacgagcggctgtttgacctgatccagaagatgctggagtatgaccctgccaagaggatcaccctgcgggaggccctgaagcaccccttctttgacctgctgaagaagagcatctag

SEQ ID NO: 146919 - DNA, 1365 bp, Artificial Sequence
  Description of Artificial Sequence: Synthetic coding sequence
atgaggcacagcaagaggacctactgcccagactgggatgacaaggactgggactatggcaagtggaggagcagcagcagccacaagaggaggaagaggagccacagcagcgcccaggagaacaagcgctgcaagtacaaccacagcaagatgtgtgacagccactacctggagagccgcagcatcaatgagaaggactaccacagccgccgctacattgatgagtacagaaatgactacacccagggctgtgagcccggccaccggcagagggaccacgagagccgctaccagaaccacagcagcaagagcagcggccgcagcggccgcagcagctacaagagcaagcaccgcatccaccacagcaccagccaccggcgcagccatggagatgaaattgtggacaccctgggggagggcgccttcggcaaggtggtggagtgcatcgaccacaaggccggcggcagacatgtggccgtgaagatcgtgaagaatgtggaccgctactgtgaggccgcccggtctgagatccaggtgctggagcacctgaacaccacagaccccaacagcaccttccgctgtgtgcagatgctggagtggtttgagcaccacggccacatctgcatcgtgtttgagctgctgggcctgagcacctatgacttcatcaaggaaaatggcttcctgcccttccggctggaccacatcaggaagatggcctaccagatctgcaagtctgtgaacttcctgcacagcaacaagctgacccacacagacctgaagccagagaacatcctgtttgtgcagagcgactacacagaggcctacaaccccaagatcaagagagatgagaggaccctcatcaacccagacatcaaggtggtggactttggcagcgccacctatgatgatgagcaccacagcaccctggtgtccaccaggcactaccgggcccctgaggtgatcctggccctgggctggagccagccctgtgatgtgtggagcatcggctgcatcctgattgagtactacctgggcttcaccgtcttccccacccatgacagcaaggagcacctggccatgatggagcgcatcctgggccccctgcccaagcacatgatccagaagaccaggaagaggaagtacttccaccacgaccggctggactgggatgagcacagcagcgctggccgctacgtgtcccggcgctgcaagcccctgaaggagttcatgctgagccaggatgtggagcacgagcggctgtttgacctgatccagaagatgctggagtatgaccctgccaagaggatcaccctgcgggaggccctgaagcaccccttctttgacctgctgaagaagagcatctag

SEQ ID NO: 146920 - DNA, 1581 bp, Artificial Sequence
  Description of Artificial Sequence: Synthetic coding sequence
atggctgctggaagaagacctgccagcgccctgtggccagagcggcggggcagccccctgcggggggacctgctgggcttccagaatgtgcgggagcccagcagctgtggggagaccctgagcggcatgaggcacagcaagaggacctactgcccagactgggatgacaaggactgggactatggcaagtggaggagcagcagcagccacaagaggaggaagaggagccacagcagcgcccaggagaacaagcgctgcaagtacaaccacagcaagatgtgtgacagccactacctggagagccgcagcatcaatgagaaggactaccacagccgccgctacattgatgagtacagaaatgactacacccagggctgtgagcccggccaccggcagagggaccacgagagccgctaccagaaccacagcagcaagagcagcggccgcagcggccgcagcagctacaagagcaagcaccgcatccaccacagcaccagccaccggcgcagccacggcaagagccacaggaggaagaggaccaggtctgtggaggatgatgaggagggccacctgatctgccagagcggagatgtgctgagcgcccgctatgaaattgtggacaccctgggggagggcgccttcggcaaggtggtggagtgcatcgaccacaaggccggcggcagacatgtggccgtgaagatcgtgaagaatgtggaccgctactgtgaggccgcccggtctgagatccaggtgctggagcacctgaacaccacagaccccaacagcaccttccgctgtgtgcagatgctggagtggtttgagcaccacggccacatctgcatcgtgtttgagctgctgggcctgagcacctatgacttcatcaaggaaaatggcttcctgcccttccggctggaccacatcaggaagatggcctaccagatctgcaagtctgtgaacttcctgcacagcaacaagctgacccacacagacctgaagccagagaacatcctgtttgtgcagagcgactacacagaggcctacaaccccaagatcaagagagatgagaggaccctcatcaacccagacatcaaggtggtggactttggcagcgccacctatgatgatgagcaccacagcaccctggtgtccaccaggcactaccgggcccctgaggtgatcctggccctgggctggagccagccctgtgatgtgtggagcatcggctgcatcctgattgagtactacctgggcttcaccgtcttccccacccatgacagcaaggagcacctggccatgatggagcgcatcctgggccccctgcccaagcacatgatccagaagaccaggaagaggaagtacttccaccacgaccggctggactgggatgagcacagcagcgctggccgctacgtgtcccggcgctgcaagcccctgaaggagttcatgctgagccaggatgtggagcacgagcggctgtttgacctgatccagaagatgctggagtatgaccctgccaagaggatcaccctgcgggaggccctgaagcaccccttctttgacctgctgaagaagagcatctag

SEQ ID NO: 146921 - DNA, 1494 bp, Artificial Sequence
  Description of Artificial Sequence: Synthetic coding sequence
atgccccacccccggcgctaccacagcagcgagcggggcagccggggcagctaccgggagcactaccgcagcaggaagcacaagagaagaagaagccgctcctggagcagcagcagtgacaggaccaggagaagaagaagagaggacagctaccacgtgcgcagccgctcctatgatgacaggagcagtgacagaagagtgtatgaccggcgctactgcggcagctacagaagaaatgactacagccgggacagaggagatgcctactatgacacagactaccgccacagctatgagtaccagcgggagaacagcagctaccgcagccagaggagcagcaggaggaagcacagaagaagaagaagaagaagcaggaccttcagccgcagcagcagccacagcagccggcgggccaagtctgtggaggatgatgctgagggccacctgatctaccacgtgggggactggctgcaggagagatatgaaattgtgtccaccctgggggagggcaccttcggccgggtggtgcagtgtgtggaccaccggcggggcggggcccgggtggccctgaagatcatcaagaatgtggagaagtacaaggaggccgcccggctggagatcaacgtgctggagaagatcaatgagaaggaccctgacaacaagaacctgtgtgtgcagatgtttgactggtttgactaccacggccacatgtgcatcagctttgagctgctgggcctgagcacctttgacttcctgaaggacaacaactacctgccctaccccatccaccaggtgcgccacatggccttccagctgtgccaggccgtgaagttcctgcatgacaacaagctgacccacacagacctgaagccagagaacatcctgtttgtgaacagcgactatgagctgacctacaacctggagaagaagagagatgagaggtctgtgaagagcacagctgtgcgggtggtggactttggcagcgccacctttgaccacgagcaccacagcaccatcgtgtccaccaggcactaccgggcccctgaggtgatcctggagctgggctggagccagccctgtgatgtgtggagcatcggctgcatcatctttgagtactacgtgggcttcaccctcttccagacccatgacaaccgggagcacctggccatgatggagcgcatcctgggccccatccccagcaggatgatcaggaagaccaggaagcagaagtacttctaccggggccgcctggactgggatgagaacaccagcgctggccgctacgtgcgggagaactgcaagcccctgcggcgctacctgaccagcgaggccgaggagcaccaccagctgtttgacctgattgagagcatgctggagtatgagcccgccaagaggctgaccctgggggaggccctgcagcaccccttctttgcccggctgcgggcagagccccccaacaagctgtgggacagcagccgggacatcagcaggtag

SEQ ID NO: 146922 - DNA, 1497 bp, Artificial Sequence
  Description of Artificial Sequence: Synthetic coding sequence
atgccccacccccggcgctaccacagcagcgagcggggcagccggggcagctaccgggagcactaccgcagcaggaagcacaagagaagaagaagccgctcctggagcagcagcagtgacaggaccaggagaagaagaagagaggacagctaccacgtgcgcagccgcagcagctatgatgacaggagcagtgaccggcgggtgtatgaccggcgctactgcggcagctacagaagaaatgactacagccgggacagaggagatgcctactatgacacagactaccgccacagctatgagtaccagcgggagaacagcagctaccgcagccagaggagcagcaggaggaagcacagaagaagaagaagaagaagcaggaccttcagccgcagcagcagccacagcagcagaagagccaagtctgtggaggatgatgctgagggccacctgatctaccacgtgggggactggctgcaggagagatatgagatcgtgtccaccctgggggagggcaccttcggccgggtggtgcagtgtgtggaccacagaagaggaggagcccgggtggccctgaagatcatcaagaatgtggagaagtacaaggaggccgcccggctggagatcaacgtgctggagaagatcaatgagaaggaccctgacaacaagaacctgtgtgtgcagatgtttgactggtttgactaccacggccacatgtgcatcagctttgagctgctgggcctgagcacctttgacttcctgaaggacaacaactacctgccctaccccatccaccaggtgcgccacatggccttccagctgtgccaggccgtgaagttcctgcatgacaacaagctgacccacacagacctgaagccagagaacatcctgtttgtgaacagcgactatgagctgacctacaacctggagaagaagagagatgagaggtctgtgaagagcacagctgtgcgggtggtggactttggaagtgccacctttgaccacgagcaccacagcaccatcgtgtccaccaggcactaccgggcccctgaggtgatcctggagctgggctggagccagccctgtgatgtgtggagcatcggctgcatcatctttgagtactacgtgggcttcaccctcttccagacccatgacaaccgggagcacctggccatgatggagcgcatcctgggccccatccccagcaggatgatcaggaagaccaggaagcagaagtacttctaccggggccgcctggactgggatgagaacaccagcgctggccgctacgtgcgggagaactgcaagcccctgcggcgctacctgaccagcgaggccgaggagcaccaccagctgtttgacctgattgaatccatgctggagtatgagcccgccaagaggctgaccctgggggaggccctgcagcaccccttctttgcccggctgcgggcagagccccccaacaagctgtgggacagcagccgggacatcagcaggtag

SEQ ID NO: 146923 - DNA, 1500 bp, Artificial Sequence
  Description of Artificial Sequence: Synthetic coding sequence
atgccccacccccggcgctaccacagcagcgagcggggcagccggggcagctaccgggagcactaccgcagcaggaagcacaagagaagaagaagccgctcctggagcagcagcagtgacaggaccaggagaagaagaagagaggacagctaccacgtgcgcagccgcagcagctatgatgacaggagcagtgaccggcgggtgtatgaccggcgctactgcggcagctacagaagaaatgactacagccgggacagaggagatgcctactatgacacagactaccgccacagctatgagtaccagcgggagaacagcagctaccgcagccagaggagcagcaggaggaagcacagaagaagaagaagaagaagcaggaccttcagccgcagcagcagccagcacagcagccggcgggccaagtctgtggaggatgatgctgagggccacctgatctaccacgtgggggactggctgcaggagagatatgaaattgtgtccaccctgggggagggcaccttcggccgggtggtgcagtgtgtggaccaccggcggggcggggcccgggtggccctgaagatcatcaagaatgtggagaagtacaaggaggccgcccggctggagatcaacgtgctggagaagatcaatgagaaggaccctgacaacaagaacctgtgtgtgcagatgtttgactggtttgactaccacggccacatgtgcatcagctttgagctgctgggcctgagcacctttgacttcctgaaggacaacaactacctgccctaccccatccaccaggtgcgccacatggccttccagctgtgccaggccgtgaagttcctgcatgacaacaagctgacccacacagacctgaagccagagaacatcctgtttgtgaacagcgactatgagctgacctacaacctggagaagaagagagatgagaggtctgtgaagagcacagctgtgcgggtggtggactttggcagcgccacctttgaccacgagcaccacagcaccatcgtgtccaccaggcactaccgggcccctgaggtgatcctggagctgggctggagccagccctgtgatgtgtggagcatcggctgcatcatctttgagtactacgtgggcttcaccctcttccagacccatgacaaccgggagcacctggccatgatggagcgcatcctgggccccatccccagcaggatgatcaggaagaccaggaagcagaagtacttctaccggggccgcctggactgggatgagaacaccagcgctggccgctacgtgcgggagaactgcaagcccctgcggcgctacctgaccagcgaggccgaggagcaccaccagctgtttgacctgattgagagcatgctggagtatgagcccgccaagaggctgaccctgggggaggccctgcagcaccccttctttgcccggctgcgggcagagccccccaacaagctgtgggacagcagccgggacatcagcaggtag

SEQ ID NO: 146924 - DNA, 816 bp, Artificial Sequence
  Description of Artificial Sequence: Synthetic coding sequence
atgtttgactggtttgactaccacggccacatgtgcatcagctttgagctgctgggcctgagcacctttgacttcctgaaggacaacaactacctgccctaccccatccaccaggtgcgccacatggccttccagctgtgccaggccgtgaagttcctgcatgacaacaagctgacccacacagacctgaagccagagaacatcctgtttgtgaacagcgactatgagctgacctacaacctggagaagaagagagatgagaggtctgtgaagagcacagctgtgcgggtggtggactttggcagcgccacctttgaccacgagcaccacagcaccatcgtgtccaccaggcactaccgggcccctgaggtgatcctggagctgggctggagccagccctgtgatgtgtggagcatcggctgcatcatctttgagtactacgtgggcttcaccctcttccagacccatgacaaccgggagcacctggccatgatggagcgcatcctgggccccatccccagcaggatgatcaggaagaccaggaagcagaagtacttctaccggggccgcctggactgggatgagaacaccagcgctggccgctacgtgcgggagaactgcaagcccctgcggcgctacctgaccagcgaggccgaggagcaccaccagctgtttgacctgattgagagcatgctggagtatgagcccgccaagaggctgaccctgggggaggccctgcagcaccccttctttgcccggctgcgggcagagccccccaacaagctgtgggacagcagccgggacatcagcaggtag

SEQ ID NO: 146925 - DNA, 1500 bp, Artificial Sequence; identical to SEQ ID NO: 146923
  Description of Artificial Sequence: Synthetic coding sequence

SEQ ID NO: 146926 - DNA, 1473 bp, Artificial Sequence
  Description of Artificial Sequence: Synthetic coding sequence
atgcaccactgcaagcgctaccgcagccctgagccagacccctacctgagctaccgctggaagagaagaagaagctacagccgggagcacgagggccgcctgcgctaccccagcagaagagagcccccaccaagaagaagccgcagccgcagccatgaccggctgccctaccagaggcgctaccgggagcggcgggacagcgacacctaccgctgtgaggagaggagccccagctttggagaggactactacggccccagccgcagccgccacagaagaagaagccgggagcggggcccctaccgcaccaggaagcacgcccaccactgccacaagaggaggaccaggagctgcagcagcgccagcagccgcagccagcagagcagcaagaggagcagccgctctgtggaggatgacaaggagggccacctggtgtgccgcatcggggactggctgcaggagagatatgagatcgtgggcaacctgggggagggcaccttcggcaaggtggtggagtgcctggaccacgcccggggcaagagccaggtggccctgaagatcatcagaaatgtgggcaagtaccgggaggccgcccggctggagatcaacgtgctgaagaagatcaaggagaaggacaaggagaacaagttcctgtgtgtgctgatgtctgactggttcaacttccacggccacatgtgcatcgcctttgagctgctgggcaagaacacctttgagttcctgaaggagaacaacttccagccctaccccctgccccacgtgcgccacatggcctaccagctgtgccacgccctgcgcttcctgcacgagaaccagctgacccacacagacctgaagccagagaacatcctgtttgtgaacagcgagtttgagaccctgtacaatgagcacaagagctgtgaggagaagtctgtgaagaacaccagcatccgggtggccgactttggaagtgccacctttgaccacgagcaccacaccaccatcgtggccaccaggcactaccggcccccagaggtgatcctggagctgggctgggcccagccctgtgatgtgtggagcatcggctgcatcctgtttgagtactaccggggcttcaccctcttccagacccatgagaaccgggagcacctggtgatgatggagaagatcctgggccccatccccagccacatgatccacaggaccaggaagcagaagtacttctacaagggcggcctggtgtgggatgagaacagcagtgatggccgctacgtgaaggagaactgcaagcccctgaagagctacatgctgcaggacagcctggagcacgtgcagctgtttgacctgatgaggaggatgctggagtttgatcctgcccagaggatcaccctggccgaggccctgctgcaccccttctttgctggcctgaccccagaggagaggagcttccacaccagcaggaaccccagcaggtag

SEQ ID NO: 146927 - DNA, 459 bp, Artificial Sequence
  Description of Artificial Sequence: Synthetic coding sequence
atgcaccactgcaagcgctaccgcagccctgagccagacccctacctgagctaccgctggaagagaagaagaagctacagccgggagcacgagggccgcctgcgctaccccagcagaagagagcccccaccaagaagaagccgcagccgcagccatgaccggctgccctaccagaggcgctaccgggagcggcgggacagcgacacctaccgctgtgaggagaggagccccagctttggagaggactactacggccccagccgcagccgccacagaagaagaagccgggagcggggcccctaccgcaccaggaagcacgcccaccactgccacaagaggaggaccaggagctgcagcagcgccagctccatgaggctgtggggcacctgggtgaaggcccccctggcccgctggtggagcgcctggaccatgcctgagggcagcctgcggctgccctag

SEQ ID NO: 146928 - DNA, 1404 bp, Artificial Sequence
  Description of Artificial Sequence: Synthetic coding sequence
atgcaccactgcaagcgctaccgcagccctgagccagacccctacctgagctaccgctggaagagaagaagaagctacagccgggagcacgagggccgcctgcgctaccccagcagaagagagcccccaccaagaagaagccgcagccgcagccatgaccggctgccctaccagaggcgctaccgggagcggcgggacagcgacacctaccgctgtgaggagaggagccccagctttggagaggactactacggccccagccgcagccgccacagaagaagaagccgggagcggggcccctaccgcaccaggaagcacgcccaccactgccacaagaggaggaccaggagctgcagcagcgccagcagccgcagccagcagagcagcaagaggagcagccgctctgtggaggatgacaaggagggccacctggtgtgccgcatcggggactggctgcaggagcgctggaagagccaggtggccctgaagatcatcagaaatgtgggcaagtaccgggaggccgcccggctggagatcaacgtgctgaagaagatcaaggagaaggacaaggagaacaagttcctgtgtgtgctgatgtctgactggttcaacttccacggccacatgtgcatcgcctttgagctgctgggcaagaacacctttgagttcctgaaggagaacaacttccagccctaccccctgccccacgtgcgccacatggcctaccagctgtgccacgccctgcgcttcctgcacgagaaccagctgacccacacagacctgaagccagagaacatcctgtttgtgaacagcgagtttgagaccctgtacaatgagcacaagagctgtgaggagaagtctgtgaagaacaccagcatccgggtggccgactttggcagcgccacctttgaccacgagcaccacaccaccatcgtggccaccaggcactacagacctcctgaggtgatcctggagctgggctgggcccagccctgtgatgtgtggagcatcggctgcatcctgtttgagtactaccggggcttcaccctcttccagacccatgaaaatcgggagcacctggtgatgatggagaagatcctgggccccatccccagccacatgatccacaggaccaggaagcagaagtacttctacaagggcggcctggtgtgggatgagaacagcagtgatggccgctacgtgaaggagaactgcaagcccctgaagagctacatgctgcaggacagcctggagcacgtgcagctgtttgacctgatgaggaggatgctggagtttgatcctgcccagaggatcaccctggccgaggccctgctgcaccccttctttgctggcctgaccccagaggagaggagcttccacaccagcaggaaccccagcaggtag

SEQ ID NO: 146929 - DNA, 1473 bp, Artificial Sequence; identical to SEQ ID NO: 146926
  Description of Artificial Sequence: Synthetic coding sequence

SEQ ID NO: 146930 - DNA, 1917 bp, Artificial Sequence
  Description of Artificial Sequence: Synthetic coding sequence
atgcctgtgctgagcgcccggcggcgggagctggccgaccatgctggcagcggcagaagaagtggccccagccccacagcccggagcggcccccacctgagcgccctgcgggcccagcctgcccgggccgcccacctgagcggccggggcacctacgtgcggcgggacacagctgggggcggccctggccaggcccggcccctgggccccccaggcaccagcctgctgggccgcggggccaggagaagtggagagggctggtgccctggggcctttgagagcggggcccgggccgcccggccccccagccgggtggagccccggctggccacagctgccagccgggagggcgccggcctgcccagggctgaggtggccgccggcagcggccgcggggcccggtctggagagtggggcctggccgctgctggggcctgggagaccatgcaccactgcaagcgctaccgcagccctgagccagacccctacctgagctaccgctggaagagaagaagaagctacagccgggagcacgagggccgcctgcgctaccccagcagaagagagcccccaccaagaagaagccgcagccgcagccatgaccggctgccctaccagaggcgctaccgggagcggcgggacagcgacacctaccgctgtgaggagaggagccccagctttggagaggactactacggccccagccgcagccgccacagaagaagaagccgggagcggggcccctaccgcaccaggaagcacgcccaccactgccacaagaggaggaccaggagctgcagcagcgccagcagccgcagccagcagagcagcaagaggagcagccgctctgtggaggatgacaaggagggccacctggtgtgccgcatcggggactggctgcaggagagatatgagatcgtgggcaacctgggggagggcaccttcggcaaggtggtggagtgcctggaccacgcccggggcaagagccaggtggccctgaagatcatcagaaatgtgggcaagtaccgggaggccgcccggctggagatcaacgtgctgaagaagatcaaggagaaggacaaggagaacaagttcctgtgtgtgctgatgtctgactggttcaacttccacggccacatgtgcatcgcctttgagctgctgggcaagaacacctttgagttcctgaaggagaacaacttccagccctaccccctgccccacgtgcgccacatggcctaccagctgtgccacgccctgcgcttcctgcacgagaaccagctgacccacacagacctgaagccagagaacatcctgtttgtgaacagcgagtttgagaccctgtacaatgagcacaagagctgtgaggagaagtctgtgaagaacaccagcatccgggtggccgactttggaagtgccacctttgaccacgagcaccacaccaccatcgtggccaccaggcactaccggcccccagaggtgatcctggagctgggctgggcccagccctgtgatgtgtggagcatcggctgcatcctgtttgagtactaccggggcttcaccctcttccagacccatgagaaccgggagcacctggtgatgatggagaagatcctgggccccatccccagccacatgatccacaggaccaggaagcagaagtacttctacaagggcggcctggtgtgggatgagaacagcagtgatggccgctacgtgaaggagaactgcaagcccctgaagagctacatgctgcaggacagcctggagcacgtgcagctgtttgacctgatgaggaggatgctggagtttgatcctgcccagaggatcaccctggccgaggccctgctgcaccccttctttgctggcctgaccccagaggagaggagcttccacaccagcaggaaccccagcaggtag

SEQ ID NO: 146931 - DNA, 327 bp, Artificial Sequence
  Description of Artificial Sequence: Synthetic coding sequence
atgagcctgaccagcagcagctctgtgcgggtggagtggattgctgctgtgaccatcgctgctggaacagctgccatcggctacctggcctacaagcgcttctacgtgaaggaccacaggaacaaggccatgatcaacctgcacatccagaaggacaaccccaagatcgtgcacgcctttgacatggaggacctgggggacaaggctgtgtactgccgctgctggaggagcaagaagttccccttctgtgatggagcccacaccaagcacaatgaggagaccggggacaacgtgggccccctcatcatcaagaagaaggagacctag

SEQ ID NO: 146932 - DNA, 408 bp, Artificial Sequence
  Description of Artificial Sequence: Synthetic coding sequence
atggtgctggagagcgtggccagaattgtgaaggtgcagctgcctgcctacctgaagaggctgcctgtgcctgagagcatcaccggctttgcccggctgactgtgtctgagtggctgcggctgctgcccttcctgggcgtgctggccctgctgggctacctggccgtgcggcccttcctgcccaagaagaagcagcagaaggacagcctcatcaacctgaagatccagaaggagaaccccaaggtggtgaatgagatcaacatcgaggacctgtgcctgaccaaggccgcctactgccgctgctggaggagcaagaccttccctgcctgtgatggcagccacaacaagcacaatgagctgactggagacaacgtgggccccctcatcctgaagaagaaggaggtgtag

SEQ ID NO: 146933 - DNA, 384 bp, Artificial Sequence
  Description of Artificial Sequence: Synthetic coding sequence
atgagaggagctggggccatcctgcggcctgctgcccggggggcccgggacctgaacccccggcgggacatcagctcctggctggcccagtggttccccaggaccccagcccggtctgtggtggccctgaagacccccatcaaggtggagctggtggccggcaagacctaccgctggtgtgtgtgtggccgcagcaagaagcagcccttctgtgatggcagccacttcttccagaggacaggcctgagccccctgaagttcaaggcccaggagaccaggatggtggccctgtgcacctgcaaggccacccagaggcctccctactgtgatggcacccacaggtctgagcgggtgcagaaggccgaggtgggcagccccctgtag

SEQ ID NO: 146934 - DNA, 1740 bp, Artificial Sequence
  Description of Artificial Sequence: Synthetic coding sequence
atgcccagcgccagctgtgacaccctgctggatgacatcgaggacatcgtgtcccaggaggacagcaagccccaggacagacactttgtgaggaaggatgtggtgcccaaggtgagaagaagaaacacccagaagtacctgcaggaggaggagaacagcccccccagcgacagcaccatccctggcatccagaagatctggatccgcacctggggctgcagccacaacaacagtgatggagagtacatggccggccagctggccgcctacggctacaagatcacagaaaatgccagtgatgctgacctgtggctgctgaacagctgcaccgtgaagaacccagctgaggaccacttcaggaacagcatcaagaaggcccaggaggagaacaagaagatcgtgctggccggctgtgtgccccaggcccagccccggcaggactacctgaagggcctgagcatcattggagtgcagcagattgacagagtggtggaggtggtggaggagaccatcaagggccacagcgtgcggctgctgggccagaagaaggacaatggaagaaggctgggcggggcccggctggacctgcccaagatcaggaagaaccccctgattgagatcatcagcatcaacacaggctgcctgaatgcctgcacctactgcaagaccaagcacgcccggggcaacctggccagctaccccattgatgagctggtggaccgggccaagcagagcttccaggagggcgtgtgtgagatctggctgaccagcgaggacaccggggcctacggccgggacatcggcaccaacctgcccaccctgctgtggaagctggtggaggtgattcctgagggcgccatgctgcggctgggcatgaccaaccccccctacatcctggagcacctggaggagatggccaagatcctgaaccacccccgggtgtatgccttcctgcacatccctgtgcagagcgccagtgacagcgtgctgatggagatgaagcgggagtactgtgtggccgacttcaagagggtggtggacttcctgaaggagaaggtgcccggcatcaccatcgccacagacatcatctgtggcttccctggagaaacagaccaggacttccaggagaccgtgaagctggtggaggagtacaagttccccagcctcttcatcaaccagttctacccccggcccggcaccccagctgccaagatggagcaggtgcctgcccaggtgaagaagcagaggaccaaggacctgagcagggtcttccacagctacagcccctatgaccacaagatcggggagcggcagcaggtgctggtgacagaggagagctttgacagcaagttctacgtggcccacaaccagttctatgagcaggtgctggtgcccaagaacccagccttcatgggcaagatggtggaggtggacatctatgagagcggcaagcacttcatgaagggccagcctgtgtctgatgccaaggtgtacacccccagcatcagcaagcccctggccaagggggaggtgtctggcctgaccaaggacttcagaaatggcctgggcaaccagctgagcagcggcagccacaccagcgctgccagccagtgtgacagcgccagcagcaggatggtgctgcccatgccccggctgcaccaggactgtgccctgaggatgtctgtgggcctggccctgctgggcctgctgtttgccttctttgtgaaggtgtacaactag

SEQ ID NO: 146935 - DNA, 1740 bp, Artificial Sequence; identical to SEQ ID NO: 146934
  Description of Artificial Sequence: Synthetic coding sequence

SEQ ID NO: 146936 - DNA, 1467 bp, Artificial Sequence
  Description of Artificial Sequence: Synthetic coding sequence
atgctgagccgccgctatgaaggagagatccccaagaacatctgcaagaggaagaagacagtgcaccaggtgacagaaaatgccagtgatgctgacctgtggctgctgaacagctgcaccgtgaagaacccagctgaggaccacttcaggaacagcatcaagaaggcccaggaggagaacaagaagatcgtgctggccggctgtgtgccccaggcccagccccggcaggactacctgaagggcctgagcatcattggagtgcagcagattgacagagtggtggaggtggtggaggagaccatcaagggccacagcgtgcggctgctgggccagaagaaggacaatggaagaaggctgggcggggcccggctggacctgcccaagatcaggaagaaccccctgattgagatcatcagcatcaacacaggctgcctgaatgcctgcacctactgcaagaccaagcacgcccggggcaacctggccagctaccccattgatgagctggtggaccgggccaagcagagcttccaggagggcgtgtgtgagatctggctgaccagcgaggacaccggggcctacggccgggacatcggcaccaacctgcccaccctgctgtggaagctggtggaggtgattcctgagggcgccatgctgcggctgggcatgaccaaccccccctacatcctggagcacctggaggagatggccaagatcctgaaccacccccgggtgtatgccttcctgcacatccctgtgcagagcgccagtgacagcgtgctgatggagatgaagcgggagtactgtgtggccgacttcaagagggtggtggacttcctgaaggagaaggtgcccggcatcaccatcgccacagacatcatctgtggcttccctggagaaacagaccaggacttccaggagaccgtgaagctggtggaggagtacaagttccccagcctcttcatcaaccagttctacccccggcccggcaccccagctgccaagatggagcaggtgcctgcccaggtgattggagagcggcagcaggtgctggtgacagaggagagctttgacagcaagttctacgtggcccacaaccagttctatgagcaggtgctggtgcccaagaacccagccttcatgggcaagatggtggaggtggacatctatgaaagtggcaagcacttcatgaagggccagcctgtgtctgatgccaaggtgtacacccccagcatcagcaagcccctggccaagggggaggtgtctggcctgaccaaggacttcagaaatggcctgggcaaccagctgagcagcggcagccacaccagcgctgccagccagtgtgacagcgccagcagcaggatggtgctgcccatgccccggctgcaccaggactgtgccctgaggatgtctgtgggcctggccctgctgggcctgctgtttgccttctttgtgaaggtgtacaactag

SEQ ID NO: 146937 - DNA, 4824 bp, Artificial Sequence
  Description of Artificial Sequence: Synthetic coding sequence
atgatggacctggtgctggaggaggatgtgacagtgcccggcaccctgagcggctgcagcggcctggtgcccagcgtgcctgatgacctggatggcatcaaccccaatgccggcctgggcaatggcctgctgcccaacgtgtctgaggagaccgtgagccccacccgggccaggaacatgaaggactttgagaaccagatcacagagctgaagaaggagaacttcaacctgaagctgcgcatctacttcctggaggagaggatgcagcaggagttccacggccccacagagcacatctacaagaccaacatcgagctgaaggtggaggtggagagcctgaagcgggagctgcaggagcgggagcagctgctgatcaaggccagcaaggctgtggagagcctggccgaggccggcggcagcgagatccagagggtgaaggaggatgccaggaagaaggtgcagcaggtggaggacctgctgaccaagaggatcctgctgctggagaaggccaaggatgtgacagctgcccaggccgagctggagaaggcctttgctggaacagaaacagagaaggccctgcggctgcggctggagagcaagctgtctgagatgaagaagatgcatgaaggagacctggccatggccctggtgctggatgagaaggaccggctgattgaggagctgaagctgagcctgaagagcaaggaggccctgatccagtgcctgaaggaggagaagagccagatggcctgcccagatgaaaatgtgagcagcggggagctgcggggcctgtgtgccgccccccgggaggagaaggagcgggagacagaggccgcccagatggagcaccagaaggagagaaattcctttgaggagcgcatccaggccctggaggaggacctgcgggagaaggagcgggagatcgccacagagaagaagaacagcctgaagagggacaaggccatccagggcctgaccatggccctgaagagcaaggagaagaaggtggaggagctgaacagcgagattgagaagctgtctgctgcctttgccaaggcccgggaggccctgcagaaggcccagacccaggagttccagggctctgaagattatgaaacagccctgagcggcaaggaggccctgtctgctgccctgcggagccagaacctgaccaagagcacagagaaccaccggctgcggcgcagcatcaagaagatcacccaggagctgagtgacctgcagcaggagcgggagcggctggagaaggacctggaggaggcccaccgggagaagagcaaaggagactgcaccatccgggacctgagaaatgaggtggagaagctgagaaatgaggtgaatgaaagagagaaggccatggagaaccgctacaagagcctgctgtctgagagcaacaagaagctgcacaaccaggagcaggtgatcaagcacctgacagagagcaccaaccagaaggatgtgctgctgcagaagttcaatgagaaggacctggaggtgatccagcagaactgctacctgatggctgctgaggacctggagctgcggtctgagggcctcatcacagagaagtgcagcagccagcagcccccaggcagcaagaccatcttcagcaaggagaagaagcagagcagtgactatgaggagctgatccaggtgctgaagaaggagcaggacatctacacccacctggtgaagagcctgcaggagagtgacagcatcaacaacctgcaggccgagctgaacaagatctttgccctgaggaagcagctggagcaggatgtgctgagctaccagaacctgaggaagaccctggaggagcagatcagcgagatcagaagaagagaggagagcttcagcctgtacagcgaccagaccagctacctgagcatctgcctggaggagaacaaccgcttccaggtggagcacttcagccaggaggagctgaagaagaaggtgtctgacctgatccagctggtgaaggagctgtacacagacaaccagcacctgaagaagaccatctttgacctgagctgcatgggcttccagggcaatggcttcccagaccggctggccagcacagagcagacagaggaggccaagaagagccggctgcccatcctgatcaagcccagccgcagcctgggcaacatgtaccgcctgcctgccacccaggaggtggtgacccagctgcagagccagatcctggagctgcagggcgagctgaaggagttcaagacctgcaacaagcagctgcaccagaagctgatcctggccgaggccgtgatggagggccggcccaccccagacaagaccctgctgaatgcccagccccctgtgggcgccgcctaccaggacagccctggagagcagaagggcatcaagaccaccagctctgtgtggagggacaaggagatggacagcgaccagcagaggagctatgaaattgattctgagatctgccccccagatgacctggccagcctgcccagctgcaaggaaaatccagaagatgtgctgagccccacctctgtggccacctacctgagcagcaagagccagcccagcgccaaggtgtctgtgatgggcacagaccagagcgagagcatcaacaccagcaatgaaacagagtacctgaagcagaagatccatgacctggagacagagctggagggctaccagaacttcatcttccagctgcagaagcacagccagtgcagcgaggccatcatcaccgtgctgtgtggcacagagggcgcccaggacggcctgagcaagcccaagaatggaagtgatggagaggagatgaccttcagcagcctgcaccaggtgcgctacgtgaagcacgtgaagatcctgggccccctggcccctgagatgattgacagccgggtgctggagaacctgaagcagcagctggaggagcaggagtacaagctgcagaaggagcagaacctgaacatgcagctgttcagcgagatccacaacctgcagaacaagttccgggacctgagccccccaagatatgacagcctggtgcagagccaggcccgggagctgagcctgcagaggcagcagatcaaggatggccacggcatctgtgtgatcagccggcagcacatgaacaccatgatcaaggcctttgaggagctgctgcaggccagtgatgtggactactgtgtggccgagggcttccaggagcagctgaaccagtgtgccgagctgctggagaagctggagaagctgttcctgaatggcaagtctgtgggcgtggagatgaacacccagaatgagctgatggagcgcatcgaggaggacaacctgacctaccagcacctgctgcctgagagccctgagcccagcgccagccacgccctgagtgactatgagaccagcgagaagagcttcttcagccgggaccagaagcaggacaatgaaacagagaagacctctgtgatggtgaacagcttcagccaggacctgctgatggagcacatccaggagatccgcaccctgaggaagaggctggaggagagcatcaagaccaatgagaagctgaggaagcagctggagcggcagggcagcgagtttgtgcagggcagcaccagcatctttgccagcggcagcgagctgcacagcagcctgaccagcgagatccacttcctgaggaagcagaaccaggccctgaatgccatgctgatcaagggcagccgggacaagcagaaggaaaatgacaagctgcgggagagcctgagcaggaagacagtgtccctggagcacctgcagcgggagtatgcctctgtgaaggaggagaatgaaaggctgcagaaggagggcagcgagaaggagcggcacaaccagcagctgatccaggaggtgcgctgcagcggccaggagctgagccgggtgcaggaggaggtgaagctgcggcagcagctgctgagccagaatgacaagctgctgcagagcctgcgggtggagctgaaggcctatgagaagctggatgaggagcaccggcggctgcgggaggccagcggggagggctggaagggccaggaccccttccgggacctgcacagcctgctgatggagatccaggccctgcggctgcagctggagaggagcattgagaccagcagcaccctgcagagccggctgaaggagcagctggcccggggagctgagaaggcccaggagggcgccctgaccctggccgtgcaggccgtgtccatccctgaggtgcccctgcagcctgacaagcatgatggagacaagtaccccatggagagtgacaacagctttgacctgtttgacagcagccaggccgtgacccccaagtctgtgtctgagaccccacccctgtctggaaatgacacagacagcctgagctgtgacagcggcagcagcgccaccagcaccccctgtgtgtcccggctggtgacaggccaccacctgtgggccagcaagaatggccgccacgtgctgggcctgattgaggactatgaggccctgctgaagcagatcagccagggccagaggctgctggccgagatggacatccagacccaggaggcccccagcagcaccagccaggagctgggcaccaagggcccccacccagcccccctgagcaagtttgtgtcctctgtgtccacagccaagctgaccctggaggaggcctacagaaggctgaagctgctgtggagggtgtccctgcctgaagatggccagtgccccctgcactgtgagcagatcggggagatgaaggccgaggtgaccaagctgcacaagaagctgaagaagagctag

SEQ ID NO: 146938 - DNA, 5682 bp, Artificial Sequence
  Description of Artificial Sequence: Synthetic coding sequence
atgatggacctggtgctggaggaggatgtgacagtgcccggcaccctgagcggctgcagcggcctggtgcccagcgtgcctgatgacctggatggcatcaaccccaatgccggcctgggcaatggcctgctgcccaacgtgtctgaggagaccgtgagccccacccgggccaggaacatgaaggactttgagaaccagatcacagagctgaagaaggagaacttcaacctgaagctgcgcatctacttcctggaggagaggatgcagcaggagttccacggccccacagagcacatctacaagaccaacatcgagctgaaggtggaggtggagagcctgaagcgggagctgcaggagcgggagcagctgctgatcaaggccagcaaggctgtggagagcctggccgaggccggcggcagcgagatccagagggtgaaggaggatgccaggaagaaggtgcagcaggtggaggacctgctgaccaagaggatcctgctgctggagaaggatgtgacagctgcccaggccgagctggagaaggcctttgctggaacagaaacagagaaggccctgcggctgcggctggagagcaagctgtctgagatgaagaagatgcatgaaggagacctggccatggccctggtgctggatgagaaggaccggctgattgaggagctgaagctgagcctgaagagcaaggaggccctgatccagtgcctgaaggaggagaagagccagatggcctgcccagatgaaaatgtgagcagcggggagctgcggggcctgtgtgccgccccccgggaggagaaggagcgggagacagaggccgcccagatggagcaccagaaggagagaaattcctttgaggagcgcatccaggccctggaggaggacctgcgggagaaggagcgggagatcgccacagagaagaagaacagcctgaagagggacaaggccatccagggcctgaccatggccctgaagagcaaggagaagaaggtggaggagctgaacagcgagattgagaagctgtctgctgcctttgccaaggcccgggaggccctgcagaaggcccagacccaggagttccagggctctgaagattatgaaacagccctgagcggcaaggaggccctgtctgctgccctgcggagccagaacctgaccaagagcacagagaaccaccggctgcggcgcagcatcaagaagatcacccaggagctgagtgacctgcagcaggagcgggagcggctggagaaggacctggaggaggcccaccgggagaagagcaaaggagactgcaccatccgggacctgagaaatgaggtggagaagctgagaaatgaggtgaatgaaagagagaaggccatggagaaccgctacaagagcctgctgtctgagagcaacaagaagctgcacaaccaggagcaggtgatcaagcacctgacagagagcaccaaccagaaggatgtgctgctgcagaagttcaatgagaaggacctggaggtgatccagcagaactgctacctgatggctgctgaggacctggagctgcggtctgagggcctcatcacagagaagtgcagcagccagcagcccccaggcagcaagaccatcttcagcaaggagaagaagcagagcagtgactatgaggagctgatccaggtgctgaagaaggagcaggacatctacacccacctggtgaagagcctgcaggagagtgacagcatcaacaacctgcaggccgagctgaacaagatctttgccctgaggaagcagctggagcaggatgtgctgagctaccagaacctgaggaagaccctggaggagcagatcagcgagatcagaagaagagaggaggagagcttcagcctgtacagcgaccagaccagctacctgagcatctgcctggaggagaacaaccgcttccaggtggagcacttcagccaggaggagctgaagaagaaggtgtctgacctgatccagctggtgaaggagctgtacacagacaaccagcacctgaagaagaccatctttgacctgagctgcatgggcttccagggcaatggcttcccagaccggctggccagcacagagcagacagagctgctggccagcaaggaggatgaggacaccatcaagattggagaagatgatgagatcaacttcctgagtgaccagcacctgcagcagagcaatgagatcatgaaggacctgagcaaaggaggctgcaagaatggctacctgcggcacacagagagcaagatcagtgactgtgatggagcccacgcccctggctgcctggaggagggcgccttcatcaacctgctggcccccctcttcaatgagaaggccaccctgctgctggagagcaggccagacctgctgaaggtggtgcgggagctgctgctgggccagctgttcctgacagagcaggaggtgtctggagagcacctggatggcaagacagagaagacccccaagcagaagggggagctggtgcactttgtgcagaccaacagcttcagcaagccccatgatgagctgaagctgagctgtgaggcccagctggtgaaggccggggaggtgcccaaggtgggcctgaaggatgcctctgtgcagacagtggccacagaaggagacctgctgcgcttcaagcatgaggccacccgggaggcctgggaggagaagcccatcaacacagccctgtctgctgagcacaggcctgagaacctgcatggagtgcccggctggcaggccgccctgctgagcctgcccggcatcaccaaccgggaggccaagaagagccggctgcccatcctgatcaagcccagccgcagcctgggcaacatgtaccgcctgcctgccacccaggaggtggtgacccagctgcagagccagatcctggagctgcagggcgagctgaaggagttcaagacctgcaacaagcagctgcaccagaagctgatcctggccgaggccgtgatggagggccggcccaccccagacaagaccctgctgaatgcccagccccctgtgggcgccgcctaccaggacagccctggagagcagaagggcatcaagaccaccagctctgtgtggagggacaaggagatggacagcgaccagcagaggagctatgaaattgattctgagatctgccccccagatgacctggccagcctgcccagctgcaaggaaaatccagaagatgtgctgagccccacctctgtggccacctacctgagcagcaagagccagcccagcgccaaggtgtctgtgatgggcacagaccagagcgagagcatcaacaccagcaatgaaacagagtacctgaagcagaagatccatgacctggagacagagctggagggctaccagaacttcatcttccagctgcagaagcacagccagtgcagcgaggccatcatcaccgtgctgtgtggcacagagggcgcccaggacggcctgagcaagcccaagaatggaagtgatggagaggagatgaccttcagcagcctgcaccaggtgcgctacgtgaagcacgtgaagatcctgggccccctggcccctgagatgattgacagccgggtgctggagaacctgaagcagcagctggaggagcaggagtacaagctgcagaaggagcagaacctgaacatgcagctgttcagcgagatccacaacctgcagaacaagttccgggacctgagccccccaagatatgacagcctggtgcagagccaggcccgggagctgagcctgcagaggcagcagatcaaggatggccacggcatctgtgtgatcagccggcagcacatgaacaccatgatcaaggcctttgaggagctgctgcaggccagtgatgtggactactgtgtggccgagggcttccaggagcagctgaaccagtgtgccgagctgctggagaagctggagaagctgttcctgaatggcaagtctgtgggcgtggagatgaacacccagaatgagctgatggagcgcatcgaggaggacaacctgacctaccagcacctgctgcctgagagccctgagcccagcgccagccacgccctgagtgactatgagaccagcgagaagagcttcttcagccgggaccagaagcaggacaatgaaacagagaagacctctgtgatggtgaacagcttcagccaggacctgctgatggagcacatccaggagatccgcaccctgaggaagaggctggaggagagcatcaagaccaatgagaagctgaggaagcagctggagcggcagggcagcgagtttgtgcagggcagcaccagcatctttgccagcggcagcgagctgcacagcagcctgaccagcgagatccacttcctgaggaagcagaaccaggccctgaatgccatgctgatcaagggcagccgggacaagcagaaggaaaatgacaagctgcgggagagcctgagcaggaagacagtgtccctggagcacctgcagcgggagtatgcctctgtgaaggaggagaatgaaaggctgcagaaggagggcagcgagaaggagcggcacaaccagcagctgatccaggaggtgcgctgcagcggccaggagctgagccgggtgcaggaggaggtgaagctgcggcagcagctgctgagccagaatgacaagctgctgcagagcctgcgggtggagctgaaggcctatgagaagctggatgaggagcaccggcggctgcgggaggccagcggggagggctggaagggccaggaccccttccgggacctgcacagcctgctgatggagatccaggccctgcggctgcagctggagaggagcattgagaccagcagcaccctgcagagccggctgaaggagcagctggcccggggagctgagaaggcccaggagggcgccctgaccctggccgtgcaggccgtgtccatccctgaggtgcccctgcagcctgacaagcatgatggagacaagtaccccatggagagtgacaacagctttgacctgtttgacagcagccaggccgtgacccccaagtctgtgtctgagaccccacccctgtctggaaatgacacagacagcctgagctgtgacagcggcagcagcgccaccagcaccccctgtgtgtcccggctggtgacaggccaccacctgtgggccagcaagaatggccgccacgtgctgggcctgattgaggactatgaggccctgctgaagcagatcagccagggccagaggctgctggccgagatggacatccagacccaggaggcccccagcagcaccagccaggagctgggcaccaagggcccccacccagcccccctgagcaagtttgtgtcctctgtgtccacagccaagctgaccctggaggaggcctacagaaggctgaagctgctgtggagggtgtccctgcctgaagatggccagtgccccctgcactgtgagcagatcggggagatgaaggccgaggtgaccaagctgcacaagaagctgtttgagcaggagaagaagctgcagaacaccatgaagctgctgcagctgagcaagaggcaggagaaggtgatctttgaccagctggtggtgacccacaagatcctgaggaaggcccggggcaacctggagctgcggcctgggggcgcccaccctggcacctgcagccccagcaggcctggcagctag

SEQ ID NO: 146939 - DNA, 5559 bp, Artificial Sequence
  Description of Artificial Sequence: Synthetic coding sequence
atgatggacctggtgctggaggaggatgtgacagtgcccggcaccctgagcggctgcagcggcctggtgcccagcgtgcctgatgacctggatggcatcaaccccaatgccggcctgggcaatggcctgctgcccaacgtgtctgaggagaccgtgagccccacccgggccaggaacatgaaggactttgagaaccagatcacagagctgaagaaggagaacttcaacctgaagctgcgcatctacttcctggaggagaggatgcagcaggagttccacggccccacagagcacatctacaagaccaacatcgagctgaaggtggaggtggagagcctgaagcgggagctgcaggagcgggagcagctgctgatcaaggccagcaaggctgtggagagcctggccgaggccggcggcagcgagatccagagggtgaaggaggatgccaggaagaaggtgcagcaggtggaggacctgctgaccaagaggatcctgctgctggagaaggatgtgacagctgcccaggccgagctggagaaggcctttgctggaacagaaacagagaaggccctgcggctgcggctggagagcaagctgtctgagatgaagaagatgcatgaaggagacctggccatggccctggtgctggatgagaaggaccggctgattgaggagctgaagctgagcctgaagagcaaggaggccctgatccagtgcctgaaggaggagaagagccagatggcctgcccagatgaaaatgtgagcagcggggagctgcggggcctgtgtgccgccccccgggaggagaaggagcgggagacagaggccgcccagatggagcaccagaaggagagaaattcctttgaggagcgcatccaggccctggaggaggacctgcgggagaaggagcgggagatcgccacagagaagaagaacagcctgaagagggacaaggccatccagggcctgaccatggccctgaagagcaaggagaagaaggtggaggagctgaacagcgagattgagaagctgtctgctgcctttgccaaggcccgggaggccctgcagaaggcccagacccaggagttccagggctctgaagattatgaaacagccctgagcggcaaggaggccctgtctgctgccctgcggagccagaacctgaccaagagcacagagaaccaccggctgcggcgcagcatcaagaagatcacccaggagctgagtgacctgcagcaggagcgggagcggctggagaaggacctggaggaggcccaccgggagaagagcaaaggagactgcaccatccgggacctgagaaatgaggtggagaagctgagaaatgaggtgaatgaaagagagaaggccatggagaaccgctacaagagcctgctgtctgagagcaacaagaagctgcacaaccaggagcaggtgatcaagcacctgacagagagcaccaaccagaaggatgtgctgctgcagaagttcaatgagaaggacctggaggtgatccagcagaactgctacctgatggctgctgaggacctggagctgcggtctgagggcctcatcacagagaagtgcagcagccagcagcccccaggcagcaagaccatcttcagcaaggagaagaagcagagcagtgactatgaggagctgatccaggtgctgaagaaggagcaggacatctacacccacctggtgaagagcctgcaggagagtgacagcatcaacaacctgcaggccgagctgaacaagatctttgccctgaggaagcagctggagcaggatgtgctgagctaccagaacctgaggaagaccctggaggagcagatcagcgagatcagaagaagagaggaggagagcttcagcctgtacagcgaccagaccagctacctgagcatctgcctggaggagaacaaccgcttccaggtggagcacttcagccaggaggagctgaagaagaaggtgtctgacctgatccagctggtgaaggagctgtacacagacaaccagcacctgaagaagaccatctttgacctgagctgcatgggcttccagggcaatggcttcccagaccggctggccagcacagagcagacagagctgctggccagcaaggaggatgaggacaccatcaagattggagaagatgatgagatcaacttcctgagtgaccagcacctgcagcagagcaatgagatcatgaaggacctgagcaaaggaggctgcaagaatggctacctgcggcacacagagagcaagatcagtgactgtgatggagcccacgcccctggctgcctggaggagggcgccttcatcaacctgctggcccccctcttcaatgagaaggccaccctgctgctggagagcaggccagacctgctgaaggtggtgcgggagctgctgctgggccagctgttcctgacagagcaggaggtgtctggagagcacctggatggcaagacagagaagacccccaagcagaagggggagctggtgcactttgtgcagaccaacagcttcagcaagccccatgatgagctgaagctgagctgtgaggcccagctggtgaaggccggggaggtgcccaaggtgggcctgaaggatgcctctgtgcagacagtggccacagaaggagacctgctgcgcttcaagcatgaggccacccgggaggcctgggaggagaagcccatcaacacagccctgtctgctgagcacaggcctgagaacctgcatggagtgcccggctggcaggccgccctgctgagcctgcccggcatcaccaaccgggaggccaagaagagccggctgcccatcctgatcaagcccagccgcagcctgggcaacatgtaccgcctgcctgccacccaggaggtggtgacccagctgcagagccagatcctggagctgcagggcgagctgaaggagttcaagacctgcaacaagcagctgcaccagaagctgatcctggccgaggccgtgatggagggccggcccaccccagacaagaccctgctgaatgacagcgagatctgccccccagatgacctggccagcctgcccagctgcaaggagaacccagaagatgtgctgagccccacctctgtggccacctacctgagcagcaagagccagcccagcgccaaggtgtctgtgatgggcacagaccagagcgagagcatcaacaccagcaatgaaacagagtacctgaagcagaagatccatgacctggagacagagctggagggctaccagaacttcatcttccagctgcagaagcacagccagtgcagcgaggccatcatcaccgtgctgtgtggcacagaaggagcccaggacggcctgagcaagcccaagaatggaagtgatggagaggagatgaccttcagcagcctgcaccaggtgcgctacgtgaagcacgtgaagatcctgggccccctggcccctgagatgattgacagccgggtgctggagaacctgaagcagcagctggaggagcaggagtacaagctgcagaaggagcagaacctgaacatgcagctgttcagcgagatccacaacctgcagaacaagttccgggacctgagcccccccaggtatgacagcctggtgcagagccaggcccgggagctgagcctgcagaggcagcagatcaaggatggccacggcatctgtgtgatcagccggcagcacatgaacaccatgatcaaggcctttgaggagctgctgcaggccagtgatgtggactactgtgtggccgagggcttccaggagcagctgaaccagtgtgccgagctgctggagaagctggagaagctgttcctgaatggcaagtctgtgggcgtggagatgaacacccagaatgagctgatggagagaattgaggaggacaacctgacctaccagcacctgctgcctgagagccctgagcccagcgccagccacgccctgagtgactatgagaccagcgagaagagcttcttcagccgggaccagaagcaggacaatgaaacagagaagacctctgtgatggtgaacagcttcagccaggacctgctgatggagcacatccaggagatccgcaccctgaggaagaggctggaggagagcatcaagaccaatgagaagctgaggaagcagctggagcggcagggcagcgagtttgtgcagggcagcaccagcatctttgccagcggcagcgagctgcacagcagcctgaccagcgagatccacttcctgaggaagcagaaccaggccctgaatgccatgctgatcaagggcagccgggacaagcagaaggaaaatgacaagctgcgggagagcctgagcaggaagacagtgtccctggagcacctgcagcgggagtatgcctctgtgaaggaggagaatgaaaggctgcagaaggagggcagcgagaaggagcggcacaaccagcagctgatccaggaggtgcgctgcagcggccaggagctgagccgggtgcaggaggaggtgaagctgcggcagcagctgctgagccagaatgacaagctgctgcagagcctgcgggtggagctgaaggcctatgagaagctggatgaggagcaccggcggctgcgggaggccagcggggagggctggaagggccaggaccccttccgggacctgcacagcctgctgatggagatccaggccctgcggctgcagctggagaggagcattgagaccagcagcaccctgcagagccggctgaaggagcagctggcccggggagctgagaaggcccaggagggcgccctgaccctggccgtgcaggccgtgtccatccctgaggtgcccctgcagcctgacaagcatgatggagacaagtaccccatggagagtgacaacagctttgacctgtttgacagcagccaggccgtgacccccaagtctgtgtctgagaccccacccctgtctggaaatgacacagacagcctgagctgtgacagcggcagcagcgccaccagcaccccctgtgtgtcccggctggtgacaggccaccacctgtgggccagcaagaatggaagacatgtgctgggcctgattgaagattatgaggccctgctgaagcagatcagccagggccagaggctgctggccgagatggacatccagacccaggaggcccccagcagcaccagccaggagctgggcaccaagggcccccacccagcccccctgagcaagtttgtgtcctctgtgtccacagccaagctgaccctggaggaggcctaccgccgcctgaagctgctgtggagggtgtccctgcctgaagatggccagtgccccctgcactgtgagcagattggagagatgaaggccgaggtgaccaagctgcacaagaagctgtttgagcaggagaagaagctgcagaacaccatgaagctgctgcagctgagcaagaggcaggagaaggtgatctttgaccagctggtggtgacccacaagatcctgaggaaggcccggggcaacctggagctgcggcctggaggagcccaccctggcacctgcagccccagccggcccggcagctag

SEQ ID NO: 146940 - DNA, 5445 bp, Artificial Sequence
  Description of Artificial Sequence: Synthetic coding sequence
atgatggacctggtgctggaggaggatgtgacagtgcccggcaccctgagcggctgcagcggcctggtgcccagcgtgcctgatgacctggatggcatcaaccccaatgccggcctgggcaatggcctgctgcccaacgtgtctgaggagaccgtgagccccacccgggccaggaacatgaaggactttgagaaccagatcacagagctgaagaaggagaacttcaacctgaagctgcgcatctacttcctggaggagaggatgcagcaggagttccacggccccacagagcacatctacaagaccaacatcgagctgaaggtggaggtggagagcctgaagcgggagctgcaggagcgggagcagctgctgatcaaggccagcaaggctgtggagagcctggccgaggccggcggcagcgagatccagagggtgaaggaggatgccaggaagaaggtgcagcaggtggaggacctgctgaccaagaggatcctgctgctggagaaggatgtgacagctgcccaggccgagctggagaaggcctttgctggaacagaaacagagaaggccctgcggctgcggctggagagcaagctgtctgagatgaagaagatgcatgaaggagacctggccatggccctggtgctggatgagaaggaccggctgattgaggagctgaagctgagcctgaagagcaaggaggccctgatccagtgcctgaaggaggagaagagccagatggcctgcccagatgaaaatgtgagcagcggggagctgcggggcctgtgtgccgccccccgggaggagaaggagcgggagacagaggccgcccagatggagcaccagaaggagagaaattcctttgaggagcgcatccaggccctggaggaggacctgcgggagaaggagcgggagatcgccacagagaagaagaacagcctgaagagggacaaggccatccagggcctgaccatggccctgaagagcaaggagaagaaggtggaggagctgaacagcgagattgagaagctgtctgctgcctttgccaaggcccgggaggccctgcagaaggcccagacccaggagttccagggctctgaagattatgaaacagccctgagcggcaaggaggccctgtctgctgccctgcggagccagaacctgaccaagagcacagagaaccaccggctgcggcgcagcatcaagaagatcacccaggagctgagtgacctgcagcaggagcgggagcggctggagaaggacctggaggaggcccaccgggagaagagcaaaggagactgcaccatccgggacctgagaaatgaggtggagaagctgagaaatgaggtgaatgaaagagagaaggccatggagaaccgctacaagagcctgctgtctgagagcaacaagaagctgcacaaccaggagcaggtgatcaagcacctgacagagagcaccaaccagaaggatgtgctgctgcagaagttcaatgagaaggacctggaggtgatccagcagaactgctacctgatggctgctgaggacctggagctgcggtctgagggcctcatcacagagaagtgcagcagccagcagcccccaggcagcaagaccatcttcagcaaggagaagaagcagagcagtgactatgaggagctgatccaggtgctgaagaaggagcaggacatctacacccacctggtgaagagcctgcaggagagtgacagcatcaacaacctgcaggccgagctgaacaagatctttgccctgaggaagcagctggagcaggatgtgctgagctaccagaacctgaggaagaccctggaggagcagatcagcgagatcagaagaagagaggaggagagcttcagcctgtacagcgaccagaccagctacctgagcatctgcctggaggagaacaaccgcttccaggtggagcacttcagccaggaggagctgaagaagaaggtgtctgacctgatccagctggtgaaggagctgtacacagacaaccagcacctgaagaagaccatctttgacctgagctgcatgggcttccagggcaatggcttcccagaccggctggccagcacagagcagacagagctgctggccagcaaggaggatgaggacaccatcaagattggagaagatgatgagatcaacttcctgagtgaccagcacctgcagcagagcaatgagatcatgaaggacctgagcaaaggaggctgcaagaatggctacctgcggcacacagagagcaagatcagtgactgtgatggagcccacgcccctggctgcctggaggagggcgccttcatcaacctgctggcccccctcttcaatgagaaggccaccctgctgctggagagcaggccagacctgctgaaggtggtgcgggagctgctgctgggccagctgttcctgacagagcaggaggtgtctggagagcacctggatggcaagacagagaagacccccaagcagaagggggagctggtgcactttgtgcagaccaacagcttcagcaagccccatgatgagctgaagctgagctgtgaggcccagctggtgaaggccggggaggtgcccaaggtgggcctgaaggatgcctctgtgcagacagtggccacagaaggagacctgctgcgcttcaagcatgaggccacccgggaggcctgggaggagaagcccatcaacacagccctgtctgctgagcacaggcctgagaacctgcatggagtgcccggctggcaggccgccctgctgagcctgcccggcatcaccaaccgggaggccaagaagagccggctgcccatcctgatcaagcccagccgcagcctgggcaacatgtaccgcctgcctgccacccaggaggtggtgacccagctgcagagccagatcctggagctgcagggcgagctgaaggagttcaagacctgcaacaagcagctgcaccagaagctgatcctggccgaggccgtgatggagggccggcccaccccagacaagaccctgctgaatgcccagccccctgtgggcgccgcctaccaggacagccctggagagcagaagggcatcaagaccaccagctctgtgtggagggacaaggagatggacagcgaccagcagaggagctatgaaattgattctgagatctgccccccagatgacctggccagcctgcccagctgcaaggaaaatccagaagatgtgctgagccccacctctgtggccacctacctgagcagcaagagccagcccagcgccaaggtgtctgtgatgggcacagaccagagcgagagcatcaacaccagcaatgaaacagagtacctgaagcagaagatccatgacctggagacagagctggagggctaccagaacttcatcttccagctgcagaagcacagccagtgcagcgaggccatcatcaccgtgctgtgtggcacagagggcgcccaggacggcctgagcaagcccaagaatggaagtgatggagaggagatgaccttcagcagcctgcaccaggtgcgctacgtgaagcacgtgaagatcctgggccccctggcccctgagatgattgacagccgggtgctggagaacctgaagcagcagctggaggagcaggagtacaagctgcagaaggagcagaacctgaacatgcagctgttcagcgagatccacaacctgcagaacaagttccgggacctgagccccccaagatatgacagcctggtgcagagccaggcccgggagctgagcctgcagaggcagcagatcaaggatggccacggcatctgtgtgatcagccggcagcacatgaacaccatgatcaaggcctttgaggagctgctgcaggccagtgatgtggactactgtgtggccgagggcttccaggagcagctgaaccagtgtgccgagctgctggagaagctggagaagctgttcctgaatggcaagtctgtgggcgtggagatgaacacccagaatgagctgatggagcgcatcgaggaggacaacctgacctaccagcacctgctgcctgagagccctgagcccagcgccagccacgccctgagtgactatgagaccagcgagaagagcttcttcagccgggaccagaagcaggacaatgaaacagagaagacctctgtgatggtgaacagcttcagccaggacctgctgatggagcacatccaggagatccgcaccctgaggaagaggctggaggagagcatcaagaccaatgagaagctgaggaagcagctggagcggcagggcagcgagtttgtgcagggcagcaccagcatctttgccagcggcagcgagctgcacagcagcctgaccagcgagatccacttcctgaggaagcagaaccaggccctgaatgccatgctgatcaagggcagccgggacaagcagaaggaaaatgacaagctgcgggagagcctgagcaggaagacagtgtccctggagcacctgcagcgggagtatgcctctgtgaaggaggagaatgaaaggctgcagaaggagggcagcgagaaggagcggcacaaccagcagctgatccaggaggtgcgctgcagcggccaggagctgagccgggtgcaggaggaggtgaagctgcggcagcagctgctgagccagaatgacaagctgctgcagagcctgcgggtggagctgaaggcctatgagaagctggatgaggagcaccggcggctgagagatggagacaagtaccccatggagagtgacaacagctttgacctgtttgacagcagccaggccgtgacccccaagtctgtgtctgagaccccacccctgtctggaaatgacacagacagcctgagctgtgacagcggcagcagcgccaccagcaccccctgtgtgtcccggctggtgacaggccaccacctgtgggccagcaagaatggaagacatgtgctgggcctgattgaagattatgaggccctgctgaagcagatcagccagggccagaggctgctggccgagatggacatccagacccaggaggcccccagcagcaccagccaggagctgggcaccaagggcccccacccagcccccctgagcaagtttgtgtcctctgtgtccacagccaagctgaccctggaggaggcctaccgccgcctgaagctgctgtggagggtgtccctgcctgaagatggccagtgccccctgcactgtgagcagattggagagatgaaggccgaggtgaccaagctgcacaagaagctgtttgagcaggagaagaagctgcagaacaccatgaagctgctgcagctgagcaagaggcaggagaaggtgatctttgaccagctggtggtgacccacaagatcctgaggaaggcccggggcaacctggagctgcggcctggaggagcccaccctggcacctgcagccccagccggcccggcagctag

SEQ ID NO: 146941 - DNA, 5586 bp, Artificial Sequence
  Description of Artificial Sequence: Synthetic coding sequence
atgatggacctggtgctggaggaggatgtgacagtgcccggcaccctgagcggctgcagcggcctggtgcccagcgtgcctgatgacctggatggcatcaaccccaatgccggcctgggcaatggcctgctgcccaacgtgtctgaggagaccgtgagccccacccgggccaggaacatgaaggactttgagaaccagatcacagagctgaagaaggagaacttcaacctgaagctgcgcatctacttcctggaggagaggatgcagcaggagttccacggccccacagagcacatctacaagaccaacatcgagctgaaggtggaggtggagagcctgaagcgggagctgcaggagcgggagcagctgctgatcaaggccagcaaggctgtggagagcctggccgaggccggcggcagcgagatccagagggtgaaggaggatgccaggaagaaggtgcagcaggtggaggacctgctgaccaagaggatcctgctgctggagaaggatgtgacagctgcccaggccgagctggagaaggcctttgctggaacagaaacagagaaggccctgcggctgcggctggagagcaagctgtctgagatgaagaagatgcatgaaggagacctggccatggccctggtgctggatgagaaggaccggctgattgaggagctgaagctgagcctgaagagcaaggaggccctgatccagtgcctgaaggaggagaagagccagatggcctgcccagatgaaaatgtgagcagcggggagctgcggggcctgtgtgccgccccccgggaggagaaggagcgggagacagaggccgcccagatggagcaccagaaggagagaaattcctttgaggagcgcatccaggccctggaggaggacctgcgggagaaggagcgggagatcgccacagagaagaagaacagcctgaagagggacaaggccatccagggcctgaccatggccctgaagagcaaggagaagaaggtggaggagctgaacagcgagattgagaagctgtctgctgcctttgccaaggcccgggaggccctgcagaaggcccagacccaggagttccagggctctgaagattatgaaacagccctgagcggcaaggaggccctgtctgctgccctgcggagccagaacctgaccaagagcacagagaaccaccggctgcggcgcagcatcaagaagatcacccaggagctgagtgacctgcagcaggagcgggagcggctggagaaggacctggaggaggcccaccgggagaagagcaaaggagactgcaccatccgggacctgagaaatgaggtggagaagctgagaaatgaggtgaatgaaagagagaaggccatggagaaccgctacaagagcctgctgtctgagagcaacaagaagctgcacaaccaggagcaggtgatcaagcacctgacagagagcaccaaccagaaggatgtgctgctgcagaagttcaatgagaaggacctggaggtgatccagcagaactgctacctgatggctgctgaggacctggagctgcggtctgagggcctcatcacagagaagtgcagcagccagcagcccccaggcagcaagaccatcttcagcaaggagaagaagcagagcagtgactatgaggagctgatccaggtgctgaagaaggagcaggacatctacacccacctggtgaagagcctgcaggagagtgacagcatcaacaacctgcaggccgagctgaacaagatctttgccctgaggaagcagctggagcaggatgtgctgagctaccagaacctgaggaagaccctggaggagcagatcagcgagatcagaagaagagaggaggagagcttcagcctgtacagcgaccagaccagctacctgagcatctgcctggaggagaacaaccgcttccaggtggagcacttcagccaggaggagctgaagaagaaggtgtctgacctgatccagctggtgaaggagctgtacacagacaaccagcacctgaagaagaccatctttgacctgagctgcatgggcttccagggcaatggcttcccagaccggctggccagcacagagcagacagagatcatgaaggacctgagcaaaggaggctgcaagaatggctacctgcggcacacagagagcaagatcagtgactgtgatggagcccacgcccctggctgcctggaggagggcgccttcatcaacctgctggcccccctcttcaatgagaaggccaccctgctgctggagagcaggccagacctgctgaaggtggtgcgggagctgctgctgggccagctgttcctgacagagcaggaggtgtctggagagcacctggatggcaagacagagaagacccccaagcagaagggggagctggtgcactttgtgcagaccaacagcttcagcaagccccatgatgagctgaagctgagctgtgaggcccagctggtgaaggccggggaggtgcccaaggtgggcctgaaggatgcctctgtgcagacagtggccacagaaggagacctgctgcgcttcaagcatgaggccacccgggaggcctgggaggagaagcccatcaacacagccctgtctgctgagcacaggcctgagaacctgcatggagtgcccggctggcaggccgccctgctgagcctgcccggcatcaccaaccgggaggccaagaagagccggctgcccatcctgatcaagcccagccgcagcctgggcaacatgtaccgcctgcctgccacccaggaggtggtgacccagctgcagagccagatcctggagctgcagggcgagctgaaggagttcaagacctgcaacaagcagctgcaccagaagctgatcctggccgaggccgtgatggagggccggcccaccccagacaagaccctgctgaatgcccagccccctgtgggcgccgcctaccaggacagccctggagagcagaagggcatcaagaccaccagctctgtgtggagggacaaggagatggacagcgaccagcagaggagctatgaaattgattctgagatctgccccccagatgacctggccagcctgcccagctgcaaggaaaatccagaagatgtgctgagccccacctctgtggccacctacctgagcagcaagagccagcccagcgccaaggtgtctgtgatgggcacagaccagagcgagagcatcaacaccagcaatgaaacagagtacctgaagcagaagatccatgacctggagacagagctggagggctaccagaacttcatcttccagctgcagaagcacagccagtgcagcgaggccatcatcaccgtgctgtgtggcacagagggcgcccaggacggcctgagcaagcccaagaatggaagtgatggagaggagatgaccttcagcagcctgcaccaggtgcgctacgtgaagcacgtgaagatcctgggccccctggcccctgagatgattgacagccgggtgctggagaacctgaagcagcagctggaggagcaggagtacaagctgcagaaggagcagaacctgaacatgcagctgttcagcgagatccacaacctgcagaacaagttccgggacctgagccccccaagatatgacagcctggtgcagagccaggcccgggagctgagcctgcagaggcagcagatcaaggatggccacggcatctgtgtgatcagccggcagcacatgaacaccatgatcaaggcctttgaggagctgctgcaggccagtgatgtggactactgtgtggccgagggcttccaggagcagctgaaccagtgtgccgagctgctggagaagctggagaagctgttcctgaatggcaagtctgtgggcgtggagatgaacacccagaatgagctgatggagcgcatcgaggaggacaacctgacctaccagcacctgctgcctgagagccctgagcccagcgccagccacgccctgagtgactatgagaccagcgagaagagcttcttcagccgggaccagaagcaggacaatgaaacagagaagacctctgtgatggtgaacagcttcagccaggacctgctgatggagcacatccaggagatccgcaccctgaggaagaggctggaggagagcatcaagaccaatgagaagctgaggaagcagctggagcggcagggcagcgagtttgtgcagggcagcaccagcatctttgccagcggcagcgagctgcacagcagcctgaccagcgagatccacttcctgaggaagcagaaccaggccctgaatgccatgctgatcaagggcagccgggacaagcagaaggaaaatgacaagctgcgggagagcctgagcaggaagacagtgtccctggagcacctgcagcgggagtatgcctctgtgaaggaggagaatgaaaggctgcagaaggagggcagcgagaaggagcggcacaaccagcagctgatccaggaggtgcgctgcagcggccaggagctgagccgggtgcaggaggaggtgaagctgcggcagcagctgctgagccagaatgacaagctgctgcagagcctgcgggtggagctgaaggcctatgagaagctggatgaggagcaccggcggctgcgggaggccagcggggagggctggaagggccaggaccccttccgggacctgcacagcctgctgatggagatccaggccctgcggctgcagctggagaggagcattgagaccagcagcaccctgcagagccggctgaaggagcagctggcccggggagctgagaaggcccaggagggcgccctgaccctggccgtgcaggccgtgtccatccctgaggtgcccctgcagcctgacaagcatgatggagacaagtaccccatggagagtgacaacagctttgacctgtttgacagcagccaggccgtgacccccaagtctgtgtctgagaccccacccctgtctggaaatgacacagacagcctgagctgtgacagcggcagcagcgccaccagcaccccctgtgtgtcccggctggtgacaggccaccacctgtgggccagcaagaatggccgccacgtgctgggcctgattgaggactatgaggccctgctgaagcagatcagccagggccagaggctgctggccgagatggacatccagacccaggaggcccccagcagcaccagccaggagctgggcaccaagggcccccacccagcccccctgagcaagtttgtgtcctctgtgtccacagccaagctgaccctggaggaggcctacagaaggctgaagctgctgtggagggtgtccctgcctgaagatggccagtgccccctgcactgtgagcagatcggggagatgaaggccgaggtgaccaagctgcacaagaagctgtttgagcaggagaagaagctgcagaacaccatgaagctgctgcagctgagcaagaggcaggagaaggtgatctttgaccagctggtggtgacccacaagatcctgaggaaggcccggggcaacctggagctgcggcctgggggcgcccaccctggcacctgcagccccagcaggcctggcagctag

SEQ ID NO: 146942 - DNA, 1521 bp, Artificial Sequence
  Description of Artificial Sequence: Synthetic coding sequence
atggaggaccaccagcacgtgcccatcgacatccagaccagcaagctgctggactggctggtggacagaagacactgcagcctgaagtggcagagcctggtgctgaccatccgggagaagatcaatgctgccatccaggacatgcctgagagcgaggagatcgcccagctgctgagcggcagctacatccactacttccactgcctgcgcatcctggacctgctgaagggcacagaggccagcaccaagaacatcttcggccgctacagcagccagaggatgaaggactggcaggagatcatcgccctgtatgagaaggacaacacctacctggtggagctgagcagcctgctggtgagaaatgtgaactatgagatccccagcctgaagaagcagatcgccaagtgccagcagctgcagcaggagtacagcaggaaggaggaggagtgccaggccggggctgctgagatgagggagcagttctaccacagctgcaagcagtatggcatcactggagaaaatgtgcggggggagctgctggccctggtgaaggacctgcccagccagctggccgagattggagctgctgcccagcagagcctgggggaggccattgatgtgtaccaggcctctgtgggctttgtgtgtgagagccccacagagcaggtgctgcccatgctgcgctttgtgcagaagaggggcaacagcacagtgtatgagtggaggactggaacagagcccagcgtggtggagcggccccacctggaggagctgcctgagcaggtggccgaggatgccatcgactggggagactttggagtggaggccgtgtctgagggcacagattctggcatctctgctgaggccgccggcatcgactggggcatcttccctgagagtgacagcaaggaccctggaggagatggcatcgactggggagatgatgctgtggccctgcagatcaccgtgctggaggccggcacccaggcccctgagggcgtggcccggggcccagatgccctgaccctgctggagtacacagagaccaggaaccagttcctggatgagctgatggagctggagatcttcctggcccagagagctgtggagctgtctgaggaggctgatgtgctgtctgtgtcccagttccagctggccccagccatcctgcagggccagaccaaggagaagatggtgaccatggtgtctgtgctggaggacctgattggcaagctgaccagcctgcagctgcagcacctgttcatgatcctggccagccccaggtatgtggacagagtgacagagttcctgcagcagaagctgaagcagagccagctgctggccctgaagaaggagctgatggtgcagaagcagcaggaggccctggaggagcaggccgccctggagcccaagctggacctgctgctggagaagaccaaggagctgcagaagctgattgaggccgacatcagcaagcgctacagcggccggcctgtgaacctgatgggcaccagcctgtag

SEQ ID NO: 146943 - DNA, 1596 bp, Artificial Sequence
  Description of Artificial Sequence: Synthetic coding sequence
atgaggcggcagagcatgaccagcgccacccgggacctgcacacagccctggatggcaaggccacccagggcggcaagaaggaccaccagcacgtgcccatcgacatccagaccagcaagctgctggactggctggtggaccggcggcactgcagcctgaagtggcagagcctggtgctgaccatccgggagaagatcaatgctgccatccaggacatgcctgagagcgaggagatcgcccagctgctgagcggcagctacatccactacttccactgcctgcgcatcctggacctgctgaagggcacagaggccagcaccaagaacatcttcggccgctacagcagccagaggatgaaggactggcaggagatcatcgccctgtatgagaaggacaacacctacctggtggagctgagcagcctgctggtgagaaatgtgaactatgagatccccagcctgaagaagcagatcgccaagtgccagcagctgcagcaggagtacagcaggaaggaggaggagtgccaggccggggctgctgagatgagggagcagttctaccacagctgcaagcagtatggcatcaccggggagaatgtgcggggggagctgctggccctggtgaaggacctgcccagccagctggccgagatcggggctgctgcccagcagagcctgggggaggccattgatgtgtaccaggcctctgtgggctttgtgtgtgagagccccacagagcaggtgctgcccatgctgcgctttgtgcagaagaggggcaacagcacagtgtatgagtggaggactggaacagagcccagcgtggtggagcggccccacctggaggagctgcctgagcaggtggctgaagatgccatcgactggggagactttggagtggaggccgtgtctgagggcacagacagcggcatctctgctgaggccgccggcatcgactggggcatcttccctgagagtgacagcaaggaccctggaggagatggcatcgactggggagatgatgctgtggccctgcagatcaccgtgctggaggccggcacccaggcccctgagggcgtggcccggggcccagatgccctgaccctgctggagtacacagagaccaggaaccagttcctggatgagctgatggagctggagatcttcctggcccagagagctgtggagctgtctgaggaggctgatgtgctgtctgtgtcccagttccagctggccccagccatcctgcagggccagaccaaggagaagatggtgaccatggtgtctgtgctggaggacctgattggcaagctgaccagcctgcagctgcagcacctgttcatgatcctggccagcccccgctacgtggacagagtgacagagttcctgcagcagaagctgaagcagagccagctgctggccctgaagaaggagctgatggtgcagaagcagcaggaggccctggaggagcaggccgccctggagcccaagctggacctgctgctggagaagaccaaggagctgcagaagctgattgaagctgacatcagcaagcgctacagcggccggcctgtgaacctgatgggcaccagcctgtag

SEQ ID NO: 146944 - DNA, 3864 bp, Artificial Sequence
  Description of Artificial Sequence: Synthetic coding sequence
atgcacccagacctgggccccctgtgcaccctgctgtatgtgaccctgaccatcctgtgcagctctgtgtccagtgacctggccccctacttcaccagcgagcccctgtctgctgtgcagaagctgggcggccctgtggtgctgcactgcagcgcccagcctgtgaccacccgcatctcctggctgcacaacgggaagaccctggatggcaacctggagcacgtgaagatccaccagggcaccctgaccatcctgagcctgaacagcagcctgctgggctactaccagtgcctggccaacaacagcattggagccatcgtgtctggccctgccaccgtgtctgtggccgtgctgggggactttggcagcagcaccaagcacgtgatcacagctgaggagaagtctgctggcttcatcggctgccgggtgcctgagagcaaccccaaggccgaggtgcgctacaagatccggggcaagtggctggagcacagcacagagaactacctgatcctgcccagcggcaacctgcagatcctgaatgtgtccctggaggacaagggcagctacaagtgtgccgcctacaaccctgtgacccaccagctgaaggtggagcccatcggcaggaagctgctggtgtcccggcccagcagtgatgatgtgcacatcctgcaccccacccacagccaggccctggccgtgctgagccgcagccctgtgaccctggagtgtgtggtgtctggagtgcctgccccccaggtgtactggctgaaggatggccaggacatcgcccctggcagcaactggaggcggctgtacagccacctggccacagattctgtggaccctgctgacagcggcaactacagctgcatggccggcaacaagtctggagatgtgaagtatgtgacctacatggtgaatgtgctggagcacgccagcatcagcaagggcctgcaggaccagatcgtgtccctgggcgccaccgtgcacttcacctgtgatgtgcacggcaacccagcccccaactgcacctggttccacaatgcccagcccatccaccccagcgcccggcacctgacagctggaaatggcctgaagatcagcggcgtgacagtggaggatgtgggcatgtaccagtgtgtggccgacaatggcatcggcttcatgcacagcacaggccgcctggagattgaaaatgatggcggcttcaagcctgtgatcatcacagcccctgtgtctgccaaggtggctgatggagactttgtgaccctgagctgcaatgccagcggcctgcctgtgcctgtgatccgctggtatgacagccacggcctcatcaccagccaccccagccaggtgctgcggagcaagagcaggaagagccagctgagcaggcctgagggcctgaacctggagcctgtgtactttgtgctgagccaggccggggccagcagcctgcacatccaggccgtgacccaggagcacgccggcaagtacatctgtgaggccgccaatgagcacggcaccacccaggccgaggccagcctgatggtggtgccctttgagaccaacaccaaggccgagaccgtgaccctgcctgatgctgcccagaatgatgacaggagcaagagagatggcagcgagaccggcctgctgagcagcttccctgtgaaggtgcaccccagcgctgtggagagcgcccctgagaagaatgccagcggcatctctgtgcctgatgcccccatcatcctgagccccccccagacccacaccccagacacctacaacctggtgtggagggctgggaaggatggcggcctgcccatcaatgcctactttgtgaagtacaggaagctggatgatggagtgggcatgctgggctcctggcacacagtgcgggtgcccggctctgaaaatgagctgcacctggccgagctggagcccagcagcctgtatgaggtgctgatggtggcccggtctgctgctggggagggccagcctgccatgctgaccttccgcaccagcaaggagaagacagccagcagcaagaacacccaggccagcagcccccctgtgggcatccccaagtaccctgtggtgtctgaggccgccaacaacaactttggagtggtgctgacagacagcagccgccacagcggcgtgcctgaggccccagaccggcccaccatcagcacagccagcgagacctctgtgtatgtgacctggatcccccgggccaacggcggcagccccatcacagccttcaaggtggagtacaagaggatgaggaccagcaactggctggtggccgctgaggacatcccccccagcaagctgtctgtggaggtgcgcagcctggagcccggcagcacctacaagttccgggtcatcgccatcaaccactatggagagagcttccgcagcagcgccagccggccctaccaggtggtgggcttccccaaccgcttcagcagccggcccatcaccggcccccacatcgcctacacagaagctgtgtctgacacccagatcatgctgaagtggacctacatccccagcagcaacaacaacacccccatccagggcttctacatctactaccggcccacagacagcgacaatgacagcgactacaagagagatgtggtggagggcagcaagcagtggcacatgattggccacctgcagcctgagaccagctatgacatcaagatgcagtgcttcaatgaaggaggagagagcgagttcagcaatgtgatgatctgtgagaccaaggtgaagagggtgcctggggccagcgagtaccctgtgaaggacctgagcaccccacccaacagcctgggcagcggcggcaatgtgggccctgccaccagccctgcccggagcagtgacatgctgtacctgattgtgggctgtgtgctgggcgtgatggtgctgatcctgatggtgttcatcgccatgtgcctgtggaagaaccggcagcagaacaccatccagaagtatgaccccccaggctacctgtaccagggcagtgacatgaatggccagatggtggactacaccaccctgagcggggccagccagatcaatggaaatgtgcatggaggcttcctgaccaatggaggcctgagcagcggctacagccacctgcaccacaaggtgcccaatgctgtgaatggcatcgtgaatggcagcctgaatggaggcctgtacagcggccacagcaacagcctgaccaggacccacgtggactttgagcacccccaccacctggtgaatggaggcggcatgtacacagctgtgccccagattgaccccctggagtgtgtgaactgcaggaactgcaggaacaacaaccgctgcttcaccaagaccaacagcaccttcagcagcagccccccacctgtggtgcctgtggtggccccctacccccaggacggcctggagatgaagcccctgagccacgtgaaggtgcctgtgtgcctgaccagcgctgtgcctgactgtggccagctgcctgaggagagcgtgaaggacaacgtggagcctgtgcccacccagaggacctgctgccaggacatcgtgaatgatgtgtccagtgatggctctgaagatcctgctgagttcagccggggccaggagggcatgatcaacctgcgcatcccagaccacctgcagctggccaagagctgtgtgtgggagggggacagctgtgcccacagcgagacagagatcaacatcgtgtcctggaatgccctgatcctgccccctgtgcctgagggctgtgccgagaagaccatgtggagccccccaggcatccccctggacagccccacagaggtgctgcagcagccccgggagacctag

SEQ ID NO: 146945 - DNA, 3795 bp, Artificial Sequence
  Description of Artificial Sequence: Synthetic coding sequence
atgcacccagacctgggccccctgtgcaccctgctgtatgtgaccctgaccatcctgtgcagctctgtgtccagtgacctggccccctacttcaccagcgagcccctgtctgctgtgcagaagctgggcggccctgtggtgctgcactgcagcgcccagcctgtgaccacccgcatctcctggctgcacaacgggaagaccctggatggcaacctggagcacgtgaagatccaccagggcaccctgaccatcctgagcctgaacagcagcctgctgggctactaccagtgcctggccaacaacagcattggagccatcgtgtctggccctgccaccgtgtctgtggccgtgctgggggactttggcagcagcaccaagcacgtgatcacagctgaggagaagtctgctggcttcatcggctgccgggtgcctgagagcaaccccaaggccgaggtgcgctacaagatccggggcaagtggctggagcacagcacagagaactacctgatcctgcccagcggcaacctgcagatcctgaatgtgtccctggaggacaagggcagctacaagtgtgccgcctacaaccctgtgacccaccagctgaaggtggagcccatcggcaggaagctgctggtgtcccggcccagcagtgatgatgtgcacatcctgcaccccacccacagccaggccctggccgtgctgagccgcagccctgtgaccctggagtgtgtggtgtctggagtgcctgccccccaggtgtactggctgaaggatggccaggacatcgcccctggcagcaactggaggcggctgtacagccacctggccacagattctgtggaccctgctgacagcggcaactacagctgcatggccggcaacaagtctggagatgtgaagtatgtgacctacatggtgaatgtgctggagcacgccagcatcagcaagggcctgcaggaccagatcgtgtccctgggcgccaccgtgcacttcacctgtgatgtgcacggcaacccagcccccaactgcacctggttccacaatgcccagcccatccaccccagcgcccggcacctgacagctggaaatggcctgaagatcagcggcgtgacagtggaggatgtgggcatgtaccagtgtgtggccgacaatggcatcggcttcatgcacagcacaggccgcctggagattgaaaatgatggcggcttcaagcctgtgatcatcacagcccctgtgtctgccaaggtggctgatggagactttgtgaccctgagctgcaatgccagcggcctgcctgtgcctgtgatccgctggtatgacagccacggcctcatcaccagccaccccagccaggtgctgcggagcaagagcaggaagagccagctgagcaggcctgagggcctgaacctggagcctgtgtactttgtgctgagccaggccggggccagcagcctgcacatccaggccgtgacccaggagcacgccggcaagtacatctgtgaggccgccaatgagcacggcaccacccaggccgaggccagcctgatggtggtgccctttgagaccaacaccaaggccgagaccgtgaccctgcctgatgctgcccagaatgatgacaggagcaagagagatggcagcgagaccggcctgctgagcagcttccctgtgaaggtgcaccccagcgctgtggagagcgcccctgagaagaatgccagcggcatctctgtgcctgatgcccccatcatcctgagccccccccagacccacaccccagacacctacaacctggtgtggagggctgggaaggatggcggcctgcccatcaatgcctactttgtgaagtacaggaagctggatgatggagtgggcatgctgggctcctggcacacagtgcgggtgcccggctctgaaaatgagctgcacctggccgagctggagcccagcagcctgtatgaggtgctgatggtggcccggtctgctgctggggagggccagcctgccatgctgaccttccgcaccagcaaggagaagacagccagcagcaagaacacccaggccagcagcccccctgtgggcatccccaagtaccctgtggtgtctgaggccgccaacaacaactttggagtggtgctgacagacagcagccgccacagcggcgtgcctgaggccccagaccggcccaccatcagcacagccagcgagacctctgtgtatgtgacctggatcccccgggccaacggcggcagccccatcacagccttcaaggtggagtacaagaggatgaggaccagcaactggctggtggccgctgaggacatcccccccagcaagctgtctgtggaggtgcgcagcctggagcccggcagcacctacaagttccgggtcatcgccatcaaccactatggagagagcttccgcagcagcgccagccggccctaccaggtggtgggcttccccaaccgcttcagcagccggcccatcaccggcccccacatcgcctacacagaagctgtgtctgacacccagatcatgctgaagtggacctacatccccagcagcaacaacaacacccccatccagggcttctacatctactaccggcccacagacagcgacaatgacagcgactacaagagagatgtggtggagggcagcaagcagtggcacatgattggccacctgcagcctgagaccagctatgacatcaagatgcagtgcttcaatgaaggaggagagagcgagttcagcaatgtgatgatctgtgagaccaaggtgaagagggtgcctggggccagcgagtaccctgtgaaggacctgagcaccccacccaacagcctgggcagcggcggcaatgtgggccctgccaccagccctgcccggagcagtgacatgctgtacctgattgtgggctgtgtgctgggcgtgatggtgctgatcctgatggtgttcatcgccatgtgcctgtggaagaaccggcagcagaacaccatccagaagtatgaccccccaggctacctgtaccagggcagtgacatgaatggccagatggtggactacaccaccctgagcggggccagccagatcaatggaaatgtgcatggaggcttcctgaccaatggaggcctgagcagcggctacagccacctgcaccacaaggtgcccaatgctgtgaatggcatcgtgaatggcagcctgaatggaggcctgtacagcggccacagcaacagcctgaccaggacccacgtggactttgagcacccccaccacctggtgaatggaggcggcatgtacacagctgtgccccagattgaccccctggagtgtgtgaactgcaggaactgcaggaacaacaaccgctgcttcaccaagaccaacagcaccttcagcagcagccccccacctgtggtgcctgtggtggccccctacccccaggacggcctggagatgaagcccctgagccacgtgaaggtgcctgtgtgcctgaccagcgctgtgcctgactgtggccagctgcctgaggagagcgtgaaggacaacgtggagcctgtgcccacccagaggacctgctgccaggacatcgtgaatgatgtgtccagtgatggctctgaagatcctgctgagttcagcagaggagacagctgtgcccacagcgagacagagatcaacatcgtgtcctggaatgccctgatcctgccccctgtgcctgagggctgtgccgagaagaccatgtggagccccccaggcatccccctggacagccccacagaggtgctgcagcagccccgggagacctag

SEQ ID NO: 146946 - DNA, 1386 bp, Artificial Sequence
  Description of Artificial Sequence: Synthetic coding sequence
atgctggagctgcggcaccggggcagctgccccggcccccgggaggccgtgtccccaccccaccgggagggggaggccgccggcggggaccatgaaacagagagcaccagtgacaaggagacagacattgatgacagatatggagacctggacagcaggacagacagcgacatccctgagatcccccccagcagtgacaggaccccagagatcctgaagaaggccctgagcggcctgagcagccgctggaagaactggtggatccggggcatcctgaccctgaccatgatcagcctcttcttcctgatcatctacatgggcagcttcatgctgatgctgctggtgctgggcatccaggtgaagtgcttccacgagatcatcaccatcggctacagagtgtaccacagctatgacctgccctggttccgcaccctgtcctggtacttcctgctgtgtgtgaactacttcttctacggggagaccgtggccgactactttgccacctttgtgcagcgggaggagcagctgcagttcctgatccgctaccaccgcttcatcagctttgccctgtacctggccggcttctgcatgtttgtgctgagcctggtgaagaagcactaccgcctgcagttctacatgtttgcctggacccacgtgaccctgctgatcaccgtgacccagagccacctggtgatccagaacctgtttgagggcatgatctggttcctggtgcccatcagcagcgtcatctgcaatgacatcacagcctacctgtttggcttcttctttggaagaacacccctcatcaagctgagccccaagaagacctgggagggcttcatcggcggcttcttcagcacagtggtgtttggcttcatcgccgcctacgtgctgagcaagtaccagtactttgtgtgccctgtggagtacagaagtgatgtgaacagctttgtgacagaatgtgagcccagcgagctgttccagctgcagacctacagcctgccccccttcctgaaggctgtgctgcggcaggagcgggtgtccctgtaccccttccagatccacagcatcgccctgagcacctttgccagcctcatcggcccctttggaggcttctttgccagcggcttcaagagggccttcaagatcaaggactttgccaacaccatccctggccatggaggcatcatggacagatttgactgccagtacctgatggccacctttgtgcacgtgtacatcaccagcttcatccggggccccaaccccagcaaggtgctgcagcagctgctggtgctgcagcctgagcagcagctgaacatctacaagaccctgaagacccacctgattgagaagggcatcctgcagcccaccctgaaggtgtag

SEQ ID NO: 146947 - DNA, 978 bp, Artificial Sequence
  Description of Artificial Sequence: Synthetic coding sequence
atgagccggctgcggcaccccaggacccgctacttcctgctgtgtgtgaactacttcttctatggagagaccgtgacagactacttcttcaccctggtgcagcgggaggagcccctgcgcatcctgagcaagtaccaccgcttcatctccttcaccctgtacctgattggcttctgcatgtttgtgctgagcctggtgaagaagcactaccgcctgcagttctacatgtttggctggacccacgtgaccctgctgattgtggtgacccagagccacctggtgatccacaacctgtttgagggcatgatctggttcatcgtgcccatcagctgtgtgatctgcaatgacatcatggcctacatgtttggcttcttcttcggccgcacccccctcatcaagctgagccccaagaagacctgggagggcttcatcggcggcttctttgccaccgtggtgtttggcctgctgctgtcctatgtgatgagcggctaccgctgctttgtgtgccctgtggagtacaacaatgacaccaacagcttcaccgtggactgtgagcccagcgacctcttccggctgcaggagtacaacatccctggggtcatccagagcgtgattggctggaagacagtgaggatgtaccccttccagatccacagcatcgccctgagcacctttgccagcctgattggcccctttggaggcttctttgccagcggcttcaagagggccttcaagatcaaggactttgccaacaccatccctggccacggcggcatcatggacagatttgactgccagtacctgatggccacctttgtgaatgtgtacatcgccagcttcatccggggccccaaccccagcaagctgatccagcagttcctgaccctgcggccagaccagcagctgcacatcttcaacaccctgcggagccacctgattgacaagggcatgctgaccagcaccacagaagatgaatag

SEQ ID NO: 146948 - DNA, 753 bp, Artificial Sequence
  Description of Artificial Sequence: Synthetic coding sequence
atgagccggctgcggcaccccaggacccgctggaagaactggtgggtgcggggcatcctgaccctggccatgattgccttcttcttcatcatcatctacctgggccccatggtgctgatgatcatcgtgatgtgtgtgcagatcaagtgcttccacgagatcatcaccatcggctacaacgtgtaccacagctatgacctgccctggttccgcaccctgtcctggtacttcctgctgtgtgtgaactacttcttctacggggagaccgtgacagactacttcttcaccctggtgcagcgggaggagcccctgcgcatcctgagcaagtaccaccgcttcatctccttcaccctgtacctgattggcttctgcatgtttgtgctgagcctggtgaagaagcactaccgcctgcagttctacatgtttggctggacccacgtgaccctgctgattgtggtgacccagagccacctggtgatccacaacctgtttgagggcatgatctggttcatcgtgcccatcagctgtgtgatctgcaatgacatcatggcctacatgtttggcttcttctttggaagaacacccctcatcaagctgagccccaagaagacctgggagggcttcatcggcggcttctttgccaccgtggtgtttggcctgctgctgtcctatgtgatgagcggctaccgctgctttgtgtgccctgtggagtacaacaatgacaccaacagcttcaccgtggactgtgagtag

SEQ ID NO: 146949 - DNA, 1338 bp, Artificial Sequence
  Description of Artificial Sequence: Synthetic coding sequence
atgacagagctgcggcagagggtggcccacgagcctgtggcccccccagaggacaaggagagcgagagcgaggccaaggtggatggagaaacagccagtgacagcgagagcagagctgagagcgcccccctgcctgtgtctgcagatgacaccccagaggtgctgaacagagccctgagcaacctgagcagccgctggaagaactggtgggtgcggggcatcctgaccctggccatgattgccttcttcttcatcatcatctacctgggccccatggtgctgatgatcatcgtgatgtgtgtgcagatcaagtgcttccacgagatcatcaccatcggctacaacgtgtaccacagctatgacctgccctggttccgcaccctgtcctggtacttcctgctgtgtgtgaactacttcttctatggagagaccgtgacagactacttcttcaccctggtgcagcgggaggagcccctgcgcatcctgagcaagtaccaccgcttcatctccttcaccctgtacctgattggcttctgcatgtttgtgctgagcctggtgaagaagcactaccgcctgcagttctacatgtttggctggacccacgtgaccctgctgattgtggtgacccagagccacctggtgatccacaacctgtttgagggcatgatctggttcatcgtgcccatcagctgtgtgatctgcaatgacatcatggcctacatgtttggcttcttcttcggccgcacccccctcatcaagctgagccccaagaagacctgggagggcttcatcggcggcttctttgccaccgtggtgtttggcctgctgctgtcctatgtgatgagcggctaccgctgctttgtgtgccctgtggagtacaacaatgacaccaacagcttcaccgtggactgtgagcccagcgacctcttccggctgcaggagtacaacatccctggggtcatccagagcgtgattggctggaagacagtgaggatgtaccccttccagatccacagcatcgccctgagcacctttgccagcctgattggcccctttggaggcttctttgccagcggcttcaagagggccttcaagatcaaggactttgccaacaccatccctggccacggcggcatcatggacagatttgactgccagtacctgatggccacctttgtgaatgtgtacatcgccagcttcatccggggccccaaccccagcaagctgatccagcagttcctgaccctgcggccagaccagcagctgcacatcttcaacaccctgcggagccacctgattgacaagggcatgctgaccagcaccacagaagatgaatag

SEQ ID NO: 146950 - DNA, 648 bp, Artificial Sequence
  Description of Artificial Sequence: Synthetic coding sequence
atgtttgtgctgagcctggtgaagaagcactaccgcctgcagttctacatgtttggctggacccacgtgaccctgctgattgtggtgacccagagccacctggtgatccacaacctgtttgagggcatgatctggttcatcgtgcccatcagctgtgtgatctgcaatgacatcatggcctacatgtttggcttcttctttggaagaacacccctcatcaagctgagccccaagaagacctgggagggcttcatcggcggcttctttgccaccgtggtgtttggcctgctgaagacagtgaggatgtaccccttccagatccacagcatcgccctgagcacctttgccagcctgattggcccctttggaggcttctttgccagcggcttcaagagggccttcaagatcaaggactttgccaacaccatccctggccacggcggcatcatggacagatttgactgccagtacctgatggccacctttgtgaatgtgtacatcgccagcttcatccggggccccaaccccagcaagctgatccagcagttcctgaccctgcggccagaccagcagctgcacatcttcaacaccctgcggagccacctgattgacaagggcatgctgaccagcaccacagaagatgaatag

SEQ ID NO: 146951 - DNA, 3675 bp, Artificial Sequence
  Description of Artificial Sequence: Synthetic coding sequence
atggagcccctgctgctgggccggggcctgattgtgtacctgatgttcctgctgctgaagttcagcaaggccatcgagatccccagctctgtgcagcaggtgcccaccatcatcaagcagagcaaggtgcaggtggccttcccctttgatgagtacttccagattgaatgtgaggccaagggcaaccctgagcccaccttctcctggaccaaggatggcaaccccttctacttcacagaccaccgcatcatccccagcaacaacagcggcaccttccgcatccccaatgaaggccacatcagccacttccagggcaagtaccgctgctttgccagcaacaagctgggcatcgccatgtctgaggagattgagttcatcgtgcccagcgtgcccaagttccccaaggagaagattgaccccctggaggtggaggagggggaccccatcgtgctgccctgcaacccccccaagggcctgccccccctgcacatctactggatgaacatcgagctggagcacatcgagcaggatgagcgggtgtacatgagccagaagggggacctgtactttgccaacgtggaggagaaggacagcagaaatgactactgctgctttgctgccttcccccggctgcggaccatcgtgcagaagatgcccatgaagctgactgtgaacagcctgaagcacgccaatgacagcagcagcagcacagaaattggcagcaaggccaacagcatcaagcagaggaagcccaagctgctgctgcccccaacagagagcggcagcgagagcagcatcaccatcctgaagggggagatcctgctgctggagtgctttgctgagggcctgcccaccccccaggtggactggaacaagattggaggagacctgcccaagggccgggagaccaaggaaaattatggcaagaccctgaagattgaaaatgtgtcctaccaggacaagggcaactaccgctgcacagccagcaacttcctgggcacagccacccatgacttccacgtgattgtggaggagcccccacgctggaccaagaagccccagagcgctgtgtacagcacaggcagcaatggcatcctgctgtgtgaggccgagggggagccccagcccaccatcaagtggagggtgaatggcagccctgtggacaaccacccctttgctggagatgtggtgttcccccgggagatctccttcaccaacctgcagcccaaccacacagctgtgtaccagtgtgaggccagcaatgtgcacggcaccatcctggccaatgccaacattgatgtggtggatgtgcggcccctcatccagaccaaggatggagaaaattatgccaccgtggtgggctacagcgccttcctgcactgtgagttctttgccagccctgaggccgtggtgtcctggcagaaggtggaggaggtgaagcccctggagggccgccgctaccacatctatgaaaatggcaccctgcagatcaacagaaccacagaagaagatgctggcagctacagctgctgggtggagaatgccatcggcaagacagctgtgacagccaacctggacatcagaaatgccaccaagctgcgggtgagccccaagaacccccgcatccccaagctgcacatgctggagctgcactgtgagagcaaatgtgacagccacctgaagcacagcctgaagctgtcctggagcaaggatggagaggcctttgagatcaatggaacagaagatggccgcatcatcattgatggagccaacctgaccatcagcaatgtgaccctggaggaccagggcatctactgctgcagcgcccacacagccctggacagcgctgctgacatcacccaggtgacagtgctggatgtgcctgaccccccagagaacctgcacctgtctgagcggcagaacagatctgtgcggctgacctgggaggccggggctgaccacaacagcaacatcagcgagtacatcgtggagtttgagggcaacaaggaggagcccggccgctgggaggagctgaccagggtgcagggcaagaagaccaccgtcatcctgcccctggccccctttgtgcgctaccagttccgggtgattgctgtgaatgaggtgggccgcagccagcccagccagcccagcgaccaccacgagaccccacctgctgccccagacaggaacccccagaacatccgggtgcaggccagccagcccaaggagatgatcatcaagtgggagcccctgaagtccatggagcagaatggacctggcctggagtacagagtgacctggaagccccagggcgcccctgtggagtgggaggaggagaccgtgaccaaccacaccctgcgggtgatgaccccagctgtgtatgccccctatgatgtgaaggtgcaggccatcaaccagctgggcagcggccctgacccccagagcgtgaccctgtacagcggggaggactacccagacacagcccctgtgatccacggcgtggatgtgatcaacagcaccctggtgaaggtgacctggagcacagtgcccaaggacagagtgcacggccgcctgaagggctaccagatcaactggtggaagaccaagagcctgctggatggccgcacccaccccaaggaggtgaacatcctgcgcttcagcggccagaggaacagcggcatggtgcccagcctggatgccttcagcgagttccacctgactgtgctggcctacaacagcaagggggccggccctgagagcgagccctacatcttccagaccccagagggcgtgcctgagcagcccaccttcctgaaggtgatcaaggtggacaaggacacagccaccctgtcctggggcctgcccaagaagctgaatggaaacctgaccggctacctgctgcagtaccagatcatcaatgacacctatgagatcggggagctgaatgacatcaacatcaccacccccagcaagcccagctggcacctgagcaacctgaatgccaccaccaagtacaagttctacctgcgggcctgcaccagccagggctgcggcaagcccatcacagaggagagcagcaccctgggggagggcagcaaaggaattggcaagatctctggagtgaacctgacccagaagacccaccccatcgaggtgtttgagcctggagctgagcacatcgtgcggctgatgaccaagaactggggagacaatgacagcatcttccaggatgtgattgagacccggggccgggagtatgccggcctgtatgatgacatcagcacccagggctggttcatcggcctgatgtgtgccatcgccctgctgaccctgctgctgctgactgtgtgctttgtgaagaggaacagaggaggcaagtacagcgtgaaggagaaggaggacctgcacccagaccctgagatccagagcgtgaaggatgagacctttggagagtacagcgacagtgatgagaagcccctgaagggcagcctgcggagcctgaacagagacatgcagcccacagagagcgctgacagcctggtggagtatggagagggggaccacggcctcttctctgaagatggcagcttcatcggggcctatgccggcagcaaggagaagggctctgtggagagcaatggcagcagcacagccaccttccccctgcgggcctag

SEQ ID NO: 146952 - DNA, 3627 bp, Artificial Sequence
  Description of Artificial Sequence: Synthetic coding sequence
atggagcccctgctgctgggccggggcctgattgtgtacctgatgttcctgctgctgaagttcagcaaggccatcgagatccccagctctgtgcagcaggtgcccaccatcatcaagcagagcaaggtgcaggtggccttcccctttgatgagtacttccagattgaatgtgaggccaagggcaaccctgagcccaccttctcctggaccaaggatggcaaccccttctacttcacagaccaccgcatcatccccagcaacaacagcggcaccttccgcatccccaatgaaggccacatcagccacttccagggcaagtaccgctgctttgccagcaacaagctgggcatcgccatgtctgaggagattgagttcatcgtgcccagcgtgcccaagttccccaaggagaagattgaccccctggaggtggaggagggggaccccatcgtgctgccctgcaacccccccaagggcctgccccccctgcacatctactggatgaacatcgagctggagcacatcgagcaggatgagcgggtgtacatgagccagaagggggacctgtactttgccaacgtggaggagaaggacagcagaaatgactactgctgctttgctgccttcccccggctgcggaccatcgtgcagaagatgcccatgaagctgactgtgaacagcagcaacagcatcaagcagaggaagcccaagctgctgctgcccccaacagagagcggcagcgagagcagcatcaccatcctgaagggggagatcctgctgctggagtgctttgctgagggcctgcccaccccccaggtggactggaacaagattggaggagacctgcccaagggccgggagaccaaggaaaattatggcaagaccctgaagattgaaaatgtgtcctaccaggacaagggcaactaccgctgcacagccagcaacttcctgggcacagccacccatgacttccacgtgattgtggaggagcccccacgctggaccaagaagccccagagcgctgtgtacagcacaggcagcaatggcatcctgctgtgtgaggccgagggggagccccagcccaccatcaagtggagggtgaatggcagccctgtggacaaccacccctttgctggagatgtggtgttcccccgggagatctccttcaccaacctgcagcccaaccacacagctgtgtaccagtgtgaggccagcaatgtgcacggcaccatcctggccaatgccaacattgatgtggtggatgtgcggcccctcatccagaccaaggatggagaaaattatgccaccgtggtgggctacagcgccttcctgcactgtgagttctttgccagccctgaggccgtggtgtcctggcagaaggtggaggaggtgaagcccctggagggccgccgctaccacatctatgaaaatggcaccctgcagatcaacagaaccacagaagaagatgctggcagctacagctgctgggtggagaatgccatcggcaagacagctgtgacagccaacctggacatcagaaatgccaccaagctgcgggtgagccccaagaacccccgcatccccaagctgcacatgctggagctgcactgtgagagcaaatgtgacagccacctgaagcacagcctgaagctgtcctggagcaaggatggagaggcctttgagatcaatggaacagaagatggccgcatcatcattgatggagccaacctgaccatcagcaatgtgaccctggaggaccagggcatctactgctgcagcgcccacacagccctggacagcgctgctgacatcacccaggtgacagtgctggatgtgcctgaccccccagagaacctgcacctgtctgagcggcagaacagatctgtgcggctgacctgggaggccggggctgaccacaacagcaacatcagcgagtacatcgtggagtttgagggcaacaaggaggagcccggccgctgggaggagctgaccagggtgcagggcaagaagaccaccgtcatcctgcccctggccccctttgtgcgctaccagttccgggtgattgctgtgaatgaggtgggccgcagccagcccagccagcccagcgaccaccacgagaccccacctgctgccccagacaggaacccccagaacatccgggtgcaggccagccagcccaaggagatgatcatcaagtgggagcccctgaagtccatggagcagaatggacctggcctggagtacagagtgacctggaagccccagggcgcccctgtggagtgggaggaggagaccgtgaccaaccacaccctgcgggtgatgaccccagctgtgtatgccccctatgatgtgaaggtgcaggccatcaaccagctgggcagcggccctgacccccagagcgtgaccctgtacagcggggaggactacccagacacagcccctgtgatccacggcgtggatgtgatcaacagcaccctggtgaaggtgacctggagcacagtgcccaaggacagagtgcacggccgcctgaagggctaccagatcaactggtggaagaccaagagcctgctggatggccgcacccaccccaaggaggtgaacatcctgcgcttcagcggccagaggaacagcggcatggtgcccagcctggatgccttcagcgagttccacctgactgtgctggcctacaacagcaagggggccggccctgagagcgagccctacatcttccagaccccagagggcgtgcctgagcagcccaccttcctgaaggtgatcaaggtggacaaggacacagccaccctgtcctggggcctgcccaagaagctgaatggaaacctgaccggctacctgctgcagtaccagatcatcaatgacacctatgagatcggggagctgaatgacatcaacatcaccacccccagcaagcccagctggcacctgagcaacctgaatgccaccaccaagtacaagttctacctgcgggcctgcaccagccagggctgcggcaagcccatcacagaggagagcagcaccctgggggagggcagcaaaggaattggcaagatctctggagtgaacctgacccagaagacccaccccatcgaggtgtttgagcctggagctgagcacatcgtgcggctgatgaccaagaactggggagacaatgacagcatcttccaggatgtgattgagacccggggccgggagtatgccggcctgtatgatgacatcagcacccagggctggttcatcggcctgatgtgtgccatcgccctgctgaccctgctgctgctgactgtgtgctttgtgaagaggaacagaggaggcaagtacagcgtgaaggagaaggaggacctgcacccagaccctgagatccagagcgtgaaggatgagacctttggagagtacagcgacagtgatgagaagcccctgaagggcagcctgcggagcctgaacagagacatgcagcccacagagagcgctgacagcctggtggagtatggagagggggaccacggcctcttctctgaagatggcagcttcatcggggcctatgccggcagcaaggagaagggctctgtggagagcaatggcagcagcacagccaccttccccctgcgggcctag

SEQ ID NO: 146953 - DNA, 291 bp, Artificial Sequence
  Description of Artificial Sequence: Synthetic coding sequence
atggagcccctgctgctgggccggggcctgattgtgtacctgatgttcctgctgctgaagttcagcaaggccatcgagatccccagctctgtgcagcaggtgcccaccatcatcaagcagagcaaggtgcaggtggccttcccctttgatgagtacttccagattgaatgtgaggccaagggcaaccctgagcccaccttctcctggaccaaggatggcaaccccttctacttcacagaccaccgcatcatccccagcaacaacagcggcaccttccgcatccccaactag

SEQ ID NO: 146954 - DNA, 201 bp, Artificial Sequence
  Description of Artificial Sequence: Synthetic coding sequence
atggagcccctgctgctgggccggggcctgattgtgtacctgatgttcctgctgctgaagttcagcaaggccatcgagatccccagctctgtgcagcaggtgcccaccatcatcaagcagagcaaggtgcaggtggccttcccctttgatgagtacttccagattgaatgtgaggccaagggcaaccctgagcccacctag

SEQ ID NO: 146955 - DNA, 546 bp, Artificial Sequence
  Description of Artificial Sequence: Synthetic coding sequence
atggagcccctgctgctgggccggggcctgattgtgtacctgatgttcctgctgctgaagttcagcaaggccatcgagatccccagctctgtgcagcaggtgcccaccatcatcaagcagagcaaggtgcaggtggccttcccctttgatgagtacttccagattgaatgtgaggccaagggcaaccctgagcccaccttctcctggaccaaggatggcaaccccttctacttcacagaccaccgcatcatccccagcaacaacagcggcaccttccgcatccccaatgaaggccacatcagccacttccagggcaagtaccgctgctttgccagcaacaagctgggcatcgccatgtctgaggagattgagttcatcgtgcccagcgtgcccaagttccccaaggagaagattgaccccctggaggtggaggagggggaccccatcgtgctgccctgcaacccccccaagggcctgccccccctgcacatctactggatgaacatcgagctggagcacatcgagcaggatgagcgggtgtactag

SEQ ID NO: 146956 - DNA, 954 bp, Artificial Sequence
  Description of Artificial Sequence: Synthetic coding sequence
tgaagcgtgaccctgtacagcggggaggactacccagacacagcccctgtgattcatggagtggatgtgatcaacagcaccctggtgaaggtgacctggagcacagtgcccaaggacagagtgcacggccgcctgaagggctaccagatcaactggtggaagaccaagagcctgctggatggccgcacccaccccaaggaggtgaacatcctgcgcttcagcggccagagaaattctggcatggtgcccagcctggatgccttcagcgagttccacctgactgtgctggcctacaacagcaaaggagctggccctgagagcgagccctacatcttccagaccccagagggcgtgcctgagcagcccaccttcctgaaggtgatcaaggtggacaaggacacagccaccctgtcctggggcctgcccaagaagctgaatggaaacctgaccggctacctgctgcagtaccagatcatcaatgacacctatgaaattggagagctgaatgacatcaacatcaccacccccagcaagcccagctggcacctgagcaacctgaatgccaccaccaagtacaagttctacctgcgggcctgcaccagccagggctgtgggaagcccatcacagaggagagcagcaccctgggggagggcaagtatgccggcctgtatgatgacatcagcacccagggctggttcatcggcctgatgtgtgccatcgccctgctgaccctgctgctgctgactgtgtgctttgtgaagaggaacagaggaggcaagtacagcgtgaaggagaaggaggacctgcacccagaccctgagatccagagcgtgaaggatgagacctttggagagtacagcgacagtgatgagaagcccctgaagggcagcctgcggagcctgaacagagacatgcagcccacagagagcgctgacagcctggtggagtactag

SEQ ID NO: 146957 - DNA, 258 bp, Artificial Sequence
  Description of Artificial Sequence: Synthetic coding sequence
atggagcccctgctgctgggccggggcctgattgtgtacctgatgttcctgctgctgaagttcagcaaggccatcgagatccccagctctgtgcagcaggtgcccaccatcatcaagcagagcaaggtgcaggtggccttcccctttgatgagtacttccagattgaatgtgaggccaagggcaaccctgagcccaccttctcctggaccaaggatggcaaccccttctacttcacagaccaccgcatcatcccctag

SEQ ID NO: 146958 - DNA, 450 bp, Artificial Sequence
  Description of Artificial Sequence: Synthetic coding sequence
atggagagccggggcaagagcgccagcagccccaagccagacaccaaggtgccccaggtgaccacagaggccaaggtgcccccagctgctgatggcaaggcccccctgaccaagcccagcaagaaggaggccccagctgagaagcagcagcccccagctgcccccaccacagccccagccaagaagaccagcgccaaggctgaccctgccctgctgaacaaccacagcaacctgaagccagcccccaccgtgcccagcagcccagatgccaccccagagcccaagggccctggagatggagcagaagaagatgaggccgccagcggcggccctgggggccggggcccctggagctgtgagaacttcaaccccctgctggtggccggcggcgtggccgtggccgccatcgccctgatcctgggcgtggccttcctggtgaggaagaagtag

SEQ ID NO: 146959 - DNA, 627 bp, Artificial Sequence
  Description of Artificial Sequence: Synthetic coding sequence
atgagcagcgagcccccaccaccctacccaggcggccccacagcccccctgctggaggagaagagcggggccccacccaccccaggccgcagcagccctgctgtgatgcagcccccacctggcatgcccctgcccccagctgacatcggccccccaccctatgagcccccaggccaccccatgccccagcccggcttcatccccccccacatgtctgcagatggcacctacatgcctcctggcttctacccacctcctggcccccacccccccatgggctactacccacctggcccctacaccccaggcccctacccaggccctgggggccacacagccaccgtgctggtgcccagcggggccgccaccaccgtgacagtgctgcagggcgagatctttgaaggagcccctgtgcagacagtgtgcccccactgccagcaggccatcaccaccaagatctcctatgaaattggcctgatgaactttgtgctgggcttcttctgctgcttcatgggctgtgacctgggctgctgcctgatcccctgcctgatcaatgacttcaaggatgtgacccacacctgccccagctgcaaggcctacatctacacctacaagaggctgtgctag

SEQ ID NO: 146960 - DNA, 456 bp, Artificial Sequence
  Description of Artificial Sequence: Synthetic coding sequence
atggccgccagcacctccatggtgcctgtggccgtgacagctgctgtggcccctgtgctgagcatcaacagcgacttcagtgacctgcgggagatcaagaagcagctgctgctgattgctggcctgacccgggagcggggcctgctgcacagcagcaagtggagcgctgagctggccttcagcctgcctgccctgcccctggccgagctgcagcccccaccacccatcacagaagaagatgcccaggacatggatgcctacaccctggccaaggcctactttgatgtgaaggagtatgaccgggccgcccacttcctgcacggctgcaacagcaagaaggcctacttcctgtacatgtacagccgctacctggtgcgggccatcctgaagtgccacagcgccttcagcgagaccagcatcttccgcaccaacgggaaggtgaagagcttcaagtag

SEQ ID NO: 146961 - DNA, 1794 bp, Artificial Sequence
  Description of Artificial Sequence: Synthetic coding sequence
atggccgccagcacctccatggtgcctgtggccgtgacagctgctgtggcccctgtgctgagcatcaacagcgacttcagtgacctgcgggagatcaagaagcagctgctgctgattgctggcctgacccgggagcggggcctgctgcacagcagcaagtggagcgctgagctggccttcagcctgcctgccctgcccctggccgagctgcagcccccaccacccatcacagaagaagatgcccaggacatggatgcctacaccctggccaaggcctactttgatgtgaaggagtatgaccgggccgcccacttcctgcacggctgcaacagcaagaaggcctacttcctgtacatgtacagccgctacctgtctggagagaagaagaaggatgatgagaccgtggacagcctgggccccctggagaagggccaggtgaagaatgaggccctgcgggagctgcgggtggagctgagcaagaagcaccaggcccgggagctggatggcttcggcctgtacctgtatggagtggtgctgaggaagctggacctggtgaaggaggccattgatgtgtttgtggaggccacccacgtgctgcccctgcactggggcgcctggctggagctgtgcaacctgatcacagacaaggagatgctgaagttcctgagcctgcctgacacctggatgaaggagttcttcctggcccacatctacacagagctgcagctgattgaggaggccctgcagaagtaccagaacctgattgatgtgggcttcagcaagagcagctacatcgtgtcccagattgctgtggcctaccacaacatccgggacatcgacaaggccctgagcatcttcaatgagctgaggaagcaggacccctacagaattgagaacatggacaccttcagcaacctgctgtatgtgcgctccatgaagtctgagctgagctacctggcccacaacctgtgtgaaattgacaagtacagagtggagacctgctgcgtgattggcaactactacagcctgcggagccagcacgagaaggccgccctgtacttccagagggccctgaagctgaacccccgctacctgggcgcctggaccctgatgggccacgagtacatggagatgaagaacaccagcgctgccatccaggcctacagacatgccatcgaggtgaacaagagggactaccgggcctggtacggcctgggccagacctatgagatcctgaagatgcccttctactgcctgtactactacagaagagcccaccagctgcggcccaatgacagcaggatgctggtggccctgggagaatgttatgagaagctgaaccagctggtggaggccaagaagtgctactggagggcctatgctgtgggagatgtggagaagatggccctggtgaagctggccaagctgcacgagcagctgacagaaagtgagcaggccgcccagtgctacatcaagtacatccaggacatctacagctgtggggagatcgtggagcacctggaggagagcacagccttccgctacctggcccagtactacttcaagtgcaagctgtgggatgaggccagcacctgtgcccagaagtgctgtgccttcaatgacacccgggaggagggcaaggccctgctgcggcagatcctgcagctgaggaaccagggcgagacccccaccacagaggtgcctgcccccttcttcctgcctgccagcctgagcgccaacaacacccccaccaggagagtgagccccctgaacctgagctctgtgaccccctag

SEQ ID NO: 146962 - DNA, 1575 bp, Artificial Sequence
  Description of Artificial Sequence: Synthetic coding sequence
atggagctgggccctgagcccccccacagaagaaggctgctgtttgcctgcagccccccaccagccagccagcctgtggtgaaggccctgtttggagccagcgctgctgggggcctgagccctgtgaccaacctgactgtgaccatggaccagctgcagggcctgggcagtgactatgagcagcccctggaggtgaagaacaacagcaacctgcagaggatgggcagcagcgagagcacagacagcggcttctgcctggacagccctggccccctggacagcaaggagaacctggagaaccccatgaggcgcatccacagcctgccccagaagctgctgggctgcagccctgccctgaagaggagccacagcgacagcctggaccatgacatcttccagctgattgatcctgatgagaacaaggaaaatgaggcctttgagttcaagaagcctgtgcggcctgtgtcccggggctgcctgcacagccacggcctgcaggagggcaaggacctcttcacccagaggcagaacagcgccccagccaggatgctgagcagcaatgaaagagacagcagcgagcccggcaacttcatccccctcttcaccccccagagccctgtgacagccaccctgagtgatgaagatgatggctttgtggacctgctggatggagagaacctgaagaatgaggaggagacccccagctgcatggccagcctgtggacagcccccctggtgatgaggaccaccaacctggacaaccgctgcaagctgtttgacagccccagcctgtgcagcagcagcaccaggtctgtgctgaagaggcctgagaggagccaggaggagagccccccaggcagcaccaagaggaggaagtccatgtctggggccagccccaaggagagcaccaaccctgagaaggcccacgagaccctgcaccagagcctgagcctggccagcagccccaagggcaccatcgagaacatcctggacaatgacccccgggacctgattggagacttcagcaagggctacctgttccacacagtggccggcaagcaccaggacctgaagtacatcagccctgagatcatggcctctgtgctgaatggcaagtttgccaacctgatcaaggagtttgtgatcatcgactgccgctacccctatgaatatgaaggaggccacatcaagggagctgtgaacctgcacatggaggaggaggtggaggacttcctgctgaagaagcccatcgtgcccacagatggcaagagggtcatcgtggtgttccactgtgagttcagcagcgagcggggccccaggatgtgccgctacgtgcgggagcgggaccggctgggcaatgagtaccccaagctgcactacccagagctgtatgtgctgaagggcggctacaaggagttcttcatgaagtgccagagctactgtgagcccccatcctaccggcccatgcaccacgaggacttcaaggaggacctgaagaagttccgcaccaagagcaggacctgggccggggagaagagcaagcgggagatgtacagccggctgaagaagctgtag

SEQ ID NO: 146963 - DNA, 1455 bp, Artificial Sequence
  Description of Artificial Sequence: Synthetic coding sequence
atggagctgggccctgagcccccccacagaagaaggctgctgtttgcctgcagccccccaccagccagccagcctgtggtgaaggccctgtttggagccagcgctgctgggggcctgagccctgtgaccaacctgactgtgaccatggaccagctgcagggcctgggcagtgactatgagcagcccctggaggtgaagaacaacagcaacctgcagaggatgggcagcagcgagagcacagacagcggcttctgcctggacagccctggccccctggacagcaaggagaacctggagaaccccatgaggcgcatccacagcctgccccagaagctgctgggctgcagccctgccctgaagaggagccacagcgacagcctggaccatgacatcttccagctgattgatcctgatgagaacaaggagaacctgagcagcaatgaaagagacagcagcgagcccggcaacttcatccccctcttcaccccccagagccctgtgacagccaccctgagtgatgaagatgatggctttgtggacctgctggatggagagaacctgaagaatgaggaggagacccccagctgcatggccagcctgtggacagcccccctggtgatgaggaccaccaacctggacaaccgctgcaagctgtttgacagccccagcctgtgcagcagcagcaccaggtctgtgctgaagaggcctgagaggagccaggaggagagccccccaggcagcaccaagaggaggaagtccatgtctggggccagccccaaggagagcaccaaccctgagaaggcccacgagaccctgcaccagagcctgagcctggccagcagccccaagggcaccatcgagaacatcctggacaatgacccccgggacctgattggagacttcagcaagggctacctgttccacacagtggccggcaagcaccaggacctgaagtacatcagccctgagatcatggcctctgtgctgaatggcaagtttgccaacctgatcaaggagtttgtgatcatcgactgccgctacccctatgaatatgaaggaggccacatcaagggagctgtgaacctgcacatggaggaggaggtggaggacttcctgctgaagaagcccatcgtgcccacagatggcaagagggtcatcgtggtgttccactgtgagttcagcagcgagcggggccccaggatgtgccgctacgtgcgggagcgggaccggctgggcaatgagtaccccaagctgcactacccagagctgtatgtgctgaagggcggctacaaggagttcttcatgaagtgccagagctactgtgagcccccatcctaccggcccatgcaccacgaggacttcaaggaggacctgaagaagttccgcaccaagagcaggacctgggccggggagaagagcaagcgggagatgtacagccggctgaagaagctgtag

SEQ ID NO: 146964 - DNA, 432 bp, Artificial Sequence
  Description of Artificial Sequence: Synthetic coding sequence
atggagctgggccctgagcccccccacagaagaaggctgctgtttgcctgcagccccccaccagccagccagcctgtggtgaaggccctgtttggagccagcgctgctgggggcctgagccctgtgaccaacctgactgtgaccatggaccagctgcagggcctgggcagtgactatgagcagcccctggaggtgaagaacaacagcaacctgcagaggatgggcagcagcgagagcacagacagcggcttctgcctggacagccctggccccctggacagcaaggagaacctggagaaccccatgaggcgcatccacagcctgccccagaagctgctgggctgcagccctgccctgaagaggagccacagcgacagcctggaccatgacatcttccagctgattgatcctgatgagaacaaggagaactag

SEQ ID NO: 146965 - DNA, 1743 bp, Artificial Sequence
  Description of Artificial Sequence: Synthetic coding sequence
atggaggtgccccagcctgagcccgcccctggcagcgccctgagccctgctggggtgtgtggcggggcccagaggcctggccacctgcccggcctgctgctgggcagccacggcctgctgggcagccctgtgcgggctgctgccagcagccctgtgaccaccctgacccagaccatgcatgacctggccggcctgggcagcgagacccccaagagccaggtgggcaccctgctcttccgcagccgcagccggctgacccacctgagcctgagccggcgggccagcgagagcagcctgagcagcgagagcagcgagagcagtgatgctggcctgtgcatggacagccccagccccatggacccccacatggccgagcagacctttgagcaggccatccaggccgccagccgcatcatcagaaatgagcagtttgccatccgccgcttccagagcatgcctgtgcggctgctgggccacagccctgtgctgaggaacatcaccaacagccaggccccagatggaagaaggaagtctgaggccggcagcggggccgccagcagcagcggggaggacaaggaaaatgatggctttgtgttcaagatgccctggaagcccacccaccccagcagcacccacgccctggccgagtgggccagccggcgggaggcctttgcccagaggcccagcagcgccccagacctgatgtgcctgagcccagacaggaagatggaggtggaggagctgagccccctggccctgggccgcttcagcctgaccccagctgagggggacacagaagaagatgatggctttgtggacatcctggagagtgacctgaaggatgatgatgctgtgcccccaggcatggagagcctcatcagcgcccccctggtgaagaccctggagaaggaggaggagaaggacctggtgatgtacagcaagtgccagaggctcttccgcagccccagcatgccctgcagcgtcatccggcccatcctgaagaggctggagcggccccaggaccgggacacccctgtgcagaacaagagaagaagatctgtgaccccacctgaggagcagcaggaggccgaggagcccaaggcccgggtgctgcggagcaagagcctgtgccatgatgaaattgagaacctgctggacagcgaccaccgggagctgattggagactacagcaaggccttcctgctgcagacagtggatggcaagcaccaggacctgaagtacatcagccctgagaccatggtggccctgctgaccgggaagttcagcaacatcgtggacaagtttgtgattgtggactgccgctacccctatgaatatgagggcggccacatcaagacagctgtgaacctgcccctggagagagatgctgagagcttcctgctgaagagccccatcgccccctgcagcctggacaagagggtcatcctgatcttccactgtgagttcagcagcgagcggggccccaggatgtgccgcttcatccgggagcgggacagagctgtgaatgactaccccagcctgtactacccagagatgtacatcctgaagggcggctacaaggagttcttcccccagcaccccaacttctgtgagccccaggactaccggcccatgaaccacgaggccttcaaggatgagctgaagaccttccggctgaagaccaggtcctgggccggggagaggagccggcgggagctgtgcagccggctgcaggaccagtag

SEQ ID NO: 146966 - DNA, 1620 bp, Artificial Sequence
  Description of Artificial Sequence: Synthetic coding sequence
atggaggtgccccagcctgagcccgcccctggcagcgccctgagccctgctggggtgtgtggcggggcccagaggcctggccacctgcccggcctgctgctgggcagccacggcctgctgggcagccctgtgcgggctgctgccagcagccctgtgaccaccctgacccagaccatgcatgacctggccggcctgggcagcgagacccccaagagccaggtgggcaccctgctcttccgcagccgcagccggctgacccacctgagcctgagccggcgggccagcgagagcagcctgagcagcgagagcagcgagagcagtgatgctggcctgtgcatggacagccccagccccatggacccccacatggccgagcagacctttgagcaggccatccaggccgccagccgcatcatcagaaatgagcagtttgccatccgccgcttccagagcatgccagatggctttgtgttcaagatgccctggaagcccacccaccccagcagcacccacgccctggccgagtgggccagcagaagagaggcctttgcccagaggcccagcagcgccccagacctgatgtgcctgagcccagacaggaagatggaggtggaggagctgagccccctggccctgggccgcttcagcctgaccccagctgagggggacacagaggaggatgatggctttgtggacatcctggagagtgacctgaaggatgatgatgctgtgcccccaggcatggagagcctcatcagcgcccccctggtgaagaccctggagaaggaggaggagaaggacctggtgatgtacagcaagtgccagaggctcttccgcagccccagcatgccctgcagcgtcatccggcccatcctgaagaggctggagcggccccaggaccgggacacccctgtgcagaacaagagaagaagatctgtgaccccacctgaggagcagcaggaggccgaggagcccaaggcccgggtgctgcggagcaagagcctgtgccatgatgaaattgagaacctgctggacagcgaccaccgggagctgattggagactacagcaaggccttcctgctgcagacagtggatggcaagcaccaggacctgaagtacatcagccctgagaccatggtggccctgctgaccgggaagttcagcaacatcgtggacaagtttgtgattgtggactgccgctacccctatgaatatgaaggaggccacatcaagacagctgtgaacctgcccctggagagagatgctgagagcttcctgctgaagagccccatcgccccctgcagcctggacaagagggtcatcctgatcttccactgtgagttcagcagcgagcggggccccaggatgtgccgcttcatccgggagcgggacagagctgtgaatgactaccccagcctgtactacccagagatgtacatcctgaagggcggctacaaggagttcttcccccagcaccccaacttctgtgagccccaggactaccggcccatgaaccacgaggccttcaaggatgagctgaagaccttccggctgaagaccaggtcctgggccggggagaggagcagaagagagctgtgcagccggctgcaggaccagtag

SEQ ID NO: 146967 - DNA, 1551 bp, Artificial Sequence
  Description of Artificial Sequence: Synthetic coding sequence
atgcacagcgagacccccaagagccaggtgggcaccctgctcttccgcagccgcagccggctgacccacctgagcctgagccggcgggccagcgagagcagcctgagcagcgagagcagcgagagcagtgatgctggcctgtgcatggacagccccagccccatggacccccacatggccgagcagacctttgagcaggccatccaggccgccagccgcatcatcagaaatgagcagtttgccatccgccgcttccagagcatgcctgtgcggctgctgggccacagccctgtgctgaggaacatcaccaacagccaggccccagatggaagaaggaagtctgaggccggcagcggggccgccagcagcagcggggaggacaaggaaaatgatggctttgtgttcaagatgccctggaagcccacccaccccagcagcacccacgccctggccgagtgggccagccggcgggaggcctttgcccagaggcccagcagcgccccagacctgatgtgcctgagcccagacaggaagatggaggtggaggagctgagccccctggccctgggccgcttcagcctgaccccagctgagggggacacagaagaagatgatggctttgtggacatcctggagagtgacctgaaggatgatgatgctgtgcccccaggcatggagagcctcatcagcgcccccctggtgaagaccctggagaaggaggaggagaaggacctggtgatgtacagcaagtgccagaggctcttccgcagccccagcatgccctgcagcgtcatccggcccatcctgaagaggctggagcggccccaggaccgggacacccctgtgcagaacaagagaagaagatctgtgaccccacctgaggagcagcaggaggccgaggagcccaaggcccgggtgctgcggagcaagagcctgtgccatgatgaaattgagaacctgctggacagcgaccaccgggagctgattggagactacagcaaggccttcctgctgcagacagtggatggcaagcaccaggacctgaagtacatcagccctgagaccatggtggccctgctgaccgggaagttcagcaacatcgtggacaagtttgtgattgtggactgccgctacccctatgaatatgagggcggccacatcaagacagctgtgaacctgcccctggagagagatgctgagagcttcctgctgaagagccccatcgccccctgcagcctggacaagagggtcatcctgatcttccactgtgagttcagcagcgagcggggccccaggatgtgccgcttcatccgggagcgggacagagctgtgaatgactaccccagcctgtactacccagagatgtacatcctgaagggcggctacaaggagttcttcccccagcaccccaacttctgtgagccccaggactaccggcccatgaaccacgaggccttcaaggatgagctgaagaccttccggctgaagaccaggtcctgggccggggagaggagccggcgggagctgtgcagccggctgcaggaccagtag

SEQ ID NO: 146968 - DNA, 1470 bp, Artificial Sequence
  Description of Artificial Sequence: Synthetic coding sequence
atgcacagcgagacccccaagagccaggtgggcaccctgctcttccgcagccgcagccggctgacccacctgagcctgagccggcgggccagcgagagcagcctgagcagcgagagcagcgagagcagtgatgctggcctgtgcatggacagccccagccccatggacccccacatggccgagcagacctttgagcaggccatccaggccgccagccgcatcatcagaaatgagcagtttgccatccgccgcttccagagcatgcctgtgcggctgctgggccacagccctgtgctgaggaacatcaccaacagccaggccccagatggaagaaggaagtctgaggccggcagcggggccgccagcagcagcggggaggacaaggaaaatgatggctttgtgttcaagatgccctggaagcccacccaccccagcagcacccacgccctggccgagtgggccagccggcgggaggcctttgcccagaggcccagcagcgccccagacctgatgtgcctgagcccagacaggaagatggaggtggaggagctgagccccctggccctgggccgcttcagcctgaccccagctgagggggacacagaagaagatgatggctttgtggacatcctggagagtgacctgaaggacctggtgatgtacagcaagtgccagaggctcttccgcagccccagcatgccctgcagcgtcatccggcccatcctgaagaggctggagcggccccaggaccgggacacccctgtgcagaacaagagaagaagatctgtgaccccacctgaggagcagcaggaggccgaggagcccaaggcccgggtgctgcggagcaagagcctgtgccatgatgaaattgagaacctgctggacagcgaccaccgggagctgattggagactacagcaaggccttcctgctgcagacagtggatggcaagcaccaggacctgaagtacatcagccctgagaccatggtggccctgctgaccgggaagttcagcaacatcgtggacaagtttgtgattgtggactgccgctacccctatgaatatgaaggaggccacatcaagacagctgtgaacctgcccctggagagagatgctgagagcttcctgctgaagagccccatcgccccctgcagcctggacaagagggtcatcctgatcttccactgtgagttcagcagcgagcggggccccaggatgtgccgcttcatccgggagcgggacagagctgtgaatgactaccccagcctgtactacccagagatgtacatcctgaagggcggctacaaggagttcttcccccagcaccccaacttctgtgagccccaggactaccggcccatgaaccacgaggccttcaaggatgagctgaagaccttccggctgaagaccaggtcctgggccggggagaggagcagaagagagctgtgcagccggctgcaggaccagtag

SEQ ID NO: 146969 - DNA, 1701 bp, Artificial Sequence
  Description of Artificial Sequence: Synthetic coding sequence
atggaggtgccccagcctgagcccgcccctggcagcgccctgagccctgctggggtgtgtggcggggcccagaggcctggccacctgcccggcctgctgctgggcagccacggcctgctgggcagccctgtgcgggctgctgccagcagccctgtgaccaccctgacccagaccatgcatgacctggccggcctgggcagccgcagccggctgacccacctgagcctgagccggcgggccagcgagagcagcctgagcagcgagagcagcgagagcagtgatgctggcctgtgcatggacagccccagccccatggacccccacatggccgagcagacctttgagcaggccatccaggccgccagccgcatcatcagaaatgagcagtttgccatccgccgcttccagagcatgcctgtgcggctgctgggccacagccctgtgctgaggaacatcaccaacagccaggccccagatggaagaaggaagtctgaggccggcagcggggccgccagcagcagcggggaggacaaggaaaatgatggctttgtgttcaagatgccctggaagcccacccaccccagcagcacccacgccctggccgagtgggccagccggcgggaggcctttgcccagaggcccagcagcgccccagacctgatgtgcctgagcccagacaggaagatggaggtggaggagctgagccccctggccctgggccgcttcagcctgaccccagctgagggggacacagaagaagatgatggctttgtggacatcctggagagtgacctgaaggatgatgatgctgtgcccccaggcatggagagcctcatcagcgcccccctggtgaagaccctggagaaggaggaggagaaggacctggtgatgtacagcaagtgccagaggctcttccgcagccccagcatgccctgcagcgtcatccggcccatcctgaagaggctggagcggccccaggaccgggacacccctgtgcagaacaagagaagaagatctgtgaccccacctgaggagcagcaggaggccgaggagcccaaggcccgggtgctgcggagcaagagcctgtgccatgatgaaattgagaacctgctggacagcgaccaccgggagctgattggagactacagcaaggccttcctgctgcagacagtggatggcaagcaccaggacctgaagtacatcagccctgagaccatggtggccctgctgaccgggaagttcagcaacatcgtggacaagtttgtgattgtggactgccgctacccctatgaatatgagggcggccacatcaagacagctgtgaacctgcccctggagagagatgctgagagcttcctgctgaagagccccatcgccccctgcagcctggacaagagggtcatcctgatcttccactgtgagttcagcagcgagcggggccccaggatgtgccgcttcatccgggagcgggacagagctgtgaatgactaccccagcctgtactacccagagatgtacatcctgaagggcggctacaaggagttcttcccccagcaccccaacttctgtgagccccaggactaccggcccatgaaccacgaggccttcaaggatgagctgaagaccttccggctgaagaccaggtcctgggccggggagaggagccggcgggagctgtgcagccggctgcaggaccagtag

SEQ ID NO: 146970 - DNA, 2475 bp, Artificial Sequence
  Description of Artificial Sequence: Synthetic coding sequence
atgacagtgctgcaggagcctgtgcaggccgccatctggcaggccctgaaccactacgcctacagagatgctgtgttcctggccgagcggctgtatgcagaggtgcacagcgaggaggccctcttcctgctggccacctgctactacagaagtggcaaggcctacaaggcctaccgcctgctgaagggccacagctgcaccaccccccagtgcaagtacctgctggccaagtgctgcgtggacctgagcaagctggccgagggggagcagatcctgtctggaggagtcttcaacaagcagaagagccatgatgacatcgtgacagaatttggagacagcgcctgcttcaccctgagcctgctgggccacgtgtactgcaagacagaccggctggccaagggcagcgagtgctaccagaagagcctgagcctgaaccccttcctgtggagcccctttgagagcctgtgtgagatcggggagaagccagaccctgaccagaccttcaagttcaccagcctgcagaacttcagcaactgcctgcccaacagctgcaccacccaggtgcccaaccacagcctgagccaccggcagcctgagaccgtgctgacagagaccccccaggacaccatcgagctgaaccggctgaacctggagagcagcaacagcaagtacagcctgaacacagacagctctgtgtcctacattgattctgctgtgatcagcccagacacagtgcccctgggcaccggcaccagcatcctgagcaagcaggtgcagaacaagcccaagacaggccgcagcctgctgggcggccctgctgccctgagccccctgacccccagctttggcatcctgcccctggagacccccagccctggagatggcagctacctgcagaactacaccaacaccccacctgtgattgatgtgcccagcactggagcccccagcaagaagtctgtggcccgcatcggccagacaggcaccaagtctgtgttcagccagagcggcaacagccgggaggtgacccccatcctggcccagacccagagcagcggcccccagaccagcaccaccccccaggtgctgagccccaccatcaccagccccccaaatgccctgccccggcgcagcagccgcctcttcaccagtgacagcagcaccaccaaggagaacagcaagaagctgaagatgaagtttcctcccaagatccccaacaggaagaccaagagcaagaccaacaagggcggcatcacccagcccaacatcaatgacagcctggagatcaccaagctggacagcagcatcatcagcgagggcaagatcagcaccatcaccccccagatccaggccttcaacctgcagaaggctgctgctgagggcctgatgagcctgctgcgggagatgggcaagggctacctggccctgtgcagctacaactgcaaggaggccatcaacatcctgagccacctgcccagccaccactacaacacaggctgggtgctgtgccagatcggccgggcctactttgagctgtctgagtacatgcaggccgagcgcatcttcagcgaggtgagaagaattgagaactacagagtggagggcatggagatctacagcaccaccctgtggcacctgcagaaggatgtggccctgtctgtgctgagcaaggacctgacagacatggacaagaacagccctgaggcctggtgtgccgccggcaactgcttcagcctgcagcgggagcatgacatcgccatcaagttcttccagagggccatccaggtggaccccaactatgcctatgcctacaccctgctgggccatgaatttgtgctgacagaggagctggacaaggccctggcctgcttcagaaatgccatccgggtgaaccccaggcactacaatgcctggtacggcctgggcatgatctactacaagcaggagaagttcagcctggccgagatgcacttccagaaggccctggacatcaacccccagagctctgtgctgctgtgccacatcggcgtggtgcagcacgccctgaagaagtctgagaaggccctggacaccctgaacaaggccatcgtcatcgaccccaagaaccccctgtgcaagttccaccgggcctctgtgctgtttgccaatgagaagtacaagagcgccctgcaggagctggaggagctgaagcagatcgtgcccaaggagagcctggtgtacttcctgattggcaaggtgtacaagaagctgggccagacccacctggccctgatgaacttctcctgggccatggacctggaccccaagggggccaacaaccagatcaaggaggccatcgacaagcgctacctgcctgatgatgaggagcccatcacccaggaggagcagatcatgggcacagatgagagccaggagagctccatgacagatgctgatgacacccagctgcacgccgctgagagtgatgagttctag

SEQ ID NO: 146971 - DNA, 2292 bp, Artificial Sequence
  Description of Artificial Sequence: Synthetic coding sequence
atggccagcaccaagcccctgtgcctgccccgctgtggcttccccaggaggacccccctgtgccggcggctggccgagggggagcagatcctgagcggcggcgtcttcaacaagcagaagagccatgatgacatcgtgacagaatttggagacagcgcctgcttcaccctgagcctgctgggccacgtgtactgcaagacagaccggctggccaagggcagcgagtgctaccagaagagcctgagcctgaaccccttcctgtggagcccctttgagagcctgtgtgaaattggagagaagccagaccctgaccagaccttcaagttcaccagcctgcagaacttcagcaactgcctgcccaacagctgcaccacccaggtgcccaaccacagcctgagccaccggcagcctgagaccgtgctgacagagaccccccaggacaccatcgagctgaaccggctgaacctggagagcagcaacagcaagtacagcctgaacacagacagctctgtgtcctacatcgacagcgctgtgatcagcccagacacagtgcccctgggcaccggcaccagcatcctgagcaagcaggtgcagaacaagcccaagacaggccgcagcctgctgggcggccctgctgccctgagccccctgacccccagctttggcatcctgcccctggagacccccagccctggagatggcagctacctgcagaactacaccaacaccccacctgtgattgatgtgcccagcactggagcccccagcaagaagtctgtggccagaattggccagacaggcaccaagagcgtcttcagccagagcggcaacagccgggaggtgacccccatcctggcccagacccagagcagcggcccccagaccagcaccaccccccaggtgctgagccccaccatcaccagccccccaaatgccctgcccaggaggagcagccgcctcttcaccagtgacagcagcaccaccaaggagaacagcaagaagctgaagatgaagttcccccccaagatccccaacaggaagaccaagagcaagaccaacaagggcggcatcacccagcccaacatcaatgacagcctggagatcaccaagctggacagcagcatcatcagcgagggcaagatcagcaccatcaccccccagatccaggccttcaacctgcagaaggctgctgctgagggcctgatgagcctgctgcgggagatgggcaagggctacctggccctgtgcagctacaactgcaaggaggccatcaacatcctgagccacctgcccagccaccactacaacacaggctgggtgctgtgccagatcggccgggcctactttgagctgtctgagtacatgcaggccgagcgcatcttcagcgaggtgagaagaattgagaactacagagtggagggcatggagatctacagcaccaccctgtggcacctgcagaaggatgtggccctgtctgtgctgagcaaggacctgacagacatggacaagaacagccctgaggcctggtgtgccgccggcaactgcttcagcctgcagcgggagcatgacatcgccatcaagttcttccagagggccatccaggtggaccccaactatgcctatgcctacaccctgctgggccacgagtttgtgctgacagaggagctggacaaggccctggcctgcttcagaaatgccatccgggtgaaccccaggcactacaatgcctggtacggcctgggcatgatctactacaagcaggagaagttcagcctggccgagatgcacttccagaaggccctggacatcaacccccagagctctgtgctgctgtgccacatcggcgtggtgcagcacgccctgaagaagtctgagaaggccctggacaccctgaacaaggccatcgtgattgaccccaagaaccccctgtgcaagttccaccgggcctctgtgctgtttgccaatgagaagtacaagagcgccctgcaggagctggaggagctgaagcagatcgtgcccaaggagagcctggtgtacttcctgattggcaaggtgtacaagaagctgggccagacccacctggccctgatgaacttctcctgggccatggacctggaccccaagggggccaacaaccagatcaaggaggccatcgacaagcgctacctgcctgatgatgaggagcccatcacccaggaggagcagatcatgggcacagatgagagccaggagagctccatgacagatgctgatgacacccagctgcatgctgctgagagtgatgagttctag

SEQ ID NO: 146972 - DNA, 2472 bp, Artificial Sequence
  Description of Artificial Sequence: Synthetic coding sequence
atgacagtgctgcaggagcctgtgcaggccgccatctggcaggccctgaaccactacgcctacagagatgctgtgttcctggccgagcggctgtatgcagaggtgcacagcgaggaggccctcttcctgctggccacctgctactacagaagtggcaaggcctacaaggcctaccgcctgctgaagggccacagctgcaccaccccccagtgcaagtacctgctggccaagtgctgcgtggacctgagcaagctggccgagggggagcagatcctgtctggaggagtcttcaacaagcagaagagccatgatgacatcgtgacagaatttggagacagcgcctgcttcaccctgagcctgctgggccacgtgtactgcaagacagaccggctggccaagggcagcgagtgctaccagaagagcctgagcctgaaccccttcctgtggagcccctttgagagcctgtgtgagatcggggagaagccagaccctgaccagaccttcaagttcaccagcctgcagaacttcagcaactgcctgcccaacagctgcaccacccaggtgcccaaccacagcctgagccaccggcagcctgagaccgtgctgacagagaccccccaggacaccatcgagctgaaccggctgaacctggagagcagcaacagcaagtacagcctgaacacagacagctctgtgtcctacattgattctgctgtgatcagcccagacacagtgcccctgggcaccggcaccagcatcctgagcaagcaggtgcagaacaagcccaagacaggccgcagcctgctgggcggccctgctgccctgagccccctgacccccagctttggcatcctgcccctggagacccccagccctggagatggcagctacctgcagaactacaccaacaccccacctgtgattgatgtgcccagcactggagcccccagcaagaagtctgtggcccgcatcggccagacaggcaccaagtctgtgttcagccagagcggcaacagccgggaggtgacccccatcctggcccagacccagagcagcggcccccagaccagcaccaccccccaggtgctgagccccaccatcaccagccccccaaatgccctgccccggcgcagcagccgcctcttcaccagtgacagcagcaccaccaaggagaacagcaagaagctgaagatgaagtttcctcccaagatccccaacaggaagaccaagagcaagaccaacaagggcggcatcacccagcccaacatcaatgacagcctggagatcaccaagctggacagcagcatcatcagcgagggcaagatcagcaccatcaccccccagatccaggccttcaacctgcagaaggctgctgctggcctgatgagcctgctgcgggagatgggcaagggctacctggccctgtgcagctacaactgcaaggaggccatcaacatcctgagccacctgcccagccaccactacaacacaggctgggtgctgtgccagatcggccgggcctactttgagctgtctgagtacatgcaggccgagcgcatcttcagcgaggtgagaagaattgagaactacagagtggagggcatggagatctacagcaccaccctgtggcacctgcagaaggatgtggccctgtctgtgctgagcaaggacctgacagacatggacaagaacagccctgaggcctggtgtgccgccggcaactgcttcagcctgcagcgggagcatgacatcgccatcaagttcttccagagggccatccaggtggaccccaactatgcctatgcctacaccctgctgggccacgagtttgtgctgacagaggagctggacaaggccctggcctgcttcagaaatgccatccgggtgaaccccaggcactacaatgcctggtacggcctgggcatgatctactacaagcaggagaagttcagcctggccgagatgcacttccagaaggccctggacatcaacccccagagctctgtgctgctgtgccacatcggcgtggtgcagcacgccctgaagaagtctgagaaggccctggacaccctgaacaaggccatcgtgattgaccccaagaaccccctgtgcaagttccaccgggcctctgtgctgtttgccaatgagaagtacaagagcgccctgcaggagctggaggagctgaagcagatcgtgcccaaggagagcctggtgtacttcctgattggcaaggtgtacaagaagctgggccagacccacctggccctgatgaacttctcctgggccatggacctggaccccaagggggccaacaaccagatcaaggaggccatcgacaagcgctacctgcctgatgatgaggagcccatcacccaggaggagcagatcatgggcacagatgagagccaggagagctccatgacagatgctgatgacacccagctgcatgctgctgagagtgatgagttctag

SEQ ID NO: 146973 - DNA, 2493 bp, Artificial Sequence
  Description of Artificial Sequence: Synthetic coding sequence
atgacagtgctgcaggagcctgtgcaggccgccatctggcaggccctgaaccactacgcctacagagatgctgtgttcctggccgagcggctgtatgcagaggtgcacagcgaggaggccctcttcctgctggccacctgctactacagaagtggcaaggcctacaaggcctaccgcctgctgaagggccacagctgcaccaccccccagtgcaagtacctgctggccaagtgctgcgtggacctgagcaagctggccgagggggagcagatcctgtctggaggagtcttcaacaagcagaagagccatgatgacatcgtgacagaatttggagacagcgcctgcttcaccctgagcctgctgggccacgtgtactgcaagacagaccggctggccaagggcagcgagtgctaccagaagagcctgagcctgaaccccttcctgtggagcccctttgagagcctgtgtgagatcggggagaagccagaccctgaccagaccttcaagttcaccagcctgcagaacttcagcaactgcctgcccaacagctgcaccacccaggtgcccaaccacagcctgagccaccggcagcctgagaccgtgctgacagagaccccccaggacaccatcgagctgaaccggctgaacctggagagcagcaacagcaagtacagcctgaacacagacagctctgtgtcctacattgattctgctgtgatcagcccagacacagtgcccctgggcaccggcaccagcatcctgagcaagcaggtgcagaacaagcccaagacaggccgcagcctgctgggcggccctgctgccctgagccccctgacccccagctttggcatcctgcccctggagacccccagccctggagatggcagctacctgcagaactacaccaacaccccacctgtgattgatgtgcccagcactggagcccccagcaagaagaccttccgggtgctgcagagcgtggcccgcatcggccagacaggcaccaagtctgtgttcagccagagcggcaacagccgggaggtgacccccatcctggcccagacccagagcagcggcccccagaccagcaccaccccccaggtgctgagccccaccatcaccagccccccaaatgccctgccccggcgcagcagccgcctcttcaccagtgacagcagcaccaccaaggagaacagcaagaagctgaagatgaagtttcctcccaagatccccaacaggaagaccaagagcaagaccaacaagggcggcatcacccagcccaacatcaatgacagcctggagatcaccaagctggacagcagcatcatcagcgagggcaagatcagcaccatcaccccccagatccaggccttcaacctgcagaaggctgctgctgagggcctgatgagcctgctgcgggagatgggcaagggctacctggccctgtgcagctacaactgcaaggaggccatcaacatcctgagccacctgcccagccaccactacaacacaggctgggtgctgtgccagatcggccgggcctactttgagctgtctgagtacatgcaggccgagcgcatcttcagcgaggtgagaagaattgagaactacagagtggagggcatggagatctacagcaccaccctgtggcacctgcagaaggatgtggccctgtctgtgctgagcaaggacctgacagacatggacaagaacagccctgaggcctggtgtgccgccggcaactgcttcagcctgcagcgggagcatgacatcgccatcaagttcttccagagggccatccaggtggaccccaactatgcctatgcctacaccctgctgggccatgaatttgtgctgacagaggagctggacaaggccctggcctgcttcagaaatgccatccgggtgaaccccaggcactacaatgcctggtacggcctgggcatgatctactacaagcaggagaagttcagcctggccgagatgcacttccagaaggccctggacatcaacccccagagctctgtgctgctgtgccacatcggcgtggtgcagcacgccctgaagaagtctgagaaggccctggacaccctgaacaaggccatcgtcatcgaccccaagaaccccctgtgcaagttccaccgggcctctgtgctgtttgccaatgagaagtacaagagcgccctgcaggagctggaggagctgaagcagatcgtgcccaaggagagcctggtgtacttcctgattggcaaggtgtacaagaagctgggccagacccacctggccctgatgaacttctcctgggccatggacctggaccccaagggggccaacaaccagatcaaggaggccatcgacaagcgctacctgcctgatgatgaggagcccatcacccaggaggagcagatcatgggcacagatgagagccaggagagctccatgacagatgctgatgacacccagctgcacgccgctgagagtgatgagttctag

SEQ ID NO: 146974 - DNA, 1740 bp, Artificial Sequence
  Description of Artificial Sequence: Synthetic coding sequence
atgtctgctgccatcgccgccctggccgccagctatggcagcggcagcggcagcgagagtgacagcgacagcgagagcagccgctgccccctgcctgctgctgacagcctgatgcacctgaccaagagccccagcagcaagcccagcctggccgtggccgtggacagcgcccctgaggtggccgtgaaggaggacctggagaccggggtgcacctggaccctgctgtgaaggaggtgcagtacaaccccacctatgagaccatgtttgcccctgagtttggacctgagaaccccttccgcacccagcagatggccgcccccaggaacatgctgagcggctatgcagagcccgcccacatcaatgacttcatgtttgagcagcagaggaggacctttgccacctacggctacgccctggaccccagcctggacaaccaccaggtgtctgccaagtacatcggctctgtggaggaggccgagaagaaccagggcctgactgtgtttgagaccggccagaagaagacagagaagaggaagaagttcaaggaaaatgatgccagcaacattgatggcttcctgggcccctgggccaagtatgtggatgagaaggatgtggccaagcccagcgaggaggagcagaaggagctggatgagatcacagccaagaggcagaagaagggcaagcaggaggaggagaagccaggagaggagaagaccatcctgcacgtgaaggagatgtatgactaccagggccgcagctacctgcacatcccccaggatgtgggcgtgaacctgcggagcaccatgcctcctgagaagtgctacctgcccaagaagcagatccacgtgtggagcggccacaccaagggcgtgtctgctgtgcggctcttccccctgagcggccacctgctgctgagctgcagcatggactgcaagatcaagctgtgggaggtgtatggagagcggcgctgcctgcggaccttcatcggccacagcaaggctgtgcgggacatctgcttcaacacagctggcacccagttcctgtctgctgcctatgaccgctacctgaagctgtgggacacagaaacaggccagtgcatcagccgcttcaccaacaggaaggtgccctactgtgtgaagttcaacccagatgaggacaagcagaacctgtttgtggccggcatgtctgacaagaagatcgtgcagtgggacatccgctctggagagatcgtgcaggagtatgacagacacctgggcgctgtgaacaccatcgtgtttgtggatgaaaatagaagatttgtgtccaccagtgatgacaagagcctgcgggtgtgggagtgggacatccctgtggacttcaagtacatcgccgagcccagcatgcacagcatgcctgctgtgaccctgagccccaacgggaagtggctggcctgccagagcatggacaaccagatcctgatctttggagcccagaaccgcttccggctgaacaagaagaagatcttcaagggccacatggtggccggctacgcctgccaggtggacttctccccagacatgtcctatgtgatctctggagatggaaatggcaagctgaacatctgggactggaagaccaccaagctgtacagccgcttcaaggcccatgacaaggtgtgcatcggggctgtgtggcacccccatgagaccagcaaggtgatcacctgtggctgggatggcctcatcaagctgtgggactag

SEQ ID NO: 146975 - DNA, 1620 bp, Artificial Sequence
  Description of Artificial Sequence: Synthetic coding sequence
atgtctgctgccatcgccgccctggccgccagctatggcagcggcagcggcagcgagagtgacagcgacagcgagagcagccgctgccccctgcctgctgctgacagcctgatgcacctgaccaagagccccagcagcaagcccagcctggccgtggccgtggacagcgcccctgaggtggccgtgaaggaggacctggagaccggggtgcacctggaccctgctgtgaaggaggtgcagtacaaccccacctatgagaccatgtttgcccctgagtttggacctgagaaccccttccgcacccagcagatggccgcccccaggaacatgctgagcggctatgcagagcccgcccacatcaatgacttcatgtttgagcagcagaggaggacctttgccacctacggctacgccctggaccccagcctggacaaccaccaggtgtctgccaagtacatcggctctgtggaggaggccgagaagaaccagggcctgactgtgtttgagaccggccagaagaagacagagaagaggaagaagttcaaggaaaatgatgccagcaacattgatggcttcctgggcccctgggccaagtatgtggatgagaaggatgtggccaagcccagcgaggaggagcagaaggagctggatgagatcacagccaagaggcagaagaagggcaagcaggaggaggagaagccaggagaggagaagaccatcctgcacgtgaaggagatgtatgactaccagggccgcagctacctgcacatcccccaggatgtgggcgtgaacctgcggagcaccatgcctcctgagaagtgctacctgcccaagaagcagatccacgtgtggagcggccacaccaagggcgtgtctgctgtgcggctcttccccctgagcggccacctgctgctgagctgcagcatggactgcaagatcaagctgtgggaggtgtatggagagcggcgctgcctgcggaccttcatcggccacagcaaggctgtgcgggacatctgcttcaacacagctggcacccagttcctgtctgctgcctatgaccgctacctgaagctgtgggacacagaaacaggccagtgcatcagccgcttcaccaacaggaaggtgccctactgtgtgaagttcaacccagatgaggacaagcagaacctgtttgtggccggcatgtctgacaagaagatcgtgcagtgggacatccgctctggagagatcgtgcaggagtatgacagacacctgggcgctgtgaacaccatcgtgtttgtggatgaaaatagaagatttgtgtccaccagtgatgacaagagcctgcgggtgtgggagtgggacatccctgtggacttcaagtacatcgccgagcccagcatgcacagcatgcctgctgtgaccctgagccccaacgggaagtggctggcctgccagagcatggacaaccagatcctgatctttggagcccagaaccgcttccggctgaacaagaagaagatcttcaagggccacatggtggccggctacgcctgccaggtggacttctccccagacatgagggtgccccagagcttccagaacctgaaggaggtgacagctggcccccaggagggctag

SEQ ID NO: 146976 - DNA, 1740 bp, Artificial Sequence; identical to SEQ ID NO: 146974
  Description of Artificial Sequence: Synthetic coding sequence

SEQ ID NO: 146977 - DNA, 1620 bp, Artificial Sequence; identical to SEQ ID NO: 146975
  Description of Artificial Sequence: Synthetic coding sequence

SEQ ID NO: 146978 - DNA, 378 bp, Artificial Sequence
  Description of Artificial Sequence: Synthetic coding sequence
tgaaacatgctgagcggctacgccgagcccgcccacatcaatgacttcatgtttgagcagcagaggaggacctttgccacctacggctacgccctggaccccagcctggacaaccaccaggtgtctgccaagtacatcggctctgtggaggaggccgagaagaaccagggcctgactgtgtttgaaacaggccagaagaagacagagaagaggaagaagttcaaggaaaatgatgccagcaacattgatggcttcctgggcccctgggccaagtatgtggatgagaaggatgtggccaagcccagcgaggtgtcctttgatgtgttcaactgccagttccgctacaccctgtacctgtatgagggctacctgcactag

SEQ ID NO: 146979 - DNA, 495 bp, Artificial Sequence
  Description of Artificial Sequence: Synthetic coding sequence
atgtctgctgccatcgccgccctggccgccagctatggcagcggcagcggcagcgagagtgacagcgacagcgagagcagccgctgccccctgcctgctgctgacagcctgatgcacctgaccaagagccccagcagcaagcccagcctggccgtggccgtggacagcgcccctgaggtggccgtgaaggaggacctggagaccggggtgcacctggaccctgctgtgaaggaggtgcagtacaaccccacctatgagaccatgtttgcccctgagtttggacctgagaaccccttccgcacccagcagatggccgcccccaggaacatgctgagcggctatgcagagcccgcccacatcaatgacttcatgtttgagcagcagaggaggacctttgccacctacggctacgccctggaccccagcctggacaaccaccaggtgtctgccaagtacatcggctctgtggaggaggccgagaagatcaaggtgtag

SEQ ID NO: 146980 - DNA, 213 bp, Artificial Sequence
  Description of Artificial Sequence: Synthetic coding sequence
atggccgcccccaggaacatgctgagcggctacgccgagcccgcccacatcaatgacttcatgtttgagcagcagaggaggacctttgccacctacggctacgccctggaccccagcctggacaaccaccaggtgtctgccaagtacatcggctctgtggaggaggccgagaagaaccagggcctgactgtgtttgaaacaggccagaagtag

SEQ ID NO: 146981 - DNA, 1305 bp, Artificial Sequence
  Description of Artificial Sequence: Synthetic coding sequence
atgagcatcctgaagatccacgcccgggagatctttgacagccggggcaaccccaccgtggaggtggacctcttcaccagcaagggcctcttccgggctgctgtgcccagcggggccagcacaggcatctatgaggccctggagctgcgggacaatgacaagacccgctacatgggcaagggcgtgtccaaggctgtggagcacatcaacaagaccatcgccccagccctggtgtccaagaagctgaatgtgacagagcaggagaagattgacaagctgatgattgagatggatggaacagagaacaagagcaagtttggagccaatgccatcctgggcgtgtccctggccgtgtgcaaggccggggctgtggagaagggcgtgcccctgtaccgccacatcgctgacctggccggcaacagcgaggtgatcctgcctgtgcctgccttcaacgtcatcaatggaggcagccatgctggcaacaagctggccatgcaggagttcatgatcctgcctgtgggcgccgccaacttccgggaggccatgagaattggagctgaggtgtaccacaacctgaagaatgtcatcaaggagaagtatggcaaggatgccaccaacgtgggagatgaaggaggctttgcccccaacatcctggagaacaaggagggcctggagctgctgaagacagccatcggcaaggccggctacacagacaaggtggtgattggcatggatgtggccgccagcgagttcttccgcagcggcaagtatgacctggacttcaagagcccagatgaccccagccgctacatcagcccagaccagctggccgacctgtacaagagcttcatcaaggactaccctgtggtgtccattgaggacccctttgaccaggatgactggggcgcctggcagaagttcaccgccagcgctggcatccaggtggtgggagatgacctgactgtgaccaaccccaagagaattgccaaggctgtgaatgagaagagctgcaactgcctgctgctgaaggtgaaccagatcggctctgtgacagagagcctgcaggcctgcaagctggcccaggccaacggctggggcgtgatggtgagccacaggtctggagaaacagaggacaccttcatcgctgacctggtggtgggcctgtgcaccggccagatcaagacaggagccccctgccgctctgagcggctggccaagtacaaccagctgctgagaattgaggaggagctgggcagcaaggccaagtttgctggcaggaacttcaggaaccccctggccaagtag

SEQ ID NO: 146982 - DNA, 360 bp, Artificial Sequence
  Description of Artificial Sequence: Synthetic coding sequence
atgaggaagacagccagcagctgcccagccagcctgacctgtgactgctacgccacagacaaggtgtgcagcatctgcctgagccggcggcagcaggtggcccccagggctggcaccccaggcttccgggcccctgaggtgctgaccaagtgccccaaccagaccaccgggaagagcatcctgtgcagcaaggaggtgcctgcccaggacctgaggaagctgtgtgagcggctgcggggcatggacagcagcacccccaagctgaccagtgacatccagggccacgccagccaccagcctgccatcagcgagaagacagaccacaaggccagctgcctggtgcagaccccacctggatag

SEQ ID NO: 146983 - DNA, 474 bp, Artificial Sequence
  Description of Artificial Sequence: Synthetic coding sequence
atggaggccagcctgggcatccagatggatgagcccatggccttcagcccccagagggaccgcttccaggccgagggcagcctgaagaagaatgagcagaacttcaagctggccggcgtgaagaaggacatcgagaagctgtatgaggccgtgccccagctgagcaatgtgttcaagattgaggacaagatcggggagggcaccttcagctctgtgtacctggccacagcccagctgcaggtgggccctgaggagaagatcgccctgaagcacctgatccccaccagccaccccatcagaattgctgctgagctgcagtgcctgactgtggccggcggccaggacaacgtgatgggcgtgaagtactgcttcaggaagaatgaccacgtggtgattgccatgccctacctggagcacgagagcttcctggacatcctgaacagcctgtccttccaggaggtgcgggagtactag

SEQ ID NO: 146984 - DNA, 1725 bp, Artificial Sequence
  Description of Artificial Sequence: Synthetic coding sequence
atggaggccagcctgggcatccagatggatgagcccatggccttcagcccccagagggaccgcttccaggccgagggcagcctgaagaagaatgagcagaacttcaagctggccggcgtgaagaaggacatcgagaagctgtatgaggccgtgccccagctgagcaatgtgttcaagattgaggacaagatcggggagggcaccttcagctctgtgtacctggccacagcccagctgcaggtgggccctgaggagaagatcgccctgaagcacctgatccccaccagccaccccatcagaattgctgctgagctgcagtgcctgactgtggccggcggccaggacaacgtgatgggcgtgaagtactgcttcaggaagaatgaccacgtggtgattgccatgccctacctggagcacgagagcttcctggacatcctgaacagcctgtccttccaggaggtgcgggagtacatgctgaacctcttcaaggccctgaagaggatccaccagtttggaattgtgcacagagatgtgaagcccagcaacttcctgtacaacagaaggctgaagaagtatgccctggtggactttggcctggcccagggcacccatgacaccaagattgagctgctgaagtttgtgcagagcgaggcccagcaggagcgctgcagccagaacaagagccacatcatcaccggcaacaagatccccctgagcggccctgtgcccaaggagctggaccagcagagcaccaccaaggcctctgtgaagaggccctacaccaatgcccagatccagatcaagcagggcaaggatggcaaggagggctctgtgggcctgtctgtgcagaggtctgtgtttggagagaggaacttcaacatccacagcagcatcagccatgagagccctgctgtgaagctgatgaagcagagcaagacagtggatgtgctgagcaggaagctggccaccaagaagaaggccatcagcaccaaggtgatgaacagcgctgtgatgaggaagacagccagcagctgcccagccagcctgacctgtgactgctacgccacagacaaggtgtgcagcatctgcctgagccggcggcagcaggtggccccccgggccggcaccccaggcttccgggcccctgaggtgctgaccaagtgccccaaccagaccacagccatcgacatgtggagcgctggggtcatcttcctgagcctgctgagcggccgctaccccttctacaaggccagtgatgacctgacagccctggcccagatcatgaccatccggggcagccgggagaccatccaggccgccaagaccttcggcaagagcatcctgtgcagcaaggaggtgcctgcccaggacctgaggaagctgtgtgagcggctgcggggcatggacagcagcacccccaagctgaccagtgacatccagggccacgccagccaccagcctgccatcagcgagaagacagaccacaaggccagctgcctggtgcagaccccacctggccagtacagcggcaacagcttcaagaagggggacagcaacagctgtgagcactgctttgatgagtacaacaccaacctggagggctggaatgaggtgcctgatgaggcctatgacctgctggacaagctgctggacctgaacccagccagccgcatcacagctgaggaggccctgctgcaccccttcttcaaggacatgagcctgtag

SEQ ID NO: 146985 - DNA, 1641 bp, Artificial Sequence
  Description of Artificial Sequence: Synthetic coding sequence
atggaggccagcctgggcatccagatggatgagcccatggccttcagcccccagagggaccgcttccaggccgagggcagcctgaagaagaatgagcagaacttcaagctggccggcaccttcagctctgtgtacctggccacagcccagctgcaggtgggccctgaggagaagatcgccctgaagcacctgatccccaccagccaccccatcagaattgctgctgagctgcagtgcctgactgtggccggcggccaggacaacgtgatgggcgtgaagtactgcttcaggaagaatgaccacgtggtgattgccatgccctacctggagcacgagagcttcctggacatcctgaacagcctgtccttccaggaggtgcgggagtacatgctgaacctcttcaaggccctgaagaggatccaccagtttggaattgtgcacagagatgtgaagcccagcaacttcctgtacaacagaaggctgaagaagtatgccctggtggactttggcctggcccagggcacccatgacaccaagattgagctgctgaagtttgtgcagagcgaggcccagcaggagcgctgcagccagaacaagagccacatcatcaccggcaacaagatccccctgagcggccctgtgcccaaggagctggaccagcagagcaccaccaaggcctctgtgaagaggccctacaccaatgcccagatccagatcaagcagggcaaggatggcaaggagggctctgtgggcctgtctgtgcagaggtctgtgtttggagagaggaacttcaacatccacagcagcatcagccatgagagccctgctgtgaagctgatgaagcagagcaagacagtggatgtgctgagcaggaagctggccaccaagaagaaggccatcagcaccaaggtgatgaacagcgctgtgatgaggaagacagccagcagctgcccagccagcctgacctgtgactgctacgccacagacaaggtgtgcagcatctgcctgagccggcggcagcaggtggccccccgggccggcaccccaggcttccgggcccctgaggtgctgaccaagtgccccaaccagaccacagccatcgacatgtggagcgctggggtcatcttcctgagcctgctgagcggccgctaccccttctacaaggccagtgatgacctgacagccctggcccagatcatgaccatccggggcagccgggagaccatccaggccgccaagaccttcggcaagagcatcctgtgcagcaaggaggtgcctgcccaggacctgaggaagctgtgtgagcggctgcggggcatggacagcagcacccccaagctgaccagtgacatccagggccacgccagccaccagcctgccatcagcgagaagacagaccacaaggccagctgcctggtgcagaccccacctggccagtacagcggcaacagcttcaagaagggggacagcaacagctgtgagcactgctttgatgagtacaacaccaacctggagggctggaatgaggtgcctgatgaggcctatgacctgctggacaagctgctggacctgaacccagccagccgcatcacagctgaggaggccctgctgcaccccttcttcaaggacatgagcctgtag

SEQ ID NO: 146986 - DNA, 3453 bp, Artificial Sequence
  Description of Artificial Sequence: Synthetic coding sequence
atggcccagtttggaggccagaagaaccccccctgggccacccagttcaccgccacagctgtgtcccagcctgctgccctgggcgtgcagcagcccagcctgctgggcgccagccccaccatctacacccagcagacagccctggccgctgctggcctgaccacccagaccccagccaactaccagctgacccagacagctgccctgcagcagcaggccgctgctgctgctgctgccctgcagcagcagtacagccagccccagcaggccctgtacagcgtgcagcagcagctgcagcagccccagcagaccctgctgacccagcctgctgtggccctgcccaccagcctgagcctgagcaccccccagcccacagcccagatcaccgtgtcctaccccacccccaggagcagccagcagcagacccagccccagaagcagagggtcttcaccggggtggtgaccaagctgcatgacacctttggatttgtggatgaagatgtgttcttccagctgtctgctgtgaagggcaagaccccccaggtgggggacagagtgctggtggaggccacctacaaccccaacatgcccttcaagtggaatgcccagaggatccagaccctgcccaaccagaaccagagccagacccagcccctgctgaagaccccacctgctgtgctgcagcccatcgccccccagaccaccttcggcgtgcagacccagccccagccccagagcctgctgcaggcccagatctctgctgccagcatcacccccctgctgcagacccagccccagcccctgctgcagcagccccagcagaaggccggcctgctgcagccccctgtgagaattgtgtcccagccccagcctgcccggcggctggacccccccagccgcttcagcggcagaaatgacagaggagaccaggtgcccaacaggaaggatgacaggagccgggagcgggagcgggagaggagaagaagccgggagaggagcccccagaggaagaggagccgggagaggagcccccggcgggagcgggagaggagccccaggagagtgcggcgggtggtgccccgctacacagtgcagttcagcaagttcagcctggactgccccagctgtgacatgatggagctgcggcggcgctaccagaacctgtacatccccagcgacttctttgatgcccagttcacctgggtggatgccttccccctgagccggcccttccagctgggcaactactgcaacttctacgtgatgcaccgggaggtggagagcctggagaagaacatggccatcctggaccccccagatgctgaccacctgtacagcgccaaggtgatgctgatggccagccccagcatggaggacctgtaccacaagagctgtgccctggccgaggacccccaggagctgagagatggcttccagcacccagcccggctggtgaagttcctggtgggcatgaagggcaaggatgaggccatggccatcggcggccactggagccccagcctggatggccctgaccctgagaaggaccccagcgtgctgatcaagacagccatccgctgctgcaaggccctgaccggcatcgacctgtctgtgtgcacccagtggtacagatttgctgagatccgctaccacaggcctgaggagacccacaagggccgcacagtgcctgcccacgtggagaccgtggtgctcttcttcccagatgtgtggcactgcctgcccaccaggtctgagtgggagaccctgagccggggctacaagcagcagctggtggagaagctgcagggcgagaggaaggaggctgatggagagcaggatgaggaggagaaggatgatggagaggccaaggagatcagcacccccacccactggagcaagctggaccccaagaccatgaaggtgaatgacctgaggaaggagctggagagccgggccctgagcagcaagggcctgaagagccagctgattgcccggctgaccaagcagctgaaggtggaggagcagaaggaggagcagaaggagctggagaagtctgagaaggaggaggatgaagatgatgacaggaagtcagaagatgacaaggaggaggaggagaggaagaggcaggaggagattgaaaggcagaggcgggagcggcgctacatcctgcctgatgagcccgccatcatcgtgcaccccaactgggccgccaagagcggcaagtttgactgcagcatcatgagcctgtctgtgctgctggactaccgcctggaggacaacaaggagcacagctttgaggtgtccctgtttgctgagctgttcaatgagatgctgcagagggactttggagtgcgcatctacaagagcctgctgagcctgcctgagaaggaggacaagaaggagaaggacaagaagagcaagaaggatgagaggaaggacaagaaggaggagagagatgatgaaacagatgagcccaagcccaagaggaggaagtctggagatgacaaggacaagaaggaggacagagatgagaggaagaaggaggacaagaggaaggatgacagcaaggatgatgatgaaacagaggaggacaacaaccaggatgaatatgaccccatggaggccgaggaggctgaagatgaggaggatgacagagatgaggaggagatgaccaagagagatgacaagagggacatcaaccgctactgcaaggagcggcccagcaaggacaaggagaaggagaagacccagatgatcaccatcaacagagacctgctgatggcctttgtgtactttgaccagagccactgcggctacctgctggagaaggacctggaggagatcctgtacaccctgggcctgcacctgagccgggcccaggtgaagaagctgctgaacaaggtggtgctgcgggagagctgcttctacaggaagctgacagacaccagcaaggatgaagaaaatcatgaggagagcgagagcctgcaggaggacatgctgggcaaccggctgctgctgcccacccccaccgtgaagcaggagagcaaggatgtggaggagaatgtgggcctgattgtgtacaacggggccatggtggatgtgggcagcctgctgcagaagctggagaagtctgagaaggtgcgggcagaggtggagcagaagctgcagctgctggaggagaagacagatgaagatgagaagaccatcctgaacctggagaacagcaacaagagcctgagcggggagctgcgggaggtgaagaaggacctgagccagctgcaggagaacctgaagatcagcgagaacatgaacctgcagtttgagaaccagatgaacaagaccatccggaacctgagcacagtgatggatgagatccacacagtgctgaagaaggacaacgtgaagaatgaagacaaggaccagaagagcaaagaaaatggagcctctgtgtag

SEQ ID NO: 146987 - DNA, 3408 bp, Artificial Sequence
  Description of Artificial Sequence: Synthetic coding sequence
atggcccagtttggaggccagaagaaccccccctgggccacccagttcaccgccacagctgtgtcccagcctgctgccctgggcgtgcagcagcccagcctgctgggcgccagccccaccatctacacccagcagacagccctggccgctgctggcctgaccacccagaccccagccaactaccagctgacccagacagctgccctgcagcagcaggccgctgctgctgctgctgccctgcagcagctgcagcagccccagcagaccctgctgacccagcctgctgtggccctgcccaccagcctgagcctgagcaccccccagcccacagcccagatcaccgtgtcctaccccacccccaggagcagccagcagcagacccagccccagaagcagagggtcttcaccggggtggtgaccaagctgcatgacaccttcggctttgtggatgaagatgtgttcttccagctgtctgctgtgaagggcaagaccccccaggtgggggacagagtgctggtggaggccacctacaaccccaacatgcccttcaagtggaatgcccagaggatccagaccctgcccaaccagaaccagagccagacccagcccctgctgaagaccccacctgctgtgctgcagcccatcgccccccagaccacctttggagtgcagacccagccccagccccagagcctgctgcaggcccagatctctgctgccagcatcacccccctgctgcagacccagccccagcccctgctgcagcagccccagcagaaggccggcctgctgcagccccctgtgcgcatcgtgtcccagccccagcctgcccggcggctggacccccccagccgcttctctggaagaaatgacagaggagaccaggtgcccaacaggaaggatgacaggagccgggagcgggagcgggagcggcggcgcagccgggagaggagcccccagaggaagaggagccgggagaggagcccccggcgggagcgggagaggagcccccggcgggtgagaagagtggtgccccgctacacagtgcagttcagcaagttcagcctggactgccccagctgtgacatgatggagctgcggcggcgctaccagaacctgtacatccccagcgacttctttgatgcccagttcacctgggtggatgccttccccctgagccggcccttccagctgggcaactactgcaacttctacgtgatgcaccgggaggtggagagcctggagaagaacatggccatcctggaccccccagatgctgaccacctgtacagcgccaaggtgatgctgatggccagccccagcatggaggacctgtaccacaagagctgtgccctggccgaggacccccaggagctgagagatggcttccagcacccagcccggctggtgaagttcctggtgggcatgaagggcaaggatgaggccatggccatcggcggccactggagccccagcctggatggccctgaccctgagaaggaccccagcgtgctgatcaagacagccatccgctgctgcaaggccctgactggaattgacctgtctgtgtgcacccagtggtacagatttgctgagatccgctaccacaggcctgaggagacccacaagggccgcacagtgcctgcccacgtggagaccgtggtgctcttcttcccagatgtgtggcactgcctgcccaccaggtctgagtgggagaccctgagccggggctacaagcagcagctggtggagaagctgcagggcgagaggaaggaggctgatggagagcaggatgaggaggagaaggatgatggagaggccaaggagatcagcacccccacccactggagcaagctggaccccaagaccatgaaggtgaatgacctgaggaaggagctggagagccgggccctgagcagcaagggcctgaagagccagctgattgcccggctgaccaagcagctgaaggtggaggagcagaaggaggagcagaaggagctggagaagtctgagaaggaggaggatgaagatgatgacaggaagtcagaagatgacaaggaggaggaggagaggaagaggcaggaggagattgagcggcagaggcgggagcggcgctacatcctgcctgatgagcccgccatcatcgtgcaccccaactgggccgccaagagcggcaagtttgactgcagcatcatgagcctgtctgtgctgctggactaccgcctggaggacaacaaggagcacagctttgaggtgtccctgtttgctgagctgttcaatgagatgctgcagagggactttggagtgcgcatctacaagagcctgctgagcctgcctgagaaggaggacaagaaggagaaggacaagaagagcaagaaggatgagaggaaggacaagaaggaggagagagatgatgaaacagatgagcccaagcccaagaggaggaagtctggagatgacaaggacaagaaggaggacagagatgagaggaagaaggaggacaagaggaaggatgacagcaaggatgatgatgaaacagaggaggacaacaaccaggatgaatatgaccccatggaggccgaggaggccgaggatgaagaagatgacagagatgaggaggagatgaccaagagagatgacaagagggacatcaaccgctactgcaaggagcggcccagcaaggacaaggagaaggagaagacccagatgatcaccatcaacagagacctgctgatggcctttgtgtactttgaccagagccactgcggctacctgctggagaaggacctggaggagatcctgtacaccctgggcctgcacctgagccgggcccaggtgaagaagctgctgaacaaggtggtgctgcgggagagctgcttctacaggaagctgacagacaccagcaaggatgaggagaaccacgaggagagcgagagcctgcaggaggacatgctgggcaaccggctgctgctgcccacccccaccgtgaagcaggagagcaaggatgtggaggagaatgtgggcctcatcgtgtacaatggagccatggtggatgtgggcagcctgctgcagaagctggagaagtctgagaaggtgcgggcagaggtggagcagaagctgcagctgctggaggagaagacagatgaagatgagaagaccatcctgaacctggagaacagcaacaagagcctgtctggagagctgcgggaggtgaagaaggacctgagccagctgcaggagaacctgaagatcagcgagaacatgaacctgcagtttgagaaccagatgaacaagaccatccggaacctgagcacagtgatggatgagatccacacagtgctgaagaaggacaacgtgaagaatgaagacaaggaccagaagagcaaagaaaatggagcctctgtgtag

SEQ ID NO: 146988 - DNA, 360 bp, Artificial Sequence
  Description of Artificial Sequence: Synthetic coding sequence
atggcccagtttggaggccagaagaaccccccctgggccacccagttcaccgccacagctgtgtcccagcctgctgccctgggcgtgcagcagcccagcctgctgggcgccagccccaccatctacacccagcagacagccctggccgctgctggcctgaccacccagaccccagccaactaccagctgacccagacagctgccctgcagcagcaggccgctgctgctgctgctgccctgcagcagcagtacagccagccccagcaggccctgtacagcgtgcagcagcagctgcagcagccccagcagaccctgctgacccagcctgctgtggccctgcccaccagcctgagcctgtag

SEQ ID NO: 146989 - DNA, 516 bp, Artificial Sequence
  Description of Artificial Sequence: Synthetic coding sequence
atggcccagtttggaggccagaagaaccccccctgggccacccagttcaccgccacagctgtgtcccagcctgctgccctgggcgtgcagcagcccagcctgctgggcgccagccccaccatctacacccagcagacagccctggccgctgctggcctgaccacccagaccccagccaactaccagctgacccagacagctgccctgcagcagcaggccgctgctgctgctgctgccctgcagcagcagtacagccagccccagcaggccctgtacagcgtgcagcagcagctgcagcagccccagcagaccctgctgacccagcctgctgtggccctgcccaccagcctgagcctgagcaccccccagcccacagcccagatcaccgtgtcctaccccacccccaggagcagccagcagcagacccagccccagaagcagagggtcttcaccggggtggtgaccaagctgcatgacacctttggatttgtggatgaagatgtgttcttccagtag

SEQ ID NO: 146990 - DNA, 3132 bp, Artificial Sequence
  Description of Artificial Sequence: Synthetic coding sequence
atggcccagtttggaggccagaagaaccccccctgggccacccagttcaccgccacagctgtgtcccagcctgctgccctgggcgtgcagcagcccagcctgctgggcgccagccccaccatctacacccagcagacagccctggccgctgctggcctgaccacccagaccccagccaactaccagctgacccagacagctgccctgcagcagcaggccgctgctgctgctgctgccctgcagcagctgcagcagccccagcagaccctgctgacccagcctgctgtggccctgcccaccagcctgagcctgagcaccccccagcccacagcccagatcaccgtgtcctaccccacccccaggagcagccagcagcagacccagccccagaagcagagggtcttcaccggggtggtgaccaagctgcatgacaccttcggctttgtggatgaagatgtgttcttccagctgtctgctgtgaagggcaagaccccccaggtgggggacagagtgctggtggaggccacctacaaccccaacatgcccttcaagtggaatgcccagaggatccagaccctgcccaaccagaaccagagccagacccagcccctgctgaagaccccacctgctgtgctgcagcccatcgccccccagaccacctttggagtgcagacccagccccagccccagagcctgctgcaggcccagatctctgctgccagcatcacccccctgctgcagacccagccccagcccctgctgcagcagccccagcagaaggccggcctgctgcagccccctgtgcgcatcgtgtcccagccccagcctgcccggcggctggacccccccagccgcttctctggaagaaatgacagaggagaccaggtgcccaacaggaaggatgacaggagccgggagcgggagcgggagcggcggcgcagccgggagaggagcccccagaggaagaggagccgggagaggagcccccggcgggagcgggagaggagcccccggcgggtgagaagagtggtgccccgctacacagtgcagttcagcaagttcagcctggactgccccagctgtgacatgatggagctgcggcggcgctaccagaacctgtacatccccagcgacttctttgatgcccagttcacctgggtggatgccttccccctgagccggcccttccagctgggcaactactgcaacttctacgtgatgcaccgggaggtggagagcctggagaagaacatggccatcctggaccccccagatgctgaccacctgtacagcgccaaggtgatgctgatggccagccccagcatggaggacctgtaccacaagagctgtgccctggccgaggacccccaggagctgagagatggcttccagcacccagcccggctggtgaagttcctggtgggcatgaagggcaaggatgaggccatggccatcggcggccactggagccccagcctggatggccctgaccctgagaaggaccccagcgtgctgatcaagacagccatccgctgctgcaaggccctgactggaattgacctgtctgtgtgcacccagtggtacagatttgctgagatccgctaccacaggcctgaggagacccacaagggccgcacagtgcctgcccacgtggagaccgtggtgctcttcttcccagatgtgtggcactgcctgcccaccaggtctgagtgggagaccctgagccggggctacaagcagcagctggtggagaagctgcagggcgagaggaaggaggctgatggagagcaggatgaggaggagaaggatgatggagaggccaaggagatcagcacccccacccactggagcaagctggaccccaagaccatgaaggtgaatgacctgaggaaggagctggagagccgggccctgagcagcaagggcctgaagagccagctgattgcccggctgaccaagcagctgaaggtggaggagcagaaggaggagcagaaggagctggagaagtctgagaaggaggaggatgaagatgatgacaggaagtcagaagatgacaaggaggaggaggagaggaagaggcaggaggagattgagcggcagaggcgggagcggcgctacatcctgcctgatgagcccgccatcatcgtgcaccccaactgggccgccaagagcggcaagtttgactgcagcatcatgagcctgtctgtgctgctggactaccgcctggaggacaacaaggagcacagctttgaggtgtccctgtttgctgagctgttcaatgagatgctgcagagggactttggagtgcgcatctacaagagcctgctgagcctgcctgagaaggaggacaagaaggagaaggacaagaagagcaagaaggatgagaggaaggacaagaaggaggagagagatgatgaaacagatgagcccaagcccaagaggaggaagtctggagatgacaaggacaagaaggaggacagagatgagaggaagaaggaggacaagaggaaggatgacagcaaggatgatgatgaaacagaggaggacaacaaccaggatgaatatgaccccatggaggccgaggaggccgaggatgaagaagatgacagagatgaggaggagatgaccaagagagatgacaagagggacatcaaccgctactgcaaggagcggcccagcaaggacaaggagaaggagaagacccagatgatcaccatcaacagagacctgctgatggcctttgtgtactttgaccagagccactgcggctacctgctggagaaggacctggaggagatcctgtacaccctgggcctgcacctgagccgggcccaggtgaagaagctgctgaacaaggtggtgctgcgggagagctgcttctacaggaagctgacagacaccagcaaggatgaggagaaccacgaggagagcgagagcctgcaggaggacatgctgggcaaccggctgctgctgcccacccccaccgtgaagcaggagagcaaggatgtggaggagaatgtgggcctcatcgtgtacaatggagccatggtggatgtgggcagcctgctgcagaagctggagaagtctgagaaggtgcgggcagaggtggagcagaagctgcagctgctgtag

SEQ ID NO: 146991 - DNA, 726 bp, Artificial Sequence
  Description of Artificial Sequence: Synthetic coding sequence
atgtttgcccggggcctgaagaggaaatgtgtgggccatgaagaagatgtggagggcgccctggccggcctgaagacagtgtcctcctacagcctgcagaggcagagcctgctggacatgagcctggtgaagctgcagctgtgccacatgctggtggagcccaacctgtgccgctctgtgctgattgccaacacagtgcggcagatccaggaggagatgacccaggacggcacctggaggacagtggccccccaggccgctgagcgggcccccctggaccggctggtgtccacagagatcctgtgccgggccgcctggggccaggagggcgcccacccagcccctggcctgggagatggccacacccagggccctgtgtctgacctgtgccctgtgaccagcgcccaggcccccaggcacctgcagagcagcgcctgggagatggatggccccagagaaaatagaggcagcttccacaagagcctggaccagatctttgagaccctggagaccaagaaccccagctgcatggaggagctgttcagtgatgtggacagcccctactatgacctggacacagtgctgaccggcatgatgggcggggcccggcccggcccctgtgagggcctggagggcctggccccagccaccccaggccccagcagcagctgcaagagtgacctgggggagctggaccacgtggtggagatcctggtggagacctag

SEQ ID NO: 146992 - DNA, 726 bp, Artificial Sequence; identical to SEQ ID NO: 146991
  Description of Artificial Sequence: Synthetic coding sequence

SEQ ID NO: 146993 - DNA, 759 bp, Artificial Sequence
  Description of Artificial Sequence: Synthetic coding sequence
atgagcggccgccgcaccaggtctgggggcgccgcccagaggagcggcccccgggcccccagccccaccaagcccctgcggcgcagccagaggaagagcggcagcgagctgcccagcatcctgcctgagatctggcccaagacccccagcgctgctgctgtgaggaagcccatcgtgctgaagagaattgtggcccatgctgtggaggtgcctgctgtgcagagccccaggaggagcccccgcatctccttcttcctggagaaggaaaatgagcccccaggccgggagctgaccaaggaggacctcttcaagacccacagcgtgcctgccacccccaccagcacccctgtgcccaaccctgaggccgagagcagcagcaaggagggggagctggatgcccgggacctggagatgagcaagaaggtgagaagaagctacagccggctggagaccctgggcagcgccagcaccagcaccccaggccgccgcagctgcttcggctttgagggcctgctgggcgctgaggacctgagcggcgtgtcccctgtggtgtgcagcaagctgacagaggtgccccgggtgtgtgccaagccctgggccccagacatgaccctgcccggcatcagccccccacctgagaagcagaagaggaagaagaagaagatgcctgagatcctgaagacagagctggatgagtgggccgccgccatgaatgctgagtttgaagctgctgagcagtttgacctgctggtggagtag

SEQ ID NO: 146994 - DNA, 216 bp, Artificial Sequence
  Description of Artificial Sequence: Synthetic coding sequence
cagttcctggaccaggaggactggggcccccagaggaccagcaaggagatccggcagctgcagaatgactgcatgaggctgcgggagagcctgaacaccacccaggtgcacaacctggccctgggggagaagctgcagaacctgcccaccctgctgtacaagagcctgaaggagggcgcccaggccatccaggaggaggcccaggccatccagtag

SEQ ID NO: 146995 - DNA, 1353 bp, Artificial Sequence
  Description of Artificial Sequence: Synthetic coding sequence
atggatgcccggcgggtgccccagaaggacctgcgggtgaagaagaacctgaagaagttccgctacgtgaagctgatctccatggagaccagcagcagcagtgatgacagctgtgacagctttgccagtgacaactttgccaacaccaagcccaagttcagaagtgacatcagcgaggagctggccaacgtgttctatgaagattctgacaatgaaagcttctgtggcttcagcgagagcgaggtgcaggatgtgctggaccactgcggcttcctgcagaagcccaggccagatgtgaccaatgagctggccggcatcttccacgccgacagtgatgatgagagcttctgtggcttcagcgagagcgagatccaggacggcatgaggctgcagagcgtgcgggagggctgcaggaccaggagccagtgccgccacagcggccccctgcgggtggccatgaagtttcctgcccggagcaccaggggggccaccaacaagaaggccgagagccggcagcccagtgaaaattctgtgacagacagcaacagcgacagtgaagatgaaagtggcatgaacttcctggagaagagggccctgaacatcaagcagaacaaggccatgctggccaagctgatgtctgagctggagagcttccctggcagcttccggggccgccaccccctgcccggcagtgacagccagagccggcggcccaggaggaggaccttccctggggtggccagcagaagaaatcctgagcggcgggcccggcccctgaccaggagccgcagccgcatcctgggcagcctggatgccctgcccatggaggaggaggaggaggaggacaagtacatgctggtgaggaagaggaagacagtggatggctacatgaatgaagatgacctgcccaggagccgccgcagccgcagctctgtgaccctgccccacatcatccggcctgtggaggagatcacagaggaggagctggagaatgtgtgcagcaacagccgggagaagatctacaacagaagcctgggcagcacctgccaccagtgccggcagaagaccatcgacaccaagaccaactgcaggaacccagactgctggggcgtgcggggccagttctgtggcccctgcctgaggaaccgctacggggaggaggtgagagatgccctgctggaccccaactggcactgccccccctgccggggcatctgcaactgcagcttctgccggcagagagatggccgctgtgccaccggggtgctggtgtacctggccaagtaccacggctttggaaatgtgcacgcctacctgaagagcctgaagcaggagtttgagatgcaggcctag

SEQ ID NO: 146996 - DNA, 1116 bp, Artificial Sequence
  Description of Artificial Sequence: Synthetic coding sequence
atggatgcccggcgggtgccccagaaggacctgcgggtgaagaagaacctgaagaagttccgctacgtgaagctgatctccatggagaccagcagcagcagtgatgacagctgtgacagctttgccagtgacaactttgccaacacccggctgcagagcgtgcgggagggctgcaggaccaggagccagtgccgccacagcggccccctgcgggtggccatgaagtttcctgcccggagcaccaggggggccaccaacaagaaggccgagagccggcagcccagcgagaacagcgtgacagacagcaacagcgacagtgaagatgagagcggcatgaacttcctggagaagagggccctgaacatcaagcagaacaaggccatgctggccaagctgatgtctgagctggagagcttccctggcagcttccggggccgccaccccctgcccggcagtgacagccagagcagaagacccaggaggaggaccttccctggggtggccagcagaagaaatcctgagcggcgggcccggcccctgaccaggagccgcagccgcatcctgggcagcctggatgccctgcccatggaggaggaggaggaggaggacaagtacatgctggtgaggaagaggaagacagtggatggctacatgaatgaagatgacctgcccaggagcagaagaagccgcagctctgtgaccctgccccacatcatccggcctgtggaggagatcacagaggaggagctggagaatgtgtgcagcaacagccgggagaagatctacaacagaagcctgggcagcacctgccaccagtgccggcagaagaccatcgacaccaagaccaactgcagaaatccagactgctggggcgtgcggggccagttctgtggcccctgcctgaggaacagatatggagaggaggtgagagatgccctgctggaccccaactggcactgccccccctgccggggcatctgcaactgcagcttctgccggcagagagatggccgctgtgccactggagtgctggtgtacctggccaagtaccacggctttggaaatgtgcacgcctacctgaagagcctgaagcaggagtttgagatgcaggcctag

SEQ ID NO: 146997 - DNA, 966 bp, Artificial Sequence
  Description of Artificial Sequence: Synthetic coding sequence
atggatgcccggcgggtgccccagaaggacctgcgggtgaagaagaacctgaagaagttccgctacgtgaagctgatctccatggagaccagcagcagcagtgatgacagctgtgacagctttgccagtgacaactttgccaacacccggctgcagagcgtgcgggagggctgcaggaccaggagccagtgccgccacagcggccccctgcgggtggccatgaagtttcctgcccggagcaccaggggggccaccaacaagaaggccgagagccggcagcccagcgagaacagcgtgacagacagcaacagcgacagtgaagatgagagcggcatgaacttcctggagaagagggccctgaacatcaagcagaacaaggccatgctggccaagctgatgtctgagctggagagcttccctggcagcttccggggccgccaccccctgcccggcagtgacagccagagcagaagacccaggaggaggaccttccctggggtggccagcagaagaaatcctgagcggcgggcccggcccctgaccaggagccgcagccgcatcctgggcagcctggatgccctgcccatggaggaggaggaggaggaggacaagtacatgctggtgaggaagaggaagacagtggatggctacatgaatgaagatgacctgcccaggagcagaagaagccgcagctctgtgaccctgccccacatcatccggcctgtggaggagatcacagaggaggagctggagaatgtgtgcagcaacagccgggagaagatctacaacagaagcctgaactggcactgccccccctgccggggcatctgcaactgcagcttctgccggcagagagatggccgctgtgccactggagtgctggtgtacctggccaagtaccacggctttggaaatgtgcacgcctacctgaagagcctgaagcaggagtttgagatgcaggcctag

SEQ ID NO: 146998 - DNA, 1263 bp, Artificial Sequence
  Description of Artificial Sequence: Synthetic coding sequence
atggagaccctgagcagcgaggagagctgtgacagctttgacagcctggagagcggcaagcagcaggatgtgcgcttccacagcaagtacttcacagaggagctgcggcgcatcttcatcgaggacacagattctgaaacagaggactttgctggcttcacccagagcgacctgaatggcaagaccaaccctgaggtgatggtggtggagagtgacctgagtgatgatggcaaggccagcctggtgtctgaggaggaggaggatgaggaggaggacaaggccaccccaagaagaagccgcagccgccgcagcagcatcggcctgcgggtggccttccagttccccaccaagaagctggccaacaagccagacaagaacagcagcagcgagcagctgttcagcagcgcccggctgcagaatgagaagaagaccatcctggagaggaagaaggactgccggcaggtgatccagcgggaggacagcaccagcgagagtgaagatgacagcagagatgagagccaggagagcagtgatgccctgctgaagaggaccatgaacatcaaggagaacaaggccatgctggcccagctgctggccgagctgaacagcatgccagacttcttccctgtgaggacccccaccagcgccagcaggaagaagacagtgagaagagccttcagcgagggccagatcaccaggaggatgaaccccaccaggtctgcccggcccccagagaagtttgccctggagaacttcaccgtgtctgctgccaagtttgctgaggagttctacagcttcagaagaaggaagaccatcggcggcaaatgtcgggagtacagaagaagacaccgcatcagcagcttccggcctgtggaggacatcacagaggaggacctggagaatgtggccatcaccgtgcgggacaagatctatgacaaggtgctgggcaacacctgccaccagtgccggcagaagaccatcgacaccaagacagtgtgcaggaaccagggctgctgcggcgtgcggggccagttctgtggcccctgcctgaggaaccgctacggggaggatgtgcgcagcgccctgctggaccctgactgggtgtgccccccctgccggggcatctgcaactgcagctactgcaggaagagagatggccgctgtgccaccggcatcctgatccacctggccaagttctacggctatgacaacgtgaaggagtacctggagagcctgcagaaggagctggtggaggacaactag

SEQ ID NO: 146999 - DNA, 1227 bp, Artificial Sequence
  Description of Artificial Sequence: Synthetic coding sequence
atggagctggccacccgctaccagatccccaaggaggtggccgacatcttcaatgcccccagtgatgatgaggagtttgtgggcttcagagatgatgtgcccatggagaccctgagcagcgaggagagctgtgacagctttgacagcctggagagcggcaagcaggtggtggagagtgacctgagtgatgatggcaaggccagcctggtgtctgaggaggaggaggatgaggaggaggacaaggccaccccaagaagaagccgcagccgccgcagcagcatcggcctgcgggtggccttccagttccccaccaagaagctggccaacaagccagacaagaacagcagcagcgagcagctgttcagcagcgcccggctgcagaatgagaagaagaccatcctggagaggaagaaggactgccggcaggtgatccagcgggaggacagcaccagcgagagtgaagatgacagcagagatgagagccaggagagcagtgatgccctgctgaagaggaccatgaacatcaaggagaacaaggccatgctggcccagctgctggccgagctgaacagcatgccagacttcttccctgtgaggacccccaccagcgccagcaggaagaagacagtgagaagagccttcagcgagggccagatcaccaggaggatgaaccccaccaggtctgcccggcccccagagaagtttgccctggagaacttcaccgtgtctgctgccaagtttgctgaggagttctacagcttcagaagaaggaagaccatcggcggcaaatgtcgggagtacagaagaagacaccgcatcagcagcttccggcctgtggaggacatcacagaggaggacctggagaatgtggccatcaccgtgcgggacaagatctatgacaaggtgctgggcaacacctgccaccagtgccggcagaagaccatcgacaccaagacagtgtgcaggaaccagggctgctgcggcgtgcggggccagttctgtggcccctgcctgaggaaccgctacggggaggatgtgcgcagcgccctgctggaccctgactgggtgtgccccccctgccggggcatctgcaactgcagctactgcaggaagagagatggccgctgtgccaccggcatcctgatccacctggccaagttctacggctatgacaacgtgaaggagtacctggagagcctgcagaaggagctggtggaggacaactag

SEQ ID NO: 147000 - DNA, 1365 bp, Artificial Sequence
  Description of Artificial Sequence: Synthetic coding sequence
atggagctggccacccgctaccagatccccaaggaggtggccgacatcttcaatgcccccagtgatgatgaggagtttgtgggcttcagagatgatgtgcccatggagaccctgagcagcgaggagagctgtgacagctttgacagcctggagagcggcaagcagcaggatgtgcgcttccacagcaagtacttcacagaggagctgcggcgcatcttcatcgaggacacagattctgaaacagaggactttgctggcttcacccagagcgacctgaatggcaagaccaaccctgaggtgatggtggtggagagtgacctgagtgatgatggcaaggccagcctggtgtctgaggaggaggaggatgaggaggaggacaaggccaccccaagaagaagccgcagccgccgcagcagcatcggcctgcgggtggccttccagttccccaccaagaagctggccaacaagccagacaagaacagcagcagcgagcagctgttcagcagcgcccggctgcagaatgagaagaagaccatcctggagaggaagaaggactgccggcaggtgatccagcgggaggacagcaccagcgagagtgaagatgacagcagagatgagagccaggagagcagtgatgccctgctgaagaggaccatgaacatcaaggagaacaaggccatgctggcccagctgctggccgagctgaacagcatgccagacttcttccctgtgaggacccccaccagcgccagcaggaagaagacagtgagaagagccttcagcgagggccagatcaccaggaggatgaaccccaccaggtctgcccggcccccagagaagtttgccctggagaacttcaccgtgtctgctgccaagtttgctgaggagttctacagcttcagaagaaggaagaccatcggcggcaaatgtcgggagtacagaagaagacaccgcatcagcagcttccggcctgtggaggacatcacagaggaggacctggagaatgtggccatcaccgtgcgggacaagatctatgacaaggtgctgggcaacacctgccaccagtgccggcagaagaccatcgacaccaagacagtgtgcaggaaccagggctgctgcggcgtgcggggccagttctgtggcccctgcctgaggaaccgctacggggaggatgtgcgcagcgccctgctggaccctgactgggtgtgccccccctgccggggcatctgcaactgcagctactgcaggaagagagatggccgctgtgccaccggcatcctgatccacctggccaagttctacggctatgacaacgtgaaggagtacctggagagcctgcagaaggagctggtggaggacaactag

SEQ ID NO: 147001 - DNA, 291 bp, Artificial Sequence
  Description of Artificial Sequence: Synthetic coding sequence
atggagaccctgagcagcgaggagagctgtgacagctttgacagcctggagagcggcaagcagcaggatgtgcgcttccacagcaagtacttcacagaggagctgcggcgcatcttcatcgaggacacagattctgaaacagaggactttgctggcttcacccagagcgacctgaatggcaagaccaaccctgaggtgatggtggtggagagtgacctgagtgatgatggcaaggccagcctggtgtctgaggaggaggaggatgaggaggaggacaaggccaccccctag

SEQ ID NO: 147002 - DNA, 843 bp, Artificial Sequence
  Description of Artificial Sequence: Synthetic coding sequence
atggcccccaggaagggcagcagccgggtggccaagaccaacagcctgcggcggaggaagctggccagcttcctgaaggactttgaccgggaggtggagatccgcatcaagcagattgaaagtgaccggcagaacctgctgaaggaggtggacaacctgtacaacatcgagatcctgcggctgcccaaggccctgcgggagatgaactggctggactactttgccctgggcggcaacaagcaggccctggaggaggccgccacagctgacctggacatcacagagatcaacaagctgacagctgaggccatccagacccccctgaagagcgccaagaccaggaaggtgatccaggtggatgagatgattgtggaggaggaggaggaggaggagaatgaaaggaagaacctgcagacagcccgggtgaagcgctgcccccccagcaagaagaggacccagagcatccagggcaagggcaagggcaagaggagcagccgggccaacacagtgaccccagctgtgggccgcctggaggtgtccatggtgaagcccaccccaggcctgacccccaggtttgacagcagggtcttcaagaccccaggcctgcggaccccagctgctggggagcgcatctacaacatctctggaaatggcagccccctggccgacagcaaggagatcttcctgactgtgcctgtgggcggcggggagagcctgcggctgctggccagtgacctgcagaggcacagcatcgcccagctggaccctgaggccctgggcaacatcaagaagctgagcaaccggctggcccagatctgcagcagcatccgcacccacaagtag

SEQ ID NO: 147003 - DNA, 843 bp, Artificial Sequence; identical to SEQ ID NO: 147002
  Description of Artificial Sequence: Synthetic coding sequence

SEQ ID NO: 147004 - DNA, 414 bp, Artificial Sequence
  Description of Artificial Sequence: Synthetic coding sequence
atgcccaactttgctggcacctggaagatgaggagcagcgagaactttgatgagctgctgaaggccctgggcgtgaatgccatgctgaggaaggtggccgtggccgccgccagcaagccccacgtggagatccggcaggatggagaccagttctacatcaagaccagcaccaccgtgaggaccacagagatcaacttcaaggtgggggagggctttgaggaggagaccgtggatggcaggaaatgtcgcagcctggccacctgggagaatgaaaacaagatccactgcacccagaccctgctggagggagatggccccaagacctactggacccgggagctggccaatgatgagctgatcctgacctttggagcagatgatgtggtgtgcacccgcatctacgtgcgggagtag

SEQ ID NO: 147005 - DNA, 249 bp, Artificial Sequence
  Description of Artificial Sequence: Synthetic coding sequence
atgcccaacttcagcggcaactggaagatcatccgctctgagaactttgaggagctgctgaaggtgctgggcgtgaatgtgatgctgaggaagattgctgtggccgccgccagcaagccagctgtggagatcaagcaggagggggacaccttctacatcaagaccagcaccaccgtgaggaccacagagatcaacttcaaggtgggggaggagtttgaggagcagacagtggatggccggccctgctag

SEQ ID NO: 147006 - DNA, 417 bp, Artificial Sequence
  Description of Artificial Sequence: Synthetic coding sequence
atgcccaacttcagcggcaactggaagatcatccgctctgagaactttgaggagctgctgaaggtgctgggcgtgaatgtgatgctgaggaagattgctgtggccgccgccagcaagccagctgtggagatcaagcaggagggggacaccttctacatcaagaccagcaccaccgtgaggaccacagagatcaacttcaaggtgggggaggagtttgaggagcagacagtggatggccggccctgcaagagcctggtgaagtgggagagcgagaacaagatggtgtgtgagcagaagctgctgaagggggagggccccaagacctcctggacccgggagctgaccaatgatggagagctgatcctgaccatgacagcagatgatgtggtgtgcaccagggtgtatgtgcgggagtag

SEQ ID NO: 147007 - DNA, 417 bp, Artificial Sequence; identical to SEQ ID NO: 147006
  Description of Artificial Sequence: Synthetic coding sequence

SEQ ID NO: 147008 - DNA, 744 bp, Artificial Sequence
  Description of Artificial Sequence: Synthetic coding sequence
atgggcaccagcagcacagacagccagcaggccggccaccggcgctgcagcaccagcaacaccagcgctgagaacctgacctgcctgagcctgcccggcagccctgggaagacagcccccctgcccggccctgcccaggccggggccggccagcccctgcccaagggctgtgccgctgtgaaggccgaggtgggcatcccagccccccacaccagccaggaggtgcgcatccacatccggcggctgctgtcctgggccgcccctggggcctgtggcctgcggagcaccccctgtgccctgccccaggccctgccccaggcccggccctgccccggccgctggttcttccctggctgcagcctgcccactggaggagcccagaccatcctgagcctgtggacctggaggcacttcctgaactgggccctgcagcagcgggaggagaacagcggccgggcccggcgggtgccccctgtgcccaggacagcccctgtgtccaaaggagagggcagccaccccccccagaacagcaatggagagaaggtgaagaccatcaccccagatgtgggcctgcaccagagcctgaccagtgaccccaccgtggccgtgctgcgggccaagagggcccctgaggcccacccccccaggagctgcagcggcagcctgacagcccgggtgtgccacatgggcgtgtgccagggccagggcgacacagaagatggccgcatgaccctgatgggctag

SEQ ID NO: 147009 - DNA, 744 bp, Artificial Sequence; identical to SEQ ID NO: 147008
  Description of Artificial Sequence: Synthetic coding sequence

SEQ ID NO: 147010 - DNA, 4218 bp, Artificial Sequence
  Description of Artificial Sequence: Synthetic coding sequence
atggccgcccggagcccccccagcccccaccccagccccccagcccggcagctgggccccaggagcccccgggtgggcagaggagctgaggtgcacgccatgaggtctgaggccagcggctttgctggggccgcccgggaggtggtggctgatgaaagtgacaagatctgggtgggggaggagggcagcggcggccggcggggccctggaggagctgccccagcccacgcccccctgctgagcgcccccatgggcagccggcggctggagggcatctctgtggaggaggccatggtgaccaggacccagctgctggaggaggagctgagcagcctgaaggaggagctggccctgtgccaggccgacaaggagtttgtgtggagcctgtggaagaggctgcaggtgaccaacccagacctgacccaggtggtgtccctggtggtggagcgggagaagcagaagtctgaggccaaggacaggaaggtgctggagatcctgcaggtgaaggatgccaagatccaggagtttgagcagcgggagagcgtgctgaagcaggagatcaatgacctggtgaagaggaagattgctgtggatgaggagaatgccttcctgaggaaggagttcagtgacctggagaagaagttcaaggacaagagccaggagatcaaggacaccaaggaatgtgtgcagaacaaggaggagcagaaccggctggtgatcaagaacctggaggaggagaacaagaagctgagcacccgctgcacagacctgctgaatgacctggagaagctgaggaagcaggaggcccacctgaggaaggagaagtacagcacagatgccaagatcaagacctttgaggacaacctgattgaggccaggaaggaggtggaggtgtcccagagcaagtacaatgccctgagcctgcagctgagcaacaagcagacagagctgatccagaaggacatggacatcaccctggtgcggcaggagctgcaggagctgcagaacctgtacaagcagaacagcacccacacagcccagcaggccgagctgatccagcagctgcaggtgctgaacatggacacccagaaggtgctgaggaaccaggaggatgtgcacacagctgagagcatctcctaccagaagctgtacaatgagctgcacatctgctttgagaccaccaagagcaatgaggccatgctgcggcagagcgtgaccaacctgcaggaccagctgctgcagaaggagcaggagaatgccaagctgaaggagaagctgcaggagagccagggcgcccccctgcccctgccccaggagagtgaccctgactacagcgcccaggtgccccaccggcccagcctgagcagcctggagaccctgatggtgtcccagaagtcagaaattgagtacctgcaggagaagctgaagatcgccaatgagaagctgtctgagaacatcagcgccaacaagggcttcagcaggaagagcatcatgaccagcgctgagggcaagcacaaggagccccctgtgaagaggagccgcagcctgagccccaagagcagcttcacagattctgaggagctgcagaagctgaggaaggccgagaggaagattgagaacctggagaaggccctgcagctgaagagccaggagaatgatgagctgagagatgcccacgagaagaggaaggagcggctgcagatgctgcagaccaactacagagctgtgaaggagcagctgaagcagtgggaggagggcagcggcatgacagagatcaggaagatcaagagagctgacccccagcagctgcggcaggaggacagtgatgctgtgtggaatgagctggcctacttcaagcgggagaaccaggagctgatgatccagaagatgaacctggaggaggagctggatgagctgaaggtgcacatcagcattgacaaggccgccatccaggagctgaacagatgtgtggccgagcggcgggaggagcagctgttccgcagcggggaggatgatgaggtgaagaggagcaccccagagaagaatggcaaggagatgctggagcagaccctgcagaaggtgacagagctggagaaccggctgaagagctttgagaagaggagcaggaagctgaaggagggcaacaagaagctgatgaaggaaaatgacttcctgaagagcctgctgaagcagcagcaggaggacacagagacccgggagaaggagctggagcagatcatcaagggcagcaaggatgtggagaaggagaacacagagctgcaggtgaagatcagcgagctggagacagaggtgaccagcctgcggcggcaggtggccgaggccaatgccctgagaaatgaaaatgaggagctgatcaaccccatggagaagagccaccagagcgctgaccgggccaagtctgagatggccaccatgaaggtgcgcagcggccgctatgactgcaagaccaccatgaccaaggtgaagttcaaggccgccaagaagaactgcagcgtgggccgccaccacacagtgctgaaccacagcatcaaggtgatgagcaatgtgtttgagaacctgagcaaggatggctgggaggatgtgtctgagagcagcagtgacagcgaggcccagaccagccagaccctgggcaccatcatcgtggagaccagccagaagatcagccccacagaagatggcaaggaccagaaggagagtgaccccacagaggacagccagacccagggcaaggagatcgtgcagacctacctgaacattgatggcaagacccccaaggactacttccatgacaagaatgccaagaagcccaccttccagaagaagaactgcaagatgcagaagagcagccacacagctgtgcccaccagggtgaaccgggagaagtacaagaacatcacagcccagaagagcagcagcaacatcatcctgctgcgggagcgcatcatcagcctgcagcagcagaacagcgtgctgcagaatgccaagaagacagctgagctgtctgtgaaggagtacaaggaggtgaatgagaagctgctgcaccagcagcaggtgtctgaccagcgcttccagaccagccggcagaccatcaagaagctgaacctggacctggccggcctgaggaaggagaaggaggacctgctgaagaagctggagagcagcagcgagatcaccagcctggccgaggagaacagccaggtgaccttcccccgcatccaggtgaccagcctgagccccagccgctccatggacctggagatgaagcagctgcagtacaagctgaagaatgccaccaatgagctgaccaagcagagcagcaatgtgaagaccctgaagtttgagctgctggccaaggaggagcacatcaaggagatgcatgagaagatcagcaggatggagcgggacatcaccatgaagaggcacctgattgaggacctgaagttccggcagaaggtgaacctggagagcaacaagagcttcagcgagatgctgcagaacctggacaagaaggtgaagaccctgacagaggagtgcagcaacaagaaggtgtccattgacagcctgaagcagaggctgaatgtggccgtgaaggagaagagccagtatgagcagatgtaccagaagagcaaggaggagctggagaagaaggacctgaagctgaccctgctggtgagccgcatcagcgagacagaaagtgccatggccgagattgaaacagctgccagcaagcagctgcaggagctggccctgcagagcgagcaggtgctggagggcgcccagaagaccctgctgctggccaatgagaaggtggaggagttcaccacctttgtgaaggccctggccaaggagctgcagaatgatgtgcacgtggtgcggcggcagatccgggagctgaagaagatgaagaagaacagagatgcctgcaagaccagcacccacaaggcccagaccctggccgccagcatcctgaacatcagcagaagtgacctggaggagatcctggacacagaggaccaggtggagattgagaagaccaagattgatgctgaaaatgacaaggagtggatgctgtacatccagaagctgctggagggccagagcctggccctgagcccccggctgaagtgcaatggagccatcgtggcccaccagaacctgcggctgcctgacagcagcagcagcgccagcgccagctag

SEQ ID NO: 147011 - DNA, 1176 bp, Artificial Sequence
  Description of Artificial Sequence: Synthetic coding sequence
atggccgcccggagcccccccagcccccaccccagccccccagcccggcagctgggccccaggagcccccgggtgggcagaggagctgaggtgcacgccatgaggtctgaggccagcggctttgctggggccgcccgggaggtggtggctgatgaaagtgacaagatctgggtgggggaggagggcagcggcggccggcggggccctggaggagctgccccagcccacgcccccctgctgagcgcccccatgggcagccggcggctggagggcatctctgtggaggaggccatggtgaccaggacccagctgctggaggaggagctgagcagcctgaaggaggagctggccctgtgccaggccgacaaggagtttgtgtggagcctgtggaagaggctgcaggtgaccaacccagacctgacccaggtggtgtccctggtggtggagcgggagaagcagaagtctgaggccaaggacaggaaggtgctggagatcctgcaggtgaaggatgccaagatccaggagtttgagcagcgggagagcgtgctgaagcaggagatcaatgacctggtgaagaggaagattgctgtggatgaggagaatgccttcctgaggaaggagttcagtgacctggagaagaagttcaaggacaagagccaggagatcaaggacaccaaggaatgtgtgcagaacaaggaggagcagaaccggctggtgatcaagaacctggaggaggagaacaagaagctgagcacccgctgcacagacctgctgaatgacctggagaagctgaggaagcaggaggcccacctgaggaaggagaagtacagcacagatgccaagatcaagacctttgaggacaacctgattgaggccaggaaggaggtggaggtgtcccagagcaagtacaatgccctgagcctgcagctgagcaacaagcagacagagctgatccagaaggacatggacatcaccctggtgaggaaggagctgcaggagctgcagaacctgtacaagcagaacagcacccacacagcccagcaggccgagctgatccagcagctgcaggtgctgaacatggacacccagaaggtgctgaggaaccaggaggatgtgcacacagctgagagcatctcctaccagaaggtgtgcttctacagcgtcatcaagatgtag

SEQ ID NO: 147012 - DNA, 4221 bp, Artificial Sequence
  Description of Artificial Sequence: Synthetic coding sequence
atggccgcccggagcccccccagcccccaccccagccccccagcccggcagctgggccccaggagcccccgggtgggcagaggagctgaggtgcacgccatgaggtctgaggccagcggctttgctggggccgcccgggaggtggtggctgatgaaagtgacaagatctgggtgggggaggagggcagcggcggccggcggggccctggaggagctgccccagcccacgcccccctgctgagcgcccccatgggcagccggcggctggagggcatctctgtggaggaggccatggtgaccaggacccagctgctggaggaggagctgagcagcctgaaggaggagctggccctgtgccaggccgacaaggagtttgtgtggagcctgtggaagaggctgcaggtgaccaacccagacctgacccaggtggtgtccctggtggtggagcgggagaagcagaagtctgaggccaaggacaggaaggtgctggagatcctgcaggtgaaggatgccaagatccaggagtttgagcagcgggagagcgtgctgaagcaggagatcaatgacctggtgaagaggaagattgctgtggatgaggagaatgccttcctgaggaaggagttcagtgacctggagaagaagttcaaggacaagagccaggagatcaaggacaccaaggaatgtgtgcagaacaaggaggagcagaaccggctggtgatcaagaacctggaggaggagaacaagaagctgagcacccgctgcacagacctgctgaatgacctggagaagctgaggaagcaggaggcccacctgaggaaggagaagtacagcacagatgccaagatcaagacctttgaggacaacctgattgaggccaggaaggaggtggaggtgtcccagagcaagtacaatgccctgagcctgcagctgagcaacaagcagacagagctgatccagaaggacatggacatcaccctggtgaggaaggagctgcaggagctgcagaacctgtacaagcagaacagcacccacacagcccagcaggccgagctgatccagcagctgcaggtgctgaacatggacacccagaaggtgctgaggaaccaggaggatgtgcacacagctgagagcatctcctaccagaagctgtacaatgagctgcacatctgctttgagaccaccaagagcaatgaggccatgctgcggcagagcgtgaccaacctgcaggaccagctgctgcagaaggagcaggagaatgccaagctgaaggagaagctgcaggagagccagggcgcccccctgcccctgccccaggagagtgaccctgactacagcgcccaggtgccccaccggcccagcctgagcagcctggagaccctgatggtgtcccagaagtcagaaattgagtacctgcaggagaagctgaagatcgccaatgagaagctgtctgagaacatcagcgccaacaagggcttcagcaggaagagcatcatgaccagcgctgagggcaagcacaaggagccccctgtgaagaggagccgcagcctgagccccaagagcagcttcacagattctgaggagctgcagaagctgaggaaggccgagaggaagattgagaacctggagaaggccctgcagctgaagagccaggagaatgatgagctgagagatgcccacgagaagaggaaggagcggctgcagatgctgcagaccaactacagagctgtgaaggagcagctgaagcagtgggaggagggcagcggcatgacagagatcaggaagatcaagagagctgacccccagcagctgcggcaggaggacagtgatgctgtgtggaatgagctggcctacttcaagcgggagaaccaggagctgatgatccagaagatgaacctggaggaggagctggatgagctgaaggtgcacatcagcattgacaaggccgccatccaggagctgaacagatgtgtggccgagcggcgggaggagcagctgttccgcagcggggaggatgatgaggtgaagaggagcaccccagagaagaatggcaaggagatgctggagcagaccctgcagaaggtgacagagctggagaaccggctgaagagctttgagaagaggagcaggaagctgaaggagggcaacaagaagctgatgaaggaaaatgacttcctgaagagcctgctgaagcagcagcaggaggacacagagacccgggagaaggagctggagcagatcatcaagggcagcaaggatgtggagaaggagaacacagagctgcaggtgaagatcagcgagctggagacagaggtgaccagcctgcggcggcaggtggccgaggccaatgccctgagaaatgaaaatgaggagctgatcaaccccatggagaagagccaccagagcgctgaccgggccaagtctgagatggccaccatgaaggtgcgcagcggccgctatgactgcaagaccaccatgaccaaggtgaagttcaaggccgccaagaagaactgcagcgtgggccgccaccacacagtgctgaaccacagcatcaaggtgatgagcaatgtgtttgagaacctgagcaaggatggctgggaggatgtgtctgagagcagcagtgacagcgaggcccagaccagccagaccctgggcaccatcatcgtggagaccagccagaagatcagccccacagaagatggcaaggaccagaaggagagtgaccccacagaggacagccagacccagggcaaggagatcgtgcagacctacctgaacattgatggcaagacccccaaggactacttccatgacaagaatgccaagaagcccaccttccagaagaagaactgcaagatgcagaagagcagccacacagctgtgcccaccagggtgaaccgggagaagtacaagaacatcacagcccagaagagcagcagcaacatcatcctgctgcgggagcgcatcatcagcctgcagcagcagaacagcgtgctgcagaatgccaagaagacagctgagctgtctgtgaaggagtacaaggaggtgaatgagaagctgctgcaccagcagcaggtgtctgaccagcgcttccagaccagccggcagaccatcaagaagctgaacctggacctggccggcctgaggaaggagaaggaggacctgctgaagaagctggagagcagcagcgagatcaccagcctggccgaggagaacagccaggtgaccttcccccgcatccaggtgaccagcctgagccccagccgctccatggacctggagatgaagcagctgcagtacaagctgaagaatgccaccaatgagctgaccaagcagagcagcaatgtgaagaccctgaagtttgagctgctggccaaggaggagcacatcaaggagatgcatgagaagatcagcaggatggagcgggacatcaccatgaagaggcacctgattgaggacctgaagttccggcagaaggtgaacctggagagcaacaagagcttcagcgagatgctgcagaacctggacaagaaggtgaagaccctgacagaggagtgcagcaacaagaaggtgtccattgacagcctgaagcagaggctgaatgtggccgtgaaggagaagagccagtatgagcagatgtaccagaagagcaaggaggagctggagaagaaggacctgaagctgaccctgctggtgagccgcatcagcgagacagaaagtgccatggccgagattgaaacagctgccagcaagcagctgcaggagctggccctgcagagcgagcaggtgctggagggcgcccagaagaccctgctgctggccaatgagaaggtggaggagttcaccacctttgtgaaggccctggccaaggagctgcagaatgatgtgcacgtggtgcggcggcagatccgggagctgaagaagatgaagaagaacagagatgcctgcaagaccagcacccacaaggcccagaccctggccgccagcatcctgaacatcagcagaagtgacctggaggagatcctggacacagaggaccaggtggagattgagaagaccaagattgatgctgaaaatgacaaggagtggatgctgtacatccagaagctgctggagggccagctgccctttgccagctacctgctggaggccgtgctggagaagatcaatgagaagaagaagctggtggagggctacttcaccatcatgaaggacatcagatag

SEQ ID NO: 147013 - DNA, 4221 bp, Artificial Sequence
  Description of Artificial Sequence: Synthetic coding sequence
atggccgcccggagcccccccagcccccaccccagccccccagcccggcagctgggccccaggagcccccgggtgggcagaggagctgaggtgcacgccatgaggtctgaggccagcggctttgctggggccgcccgggaggtggtggctgatgaaagtgacaagatctgggtgggggaggagggcagcggcggccggcggggccctggaggagctgccccagcccacgcccccctgctgagcgcccccatgggcagccggcggctggagggcatctctgtggaggaggccatggtgaccaggacccagctgctggaggaggagctgagcagcctgaaggaggagctggccctgtgccaggccgacaaggagtttgtgtggagcctgtggaagaggctgcaggtgaccaacccagacctgacccaggtggtgtccctggtggtggagcgggagaagcagaagtctgaggccaaggacaggaaggtgctggagatcctgcaggtgaaggatgccaagatccaggagtttgagcagcgggagagcgtgctgaagcaggagatcaatgacctggtgaagaggaagattgctgtggatgaggagaatgccttcctgaggaaggagttcagtgacctggagaagaagttcaaggacaagagccaggagatcaaggacaccaaggaatgtgtgcagaacaaggaggagcagaaccggctggtgatcaagaacctggaggaggagaacaagaagctgagcacccgctgcacagacctgctgaatgacctggagaagctgaggaagcaggaggcccacctgaggaaggagaagtacagcacagatgccaagatcaagacctttgaggacaacctgattgaggccaggaaggaggtggaggtgtcccagagcaagtacaatgccctgagcctgcagctgagcaacaagcagacagagctgatccagaaggacatggacatcaccctggtgcggcaggagctgcaggagctgcagaacctgtacaagcagaacagcacccacacagcccagcaggccgagctgatccagcagctgcaggtgctgaacatggacacccagaaggtgctgaggaaccaggaggatgtgcacacagctgagagcatctcctaccagaagctgtacaatgagctgcacatctgctttgagaccaccaagagcaatgaggccatgctgcggcagagcgtgaccaacctgcaggaccagctgctgcagaaggagcaggagaatgccaagctgaaggagaagctgcaggagagccagggcgcccccctgcccctgccccaggagagtgaccctgactacagcgcccaggtgccccaccggcccagcctgagcagcctggagaccctgatggtgtcccagaagtcagaaattgagtacctgcaggagaagctgaagatcgccaatgagaagctgtctgagaacatcagcgccaacaagggcttcagcaggaagagcatcatgaccagcgctgagggcaagcacaaggagccccctgtgaagaggagccgcagcctgagccccaagagcagcttcacagattctgaggagctgcagaagctgaggaaggccgagaggaagattgagaacctggagaaggccctgcagctgaagagccaggagaatgatgagctgagagatgcccacgagaagaggaaggagcggctgcagatgctgcagaccaactacagagctgtgaaggagcagctgaagcagtgggaggagggcagcggcatgacagagatcaggaagatcaagagagctgacccccagcagctgcggcaggaggacagtgatgctgtgtggaatgagctggcctacttcaagcgggagaaccaggagctgatgatccagaagatgaacctggaggaggagctggatgagctgaaggtgcacatcagcattgacaaggccgccatccaggagctgaacagatgtgtggccgagcggcgggaggagcagctgttccgcagcggggaggatgatgaggtgaagaggagcaccccagagaagaatggcaaggagatgctggagcagaccctgcagaaggtgacagagctggagaaccggctgaagagctttgagaagaggagcaggaagctgaaggagggcaacaagaagctgatgaaggaaaatgacttcctgaagagcctgctgaagcagcagcaggaggacacagagacccgggagaaggagctggagcagatcatcaagggcagcaaggatgtggagaaggagaacacagagctgcaggtgaagatcagcgagctggagacagaggtgaccagcctgcggcggcaggtggccgaggccaatgccctgagaaatgaaaatgaggagctgatcaaccccatggagaagagccaccagagcgctgaccgggccaagtctgagatggccaccatgaaggtgcgcagcggccgctatgactgcaagaccaccatgaccaaggtgaagttcaaggccgccaagaagaactgcagcgtgggccgccaccacacagtgctgaaccacagcatcaaggtgatgagcaatgtgtttgagaacctgagcaaggatggctgggaggatgtgtctgagagcagcagtgacagcgaggcccagaccagccagaccctgggcaccatcatcgtggagaccagccagaagatcagccccacagaagatggcaaggaccagaaggagagtgaccccacagaggacagccagacccagggcaaggagatcgtgcagacctacctgaacattgatggcaagacccccaaggactacttccatgacaagaatgccaagaagcccaccttccagaagaagaactgcaagatgcagaagagcagccacacagctgtgcccaccagggtgaaccgggagaagtacaagaacatcacagcccagaagagcagcagcaacatcatcctgctgcgggagcgcatcatcagcctgcagcagcagaacagcgtgctgcagaatgccaagaagacagctgagctgtctgtgaaggagtacaaggaggtgaatgagaagctgctgcaccagcagcaggtgtctgaccagcgcttccagaccagccggcagaccatcaagaagctgaacctggacctggccggcctgaggaaggagaaggaggacctgctgaagaagctggagagcagcagcgagatcaccagcctggccgaggagaacagccaggtgaccttcccccgcatccaggtgaccagcctgagccccagccgctccatggacctggagatgaagcagctgcagtacaagctgaagaatgccaccaatgagctgaccaagcagagcagcaatgtgaagaccctgaagtttgagctgctggccaaggaggagcacatcaaggagatgcatgagaagatcagcaggatggagcgggacatcaccatgaagaggcacctgattgaggacctgaagttccggcagaaggtgaacctggagagcaacaagagcttcagcgagatgctgcagaacctggacaagaaggtgaagaccctgacagaggagtgcagcaacaagaaggtgtccattgacagcctgaagcagaggctgaatgtggccgtgaaggagaagagccagtatgagcagatgtaccagaagagcaaggaggagctggagaagaaggacctgaagctgaccctgctggtgagccgcatcagcgagacagaaagtgccatggccgagattgaaacagctgccagcaagcagctgcaggagctggccctgcagagcgagcaggtgctggagggcgcccagaagaccctgctgctggccaatgagaaggtggaggagttcaccacctttgtgaaggccctggccaaggagctgcagaatgatgtgcacgtggtgcggcggcagatccgggagctgaagaagatgaagaagaacagagatgcctgcaagaccagcacccacaaggcccagaccctggccgccagcatcctgaacatcagcagaagtgacctggaggagatcctggacacagaggaccaggtggagattgagaagaccaagattgatgctgaaaatgacaaggagtggatgctgtacatccagaagctgctggagggccagctgccctttgccagctacctgctggaggccgtgctggagaagatcaatgagaagaagaagctggtggagggctacttcaccatcatgaaggacatcagatag

SEQ ID NO: 147014 - DNA, 519 bp, Artificial Sequence
  Description of Artificial Sequence: Synthetic coding sequence
atggccagcggcttcaagaagcccagcgctgccagcacaggccagaagaggaaggtggcccccaagccagagctgacagaggaccagaagcaggaggtgcgggaggcctttgacctgtttgatgtggatggcagcggcaccattgatgccaaggagctgaaggtggccatgagggccctgggctttgagcccaggaaggaggagatgaagaagatgatcagcgaggtggaccgggagggcaccgggaagatctccttcaatgacttcctggccgtgatgacccagaagatgtctgagaaggacaccaaggaggagatcctgaaggccttccggctgtttgatgatgatgagaccgggaagatctccttcaagaacctgaagagggtggccaatgagctgggggagaacctgacagatgaggagctgcaggagatgattgatgaagctgacagagatggagatggagaggtgaatgaggaggagttcctgcgcatcatgaagaagaccagcctgtactag

SEQ ID NO: 147015 - DNA, 519 bp, Artificial Sequence
  Description of Artificial Sequence: Synthetic coding sequence
atggccagcaacttcaagaaggccaacatggccagcagcagccagaggaagaggatgagccccaagccagagctgacagaggagcagaagcaggagatccgggaggcctttgacctgtttgatgctgatggcaccggcaccattgatgtgaaggagctgaaggtggccatgagggccctgggctttgagcccaagaaggaggagatcaagaagatgatcagcgagattgacaaggagggcaccgggaagatgaactttggagacttcctgactgtgatgacccagaagatgtctgagaaggacaccaaggaggagatcctgaaggccttcaagctgtttgatgatgatgagaccgggaagatctccttcaagaacctgaagagggtggccaaggagctgggggagaacctgacagatgaggagctgcaggagatgattgatgaagctgacagagatggagatggagaggtgtctgagcaggagttcctgcgcatcatgaagaagaccagcctgtactag

SEQ ID NO: 147016 - DNA, 378 bp, Artificial Sequence
  Description of Artificial Sequence: Synthetic coding sequence
atggccatgcaggccgccaagagggccaacatccggctgcccccagaggtgaaccgcatcctgtacatccggaacctgccctacaagatcacagctgaggagatgtatgacatctttgggaagtatggccccatccggcagatccgggtgggcaacaccccagagacccggggcacagcctacgtggtgtatgaggacatctttgatgccaagaatgcctgtgaccacctgagcggcttcaacgtgtgcaaccgctacctggtggtgctgtactacaatgccaacagagccttccagaagatggacaccaagaagaaggaggagcagctgaagctgctgaaggagaagtatggcatcaacacagatcctcccaagtag

SEQ ID NO: 147017 - DNA, 423 bp, Artificial Sequence
  Description of Artificial Sequence: Synthetic coding sequence
atgggccccaggagaagaagcaggaagccagaggcccccaggagaagaagccccagccccacccccaccccaggccccagccggcggggccccagcctgggcgccagcagccaccagcacagcagaagacggcagggctggctgaaggagatcaggaagctgcagaagagcacccacctgctgatcaggaagctgcccttcagccggctggcccgggagatctgtgtgaagttcacccggggcgtggacttcaactggcaggcccaggccctgctggccctgcaggaggccgctgaggccttcctggtgcacctgtttgaagatgcctacctgctgaccctgcacgccggccgggtgaccctcttccccaaggatgtgcagctggcccggcgcatccggggcctggaggagggcctgggctag

SEQ ID NO: 147018 - DNA, 1800 bp, Artificial Sequence
  Description of Artificial Sequence: Synthetic coding sequence
atgggccccaagaggcggcagctgaccttccgggagaagagccgcatcatccaggaggtggaggagaacccagacctgaggaagggggagatcgcccggcgcttcaacatcccccccagcaccctgagcaccatcctgaagaacaagagggccatcctggccagcgagaggaaatatggagtggccagcacctgcaggaagaccaacaagctgagcccctatgacaagctggagggcctgctgattgcctggttccagcagatccgggctgctggcctgcctgtgaagggcatcatcctgaaggagaaggccctgagaattgctgaggagctgggcatggatgacttcaccgccagcaatggctggctggaccgcttcagaagaagacatggagtggtgtcctgcagcggcgtggcccgggcccgggccagaaatgctgcccccaggaccccagctgccccagccagccctgctgctgtgcccagcgagggcagcggcggcagcaccaccggctggagggcccgggaggagcagcccccatctgtggccgagggctacgccagccaggatgtgttttctgccacagagaccagcctgtggtatgacttcctgcctgaccaggccgccggcctgtgtggaggagatggccggccccggcaggccacccagaggctgtctgtgctgctgtgtgccaatgctgatggcagcgagaagctgccccccctggtggccggcaagagcgccaagccccgggccggccaggccggcctgccctgtgactacacagccaacagcaagggcggcgtgaccacccaggccctggccaagtacctgaaggccctggacaccaggatggctgctgagagccggcgggtgctgctgctggccggccgcctggccgcccagagcctggacaccagcggcctgcggcacgtgcagctggccttcttccccccaggcaccgtgcaccccctggagcggggcgtggtgcagcaggtgaagggccactaccggcaggccatgctgctgaaggccatggccgccctggagggccaggaccccagcggcctgcagctgggcctgacagaggccctgcactttgtggccgccgcctggcaggccgtggagcccagcgacattgctgcctgcttccgggaggccggctttggaggcggccccaatgccaccatcaccaccagcctgaagtctgagggggaggaggaggaggaggaggaggaggaggaggaggaggaggagggggagggggaggaggaggaggaggagggggaggaggaggaggaggagggcggggagggggaggagctgggggaggaggaggaggtggaggaggagggagatgtggacagtgatgaggaggaggaggaggatgaggagagcagcagcgagggcctggaggccgaggactgggcccagggcgtggtggaggccggcggcagctttggagcctacggggcccaggaggaggcccagtgccccaccctgcacttcctggagggcggggaggacagcgacagcgacagcgaggaggaggatgatgaggaggaggatgatgaagatgaagatgatgatgatgatgaggaggatggagatgaggtgcctgtgcccagctttggagaggccatggcctactttgccatggtgaagcgctacctgaccagcttccccattgatgacagagtgcagagccacatcctgcacctggagcatgacctggtgcacgtgaccaggaagaaccacgcccggcaggccggcgtgcggggcctgggccaccagagctag

SEQ ID NO: 147019 - DNA, 417 bp, Artificial Sequence
  Description of Artificial Sequence: Synthetic coding sequence
gaagatgaggagagcagcagcgagggcctggaggccgaggactgggcccagggcgtggtggaggccggcggcagctttggagcctatggagcccaggaggaggcccagtgccccaccctgcacttcctggagggcggagaagattctgacagcgacagcgaggaggaggatgatgaggaggaggatgatgaagatgaagatgatgatgatgatgaagaagatggagatgaggtgcctgtgcccagctttggagaggccatggcctactttgccatggtgaagcgctacctgaccagcttccccattgatgacagagtgcagagccacatcctgcacctggagcatgacctggtgcacgtgaccaggaagaaccacgcccggcaggccggcgtgcggggcctgggccaccagagctag

SEQ ID NO: 147020 - DNA, 2832 bp, Artificial Sequence
  Description of Artificial Sequence: Synthetic coding sequence
atggccgccagcggcctggaccacctgaagaatggctacagaagacgcttctgccggcccagccgggcccgggacatcaacacagagcagggccagaatgtgctggagatcctgcaggactgctttgaggagaagagcctggccaatgacttcagcaccaacagcaccaagtctgtgcccaacagcaccaggaagatcaaggacacctgcatccagagccccagcaaagaatgccagaagagccaccccaagtctgtgcctgtgagcagcaagaagaaggaggccagcctgcagtttgtggtggagcccagcgaggccaccaacagatctgtgcaggcccacgaggtgcaccagaagatcctggccacagatgtgagcagcaagaacaccccagacagcaagaagatcagcagcaggaacatcaatgaccaccacagcgaggctgatgaggagttctacctgtctgtgggcagccccagcgtgctgctggatgccaagacctctgtgtcccagaatgtcatccccagcagcgcccagaagcgggagacctacacctttgaaaattctgtgaacatgctgcccagcagcacagaggtgtctgtgaagaccaagaagaggctgaactttgatgacaaggtgatgctgaagaagattgaaattgacaacaaggtgtctgatgaggaggacaagaccagcgagggccaggagaggaagcccagcggcagcagccagaaccgcatccgggacagtgaatatgagatccagaggcaggccaagaagagcttcagcaccctcttcctggagaccgtgaagaggaagtctgagagcagccccatcgtgagacatgctgccacagccccaccccacagctgccccccagatgacaccaagctgattgaagatgagttcatcattgatgaaagtgaccagagctttgccagccgctcctggatcaccatccccaggaaggccggcagcctgaagcagaggaccatcagccctgctgagagcacagccctgctgcagggcaggaagagccgggagaagcaccacaacatcctgcccaagaccctggccaatgacaagcacagccacaagccccaccctgtggagaccagccagcccagcgacaagacagtgctggacaccagctatgccctgattggagaaacagtgaacaactaccgcagcaccaagtatgagatgtacagcaagaatgctgagaagcccagccgcagcaagaggaccatcaagcagaagcagaggaggaagttcatggccaagccagctgaggagcagctggatgtgggccagagcaaggatgagaacatccacaccagccacatcacccaggatgagttccagaggaacagcgacaggaacatggaggagcacgaggagatgggaaatgactgtgtgtccaagaagcagatgcctcctgtgggcagcaagaagagcagcaccaggaaggacaaggaggagagcaagaagaagcgcttcagcagcgagagcaagaacaagctggtgcctgaggaggtgaccagcacagtgaccaagagccgccgcatcagcagaagacccagcgactggtgggtggtgaagtctgaggagagccctgtgtacagcaacagctctgtgagaaatgagctgcccatgcaccacaacagcagcaggaagagcaccaagaagaccaaccagagcagcaagaacatcaggaagaagaccatccccctgaagaggcagaagacagccaccaagggcaaccagagggtgcagaagttcctgaatgctgagggcagcggcggcatcgtgggccatgatgagatcagccgctgcagcctgtctgagcccctggagagtgatgaagctgacctggccaagaagaagaacctggactgcagccgcagcaccaggagcagcaagaatgaagacaacatcatgacagcccagaatgtgcccctgaagccccagaccagcggctacacctgcaacatccccacagagagcaacctggacagcggggagcacaagacctctgtgctggaggagagcggccccagccggctgaacaacaactacctgatgtctgggaagaatgatgtggatgatgaggaggtgcacggcagcagtgatgacagcaagcagagcaaggtgatccccaagaaccgcatccaccacaagctggtgctgcccagcaacacccccaacgtgcggaggaccaagaggacccggctgaagcccctggagtactggagaggagagagaattgactaccagggccggcccagcggcggcttcgtcatctctggagtgctgagcccagacaccatcagcagcaagaggaaggccaaggaaaatattggcaaggtgaacaagaagagcaacaagaagaggatctgcctggacaatgatgagaggaagaccaacctgatggtgaacctgggcatccccctgggggaccccctgcagcccaccagggtgaaggaccctgagacccgggagatcatcctgatggacctggtgcggccccaggacacctaccagttctttgtgaagcatggagagctgaaggtgtacaagaccctggacacccccttcttcagcacaggcaagctgatcctgggcccccaggaggagaagggcaagcagcacgtgggccaggacatcctggtgttctacgtgaactttggagacctgctgtgcaccctgcacgagaccccctacatcctgagcactggagacagcttctacgtgcccagcggcaactactacaacatcaagaacctgagaaatgaggagagcgtgctgctcttcacccagatcaagaggtag

SEQ ID NO: 147021 - DNA, 8106 bp, Artificial Sequence
  Description of Artificial Sequence: Synthetic coding sequence
atggccgaggagggcgctgtggccgtgtgtgtgcgggtgcggcccctgaacagccgggaggagagcctgggggagacagcccaggtgtactggaagacagacaacaacgtcatctaccaggtggatggcagcaagagcttcaactttgacagagtcttccacggcaatgagaccaccaagaatgtgtatgaggagattgctgcccccatcattgattctgccatccagggctacaacggcaccatctttgcctacggccagacagccagcggcaagacctacaccatgatgggcagcgaggaccacctgggcgtcatcccccgggccatccatgacatcttccagaagatcaagaagttcccagaccgggagttcctgctgcgggtgtcctacatggagatctacaatgagaccatcacagacctgctgtgtggcacccagaagatgaagcccctcatcatccgggaggatgtgaacagaaatgtgtatgtggccgacctgacagaggaggtggtgtacaccagcgagatggccctgaagtggatcaccaagggggagaagagccgccactatggagagaccaagatgaaccagaggagcagccgcagccacaccatcttcaggatgatcctggagagccgggagaagggggagcccagcaactgtgagggctctgtgaaggtgagccacctgaacctggtggacctggccggcagcgagcgggccgcccagacaggagctgctggggtgcggctgaaggagggctgcaacatcaacagaagcctcttcatcctgggccaggtgatcaagaagctgagtgatggccaggtgggcggcttcatcaactacagagacagcaagctgacccgcatcctgcagaacagcctgggcggcaatgccaagacccgcatcatctgcaccatcacccctgtgtcctttgatgagaccctgacagccctgcagtttgccagcacagccaagtacatgaagaacaccccctacgtgaatgaggtgtccacagatgaggccctgctgaagcgctacaggaaggagatcatggacctgaagaagcagctggaggaggtgtccctggagacccgggcccaggccatggagaaggaccagctggcccagctgctggaggagaaggacctgctgcagaaggtgcagaatgagaagattgagaacctgaccaggatgctggtgaccagcagcagcctgaccctgcagcaggagctgaaggccaagaggaagagaagagtgacctggtgcctgggcaagatcaacaagatgaagaacagcaactatgctgaccagttcaacatccccaccaacatcaccaccaagacccacaagctgagcatcaacctgctgcgggagattgatgagagcgtgtgcagcgagagtgatgtgttcagcaacaccctggacaccctgtctgaaattgagtggaacccagccaccaagctgctgaaccaggagaacatcgagagcgagctgaacagcctgcgggctgactatgacaacctggtgctggactatgagcagctgaggacagagaaggaggagatggagctgaagctgaaggagaagaatgacctggatgaatttgaggccctggagaggaagaccaagaaggaccaggagatgcagctgatccacgagatcagcaacctgaagaacctggtgaagcacgccgaggtgtacaaccaggacctggagaatgagctgagcagcaaggtggagctgctgcgggagaaggaggaccagatcaagaagctgcaggagtacatcgacagccagaagctggagaacatcaagatggacctgagctacagcctggagagcattgaggaccccaagcagatgaagcagaccctgtttgatgctgagaccgtggccctggatgccaagcgggagagcgccttcctgcggtctgagaacctggagctgaaggagaagatgaaggagctggccaccacctacaagcagatggagaatgacatccagctgtaccagagccagctggaggccaagaagaagatgcaggtggacctggagaaggagctgcagagcgccttcaatgagatcaccaagctgaccagcctgattgatggcaaggtgcccaaggacctgctgtgcaacctggagctggagggcaagatcacagacctgcagaaggagctgaacaaggaggtggaggagaatgaggccctgcgggaggaggtgatcctgctgtctgagctgaagagcctgcccagcgaggtggagcggctgaggaaggagatccaggacaagtctgaggagctgcacatcatcaccagcgagaaggacaagctgttcagcgaggtggtgcacaaggagagccgggtgcagggcctgctggaggagatcggcaagaccaaggatgacctggccaccacccagagcaactacaagagcacagaccaggagttccagaacttcaagaccctgcacatggactttgagcagaagtacaagatggtgctggaggagaatgaaagaatgaaccaggagatcgtgaacctgagcaaggaggcccagaagtttgacagcagcctgggcgccctgaagacagagctgagctacaagacccaggagctgcaggagaagacccgggaggtgcaggagcggctgaatgagatggagcagctgaaggagcagctggagaacagagacagcaccctgcagacagtggagcgggagaagaccctcatcacagagaagctgcagcagaccctggaggaggtgaagaccctgacccaggagaaggatgacctgaagcagctgcaggagagcctgcagatcgagcgggaccagctgaagagtgacatccatgacacagtgaacatgaacatcgacacccaggagcagctgagaaatgccctggagagcctgaagcagcaccaggagaccatcaacaccctgaagagcaagatcagcgaggaggtgtccaggaacctgcacatggaggagaacacaggagagaccaaggatgagttccagcagaagatggtgggcatcgacaagaagcaggacctggaggccaagaacacccagaccctgacagcagatgtgaaggacaatgagatcatcgagcagcagaggaagatcttcagcctcatccaggagaagaatgagctgcagcagatgctggagagcgtgattgctgagaaggagcagctgaagacagacctgaaggaaaatattgagatgaccatcgagaaccaggaggagctgcggctgctgggagatgagctgaagaagcagcaggagatcgtggcccaggagaagaaccacgccatcaagaaggagggggagctgagcaggacctgtgaccggctggccgaggtggaggagaagctgaaggagaagagccagcagctgcaggagaagcagcagcagctgctgaatgtgcaggaggagatgtctgagatgcagaagaagatcaatgaaattgagaacctgaagaatgagctgaagaacaaggagctgaccctggagcacatggagacagagcggctggagctggcccagaagctgaatgaaaattatgaggaggtgaagagcatcaccaaggagaggaaggtgctgaaggagctgcagaagagctttgaaacagagcgggaccacctgcggggctacatccgggagattgaggccaccggcctgcagaccaaggaggagctgaagatcgcccacatccacctgaaggagcaccaggagaccattgatgagctgcggcgctctgtgtctgagaagacagcccagatcatcaacacccaggacctggagaagagccacaccaagctgcaggaggagatccctgtgctgcacgaggagcaggagctgctgcccaacgtgaaggaggtgtctgagacccaggagaccatgaatgagctggagctgctgacagagcagagcaccaccaaggacagcaccaccctggcccgcatcgagatggagcggctgcggctgaatgagaagttccaggagagccaggaggagatcaagagcctgaccaaggagcgggacaacctgaagaccatcaaggaggccctggaggtgaagcatgaccagctgaaggagcacatccgggagaccctggccaagatccaggagagccagagcaagcaggagcagagcctgaacatgaaggagaaggacaatgagaccaccaagatcgtgtctgagatggagcagttcaagcccaaggacagcgccctgctgagaattgaaattgagatgctgggcctgagcaagaggctgcaggagagccatgatgagatgaagtctgtggccaaggagaaggatgacctgcagaggctgcaggaggtgctgcagagcgagagtgaccagctgaaggagaacatcaaggagatcgtggccaagcacctggagacagaggaggagctgaaggtggcccactgctgcctgaaggagcaggaggagaccatcaatgagctgcgggtgaacctgtctgagaaggagacagagatcagcaccatccagaagcagctggaggccatcaatgacaagctgcagaacaagatccaggagatctatgagaaggaggagcagttcaacatcaagcagatcagcgaggtgcaggagaaggtgaatgagctgaagcagttcaaggagcacaggaaggccaaggacagcgccctgcagagcattgagagcaagatgctggagctgaccaaccggctgcaggagagccaggaggagatccagatcatgatcaaggagaaggaggagatgaagagggtgcaggaggccctgcagatcgagcgggaccagctgaaggagaacaccaaggagatcgtggccaagatgaaggagagccaggagaaggagtaccagttcctgaagatgacagctgtgaatgagacccaggagaagatgtgtgaaattgagcacctgaaggagcagtttgagacccagaagctgaacctggagaacattgaaacagagaacatccggctgacccagatcctgcacgagaacctggaggagatgaggtctgtgaccaaggagagagatgacctgcggtctgtggaggagaccctgaaggtggagcgggaccagctgaaggagaacctgcgggagaccatcacccgggacctggagaagcaggaggagctgaagatcgtgcacatgcacctgaaggagcaccaggagaccatcgacaagctgcggggcatcgtgtctgagaagaccaatgagatcagcaacatgcagaaggacctggagcacagcaatgatgccctgaaggcccaggacctgaagatccaggaggagctgcgcatcgcccacatgcacctgaaggagcagcaggagaccatcgacaagctgcggggcatcgtgtctgagaagacagacaagctgagcaacatgcagaaggacctggagaacagcaatgccaagctgcaggagaagatccaggagctgaaggccaatgagcaccagctgatcaccctgaagaaggatgtgaatgagacccagaagaaggtgtctgagatggagcagctgaagaagcagatcaaggaccagagcctgaccctgagcaagctggagattgagaacctgaacctggcccagaagctgcacgagaacctggaggagatgaagtctgtgatgaaggagcgggacaacctgcggcgggtggaggagaccctgaagctggagcgggaccagctgaaggagagcctgcaggagaccaaggcccgggacctggagatccagcaggagctgaagacagccaggatgctgagcaaggagcacaaggagaccgtggacaagctgcgggagaagatcagcgagaagaccatccagatcagtgacatccagaaggacctggacaagagcaaggatgagctgcagaagaagatccaggagctgcagaagaaggagctgcagctgctgcgggtgaaggaggatgtgaacatgagccacaagaagatcaatgagatggagcagctgaagaagcagtttgaggcccagaacctgtccatgcagagcgtgaggatggacaacttccagctgaccaagaagctgcacgagagcctggaggagatccgcatcgtggccaaggagagagatgagctgcggcgcatcaaggagagcctgaagatggagcgggaccagttcatcgccaccctgcgggagatgattgcccgggaccggcagaaccaccaggtgaagccagagaagaggctgctgagtgatggccagcagcacctgacagagagcctgcgggagaagtgcagccgcatcaaggagctgctgaagcgctacagcgagatggatgaccactatgaatgtctgaaccggctgagcctggacctggagaaggagattgagttccagaaggagctgtccatgagggtgaaggccaacctgagcctgccctacctgcagaccaagcacatcgagaagctgttcaccgccaaccagcgctgcagcatggagttccaccgcatcatgaagaagctgaagtatgtgctgtcctatgtgaccaagatcaaggaggagcagcacgagagcatcaacaagtttgagatggacttcattgatgaggtggagaagcagaaggagctgctgatcaagatccagcacctgcagcaggactgtgatgtgcccagccgggagctgcgggacctgaagctgaaccagaacatggacctgcacatcgaggagatcctgaaggacttcagcgagagcgagttccccagcatcaagacagagttccagcaggtgctgagcaacaggaaggagatgacccagttcctggaggagtggctgaacaccaggtttgacatcgagaagctgaagaatggcatccagaaggaaaatgaccgcatctgccaggtgaacaacttcttcaacaaccgcatcatcgccatcatgaatgaaagcacagaatttgaggagaggtctgccaccatcagcaaggagtgggagcaggacctgaagagcctgaaggagaagaatgagaagctgttcaagaactaccagaccctgaagaccagcctggccagcggggcccaggtgaaccccaccacccaggacaacaagaacccccacgtgaccagccgggccacccagctgaccacagagaagatccgggagctggagaacagcctgcacgaggccaaggagagcgccatgcacaaggagagcaagatcatcaagatgcagaaggagctggaggtgaccaatgacatcatcgccaagctgcaggccaaggtgcatgagagcaacaagtgcctggagaagaccaaggagaccatccaggtgctgcaggacaaggtggccctgggcgccaagccctacaaggaggagattgaggacctgaagatgaagctggtgaagattgacctggagaagatgaagaatgccaaggagtttgagaaggagatcagcgccaccaaggccaccgtggagtaccagaaggaggtgatccggctgctgcgggagaacctgcggcgcagccagcaggcccaggacaccagcgtcatcagcgagcacacagacccccagcccagcaacaagcccctgacctgtggcggcggcagcggcatcgtgcagaacaccaaggccctgatcctgaagtctgagcacatccggctggagaaggagatcagcaagctgaagcagcagaatgagcagctgatcaagcagaagaatgagctgctgagcaacaaccagcacctgagcaatgaggtgaagacctggaaggagaggaccctgaagcgggaggcccacaagcaggtgacctgtgagaacagccccaagagccccaaggtgactggaacagccagcaagaagaagcagatcacccccagccagtgcaaggagaggaacctgcaggaccctgtgcccaaggagagccccaagagctgcttctttgacagccgcagcaagagcctgcccagcccccaccctgtgcgctactttgacaacagcagcctgggcctgtgcccagaggtgcagaatgctggagctgagagcgtggacagccagcccggcccctggcacgccagcagcggcaaggatgtgcctgagtgcaagacccagtag

SEQ ID NO: 147022 - DNA, 7743 bp, Artificial Sequence
  Description of Artificial Sequence: Synthetic coding sequence
atggccgaggagggcgctgtggccgtgtgtgtgcgggtgcggcccctgaacagccgggaggagagcctgggggagacagcccaggtgtactggaagacagacaacaacgtcatctaccaggtggatggcagcaagagcttcaactttgacagagtcttccacggcaatgagaccaccaagaatgtgtatgaggagattgctgcccccatcattgattctgccatccagggctacaacggcaccatctttgcctacggccagacagccagcggcaagacctacaccatgatgggcagcgaggaccacctgggcgtcatcccccgggccatccatgacatcttccagaagatcaagaagttcccagaccgggagttcctgctgcgggtgtcctacatggagatctacaatgagaccatcacagacctgctgtgtggcacccagaagatgaagcccctcatcatccgggaggatgtgaacagaaatgtgtatgtggccgacctgacagaggaggtggtgtacaccagcgagatggccctgaagtggatcaccaagggggagaagagccgccactatggagagaccaagatgaaccagaggagcagccgcagccacaccatcttcaggatgatcctggagagccgggagaagggggagcccagcaactgtgagggctctgtgaaggtgagccacctgaacctggtggacctggccggcagcgagcgggccgcccagacaggagctgctggggtgcggctgaaggagggctgcaacatcaacagaagcctcttcatcctgggccaggtgatcaagaagctgagtgatggccaggtgggcggcttcatcaactacagagacagcaagctgacccgcatcctgcagaacagcctgggcggcaatgccaagacccgcatcatctgcaccatcacccctgtgtcctttgatgagaccctgacagccctgcagtttgccagcacagccaagtacatgaagaacaccccctacgtgaatgaggtgtccacagatgaggccctgctgaagcgctacaggaaggagatcatggacctgaagaagcagctggaggaggtgtccctggagacccgggcccaggccatggagaaggaccagctggcccagctgctggaggagaaggacctgctgcagaaggtgcagaatgagaagattgagaacctgaccaggatgctggtgaccagcagcagcctgaccctgcagcaggagctgaaggccaagaggaagagaagagtgacctggtgcctgggcaagatcaacaagatgaagaacagcaactatgctgaccagttcaacatccccaccaacatcaccaccaagacccacaagctgagcatcaacctgctgcgggagattgatgagagcgtgtgcagcgagagtgatgtgttcagcaacaccctggacaccctgtctgaaattgagtggaacccagccaccaagctgctgaaccaggagaacatcgagagcgagctgaacagcctgcgggctgactatgacaacctggtgctggactatgagcagctgaggacagagaaggaggagatggagctgaagctgaaggagaagaatgacctggatgaatttgaggccctggagaggaagaccaagaaggaccaggagaatgagctgagcagcaaggtggagctgctgcgggagaaggaggaccagatcaagaagctgcaggagtacatcgacagccagaagctggagaacatcaagatggacctgagctacagcctggagagcattgaggaccccaagcagatgaagcagaccctgtttgatgctgagaccgtggccctggatgccaagcgggagagcgccttcctgcggtctgagaacctggagctgaaggagaagatgaaggagctggccaccacctacaagcagatggagaatgacatccagctgtaccagagccagctggaggccaagaagaagatgcaggtggacctggagaaggagctgcagagcgccttcaatgagatcaccaagctgaccagcctgattgatggcaaggtgcccaaggacctgctgtgcaacctggagctggagggcaagatcacagacctgcagaaggagctgaacaaggaggtggaggagaatgaggccctgcgggaggaggtgatcctgctgtctgagctgaagagcctgcccagcgaggtggagcggctgaggaaggagatccaggacaagtctgaggagctgcacatcatcaccagcgagaaggacaagctgttcagcgaggtggtgcacaaggagagccgggtgcagggcctgctggaggagatcggcaagaccaaggatgacctggccaccacccagagcaactacaagagcacagaccaggagttccagaacttcaagaccctgcacatggactttgagcagaagtacaagatggtgctggaggagaatgaaagaatgaaccaggagatcgtgaacctgagcaaggaggcccagaagtttgacagcagcctgggcgccctgaagacagagctgagctacaagacccaggagctgcaggagaagacccgggaggtgcaggagcggctgaatgagatggagcagctgaaggagcagctggagaacagagacagcaccctgcagacagtggagcgggagaagaccctcatcacagagaagctgcagcagaccctggaggaggtgaagaccctgacccaggagaaggatgacctgaagcagctgcaggagagcctgcagatcgagcgggaccagctgaagagtgacatccatgacacagtgaacatgaacatcgacacccaggagcagctgagaaatgccctggagagcctgaagcagcaccaggagaccatcaacaccctgaagagcaagatcagcgaggaggtgtccaggaacctgcacatggaggagaacacaggagagaccaaggatgagttccagcagaagatggtgggcatcgacaagaagcaggacctggaggccaagaacacccagaccctgacagcagatgtgaaggacaatgagatcatcgagcagcagaggaagatcttcagcctcatccaggagaagaatgagctgcagcagatgctggagagcgtgattgctgagaaggagcagctgaagacagacctgaaggagaacatcgagatgaccatcgagaaccaggaggagctgcggctgctgggagatgagctgaagaagcagcaggagatcgtggcccaggagaagaaccacgccatcaagaaggagggggagctgagcaggacctgtgaccggctggccgaggtggaggagaagctgaaggagaagagccagcagctgcaggagaagcagcagcagctgctgaatgtgcaggaggagatgtctgagatgcagaagaagatcaatgaaattgagaacctgaagaatgagctgaagaacaaggagctgaccctggagcacatggagacagagcggctggagctggcccagaagctgaatgaaaattatgaggaggtgaagagcatcaccaaggagaggaaggtgctgaaggagctgcagaagagctttgaaacagagcgggaccacctgcggggctacatccgggagattgaggccaccggcctgcagaccaaggaggagctgaagatcgcccacatccacctgaaggagcaccaggagaccattgatgagctgcggcgctctgtgtctgagaagacagcccagatcatcaacacccaggacctggagaagagccacaccaagctgcaggaggagatccctgtgctgcacgaggagcaggagctgctgcccaacgtgaaggaggtgtctgagacccaggagaccatgaatgagctggagctgctgacagagcagagcaccaccaaggacagcaccaccctggccagaattgagatggagcggctgcggctgaatgagaagttccaggagagccaggaggagatcaagagcctgaccaaggagcgggacaacctgaagaccatcaaggaggccctggaggtgaagcatgaccagctgaaggagcacatccgggagaccctggccaagatccaggagagccagagcaagcaggagcagagcctgaacatgaaggagaaggacaatgagaccaccaagatcgtgtctgagatggagcagttcaagcccaaggacagcgccctgctgcgcatcgagattgagatgctgggcctgagcaagaggctgcaggagagccatgatgagatgaagtctgtggccaaggagaaggatgacctgcagaggctgcaggaggtgctgcagagcgagagtgaccagctgaaggagaacatcaaggagatcgtggccaagcacctggagacagaggaggagctgaaggtggcccactgctgcctgaaggagcaggaggagaccatcaatgagctgcgggtgaacctgtctgagaaggagacagagatcagcaccatccagaagcagctggaggccatcaatgacaagctgcagaacaagatccaggagatctatgagaaggaggagcagttcaacatcaagcagatcagcgaggtgcaggagaaggtgaatgagctgaagcagttcaaggagcacaggaaggccaaggacagcgccctgcagagcattgagagcaagatgctggagctgaccaaccggctgcaggagagccaggaggagatccagatcatgatcaaggagaaggaggagatgaagagggtgcaggaggccctgcagatcgagcgggaccagctgaaggagaacaccaaggagatcgtggccaagatgaaggagagccaggagaaggagtaccagttcctgaagatgacagctgtgaatgagacccaggagaagatgtgtgaaattgagcacctgaaggagcagtttgagacccagaagctgaacctggagaacatcgagacagagaacatccggctgacccagatcctgcacgagaacctggaggagatgaggtctgtgaccaaggagagagatgacctgcggtctgtggaggagaccctgaaggtggagcgggaccagctgaaggagaacctgcgggagaccatcacccgggacctggagaagcaggaggagctgaagatcgtgcacatgcacctgaaggagcaccaggagaccatcgacaagctgcggggcatcgtgtctgagaagaccaatgagatcagcaacatgcagaaggacctggagcacagcaatgatgccctgaaggcccaggacctgaagatccaggaggagctgagaattgcccacatgcacctgaaggagcagcaggagaccatcgacaagctgcggggcatcgtgtctgagaagacagacaagctgagcaacatgcagaaggacctggagaacagcaatgccaagctgcaggagaagatccaggagctgaaggccaatgagcaccagctgatcaccctgaagaaggatgtgaatgagacccagaagaaggtgtctgagatggagcagctgaagaagcagatcaaggaccagagcctgaccctgagcaagctggagattgagaacctgaacctggcccagaagctgcacgagaacctggaggagatgaagtctgtgatgaaggagcgggacaacctgcggcgggtggaggagaccctgaagctggagcgggaccagctgaaggagagcctgcaggagaccaaggcccgggacctggagatccagcaggagctgaagacagccaggatgctgagcaaggagcacaaggagaccgtggacaagctgcgggagaagatcagcgagaagaccatccagatcagtgacatccagaaggacctggacaagagcaaggatgagctgcagaagaagcaggaccggcagaaccaccaggtgaagccagagaagaggctgctgagtgatggccagcagcacctgacagagagcctgcgggagaagtgcagccgcatcaaggagctgctgaagcgctacagcgagatggatgaccactatgagtgcctgaaccggctgagcctggacctggagaaggagattgagttccagaaggagctgtccatgagggtgaaggccaacctgagcctgccctacctgcagaccaagcacatcgagaagctgttcaccgccaaccagcgctgcagcatggagttccaccgcatcatgaagaagctgaagtatgtgctgtcctatgtgaccaagatcaaggaggagcagcacgagagcatcaacaagtttgagatggacttcattgatgaggtggagaagcagaaggagctgctgatcaagatccagcacctgcagcaggactgtgatgtgcccagccgggagctgcgggacctgaagctgaaccagaacatggacctgcacatcgaggagatcctgaaggacttcagcgagagcgagttccccagcatcaagacagagttccagcaggtgctgagcaacaggaaggagatgacccagttcctggaggagtggctgaacaccaggtttgatattgagaagctgaagaatggcatccagaaggaaaatgaccgcatctgccaggtgaacaacttcttcaacaaccgcatcatcgccatcatgaatgaaagcacagaatttgaggagaggtctgccaccatcagcaaggagtgggagcaggacctgaagagcctgaaggagaagaatgagaagctgttcaagaactaccagaccctgaagaccagcctggccagcggggcccaggtgaaccccaccacccaggacaacaagaacccccacgtgaccagccgggccacccagctgaccacagagaagatccgggagctggagaacagcctgcacgaggccaaggagagcgccatgcacaaggagagcaagatcatcaagatgcagaaggagctggaggtgaccaatgacatcatcgccaagctgcaggccaaggtgcatgagagcaacaagtgcctggagaagaccaaggagaccatccaggtgctgcaggacaaggtggccctgggcgccaagccctacaaggaggagattgaggacctgaagatgaagctggtgaagattgacctggagaagatgaagaatgccaaggagtttgagaaggagatcagcgccaccaaggccaccgtggagtaccagaaggaggtgatccggctgctgcgggagaacctgcggcgcagccagcaggcccaggacaccagcgtcatcagcgagcacacagacccccagcccagcaacaagcccctgacctgtggcggcggcagcggcatcgtgcagaacaccaaggccctgatcctgaagtctgagcacatccggctggagaaggagatcagcaagctgaagcagcagaatgagcagctgatcaagcagaagaatgagctgctgagcaacaaccagcacctgagcaatgaggtgaagacctggaaggagaggaccctgaagcgggaggcccacaagcaggtgacctgtgagaacagccccaagagccccaaggtgactggaacagccagcaagaagaagcagatcacccccagccagtgcaaggagaggaacctgcaggaccctgtgcccaaggagagccccaagagctgcttctttgacagccgcagcaagagcctgcccagcccccaccctgtgcgctactttgacaacagcagcctgggcctgtgcccagaggtgcagaatgctggagctgagagcgtggacagccagcccggcccctggcacgccagcagcggcaaggatgtgcctgagtgcaagacccagtag

SEQ ID NO: 147023 - DNA, 7038 bp, Artificial Sequence
  Description of Artificial Sequence: Synthetic coding sequence
atggccgaggagggcgctgtggccgtgtgtgtgcgggtgcggcccctgaacagccgggaggagagcctgggggagacagcccaggtgtactggaagacagacaacaacgtcatctaccaggtggatggcagcaagagcttcaactttgacagagtcttccacggcaatgagaccaccaagaatgtgtatgaggagattgctgcccccatcattgattctgccatccagggctacaacggcaccatctttgcctacggccagacagccagcggcaagacctacaccatgatgggcagcgaggaccacctgggcgtcatcccccgggccatccatgacatcttccagaagatcaagaagttcccagaccgggagttcctgctgcgggtgtcctacatggagatctacaatgagaccatcacagacctgctgtgtggcacccagaagatgaagcccctcatcatccgggaggatgtgaacagaaatgtgtatgtggccgacctgacagaggaggtggtgtacaccagcgagatggccctgaagtggatcaccaagggggagaagagccgccactatggagagaccaagatgaaccagaggagcagccgcagccacaccatcttcaggatgatcctggagagccgggagaagggggagcccagcaactgtgagggctctgtgaaggtgagccacctgaacctggtggacctggccggcagcgagcgggccgcccagacaggagctgctggggtgcggctgaaggagggctgcaacatcaacagaagcctcttcatcctgggccaggtgatcaagaagctgagtgatggccaggtgggcggcttcatcaactacagagacagcaagctgacccgcatcctgcagaacagcctgggcggcaatgccaagacccgcatcatctgcaccatcacccctgtgtcctttgatgagaccctgacagccctgcagtttgccagcacagccaagtacatgaagaacaccccctacgtgaatgaggtgtccacagatgaggccctgctgaagcgctacaggaaggagatcatggacctgaagaagcagctggaggaggtgtccctggagacccgggcccaggccatggagaaggaccagctggcccagctgctggaggagaaggacctgctgcagaaggtgcagaatgagaagattgagaacctgaccaggatgctggtgaccagcagcagcctgaccctgcagcaggagctgaaggccaagaggaagagaagagtgacctggtgcctgggcaagatcaacaagatgaagaacagcaactatgctgaccagttcaacatccccaccaacatcaccaccaagacccacaagctgagcatcaacctgctgcgggagattgatgagagcgtgtgcagcgagagtgatgtgttcagcaacaccctggacaccctgtctgaaattgagtggaacccagccaccaagctgctgaaccaggagaacatcgagagcgagctgaacagcctgcgggctgactatgacaacctggtgctggactatgagcagctgaggacagagaaggaggagatggagctgaagctgaaggagaagaatgacctggatgaatttgaggccctggagaggaagaccaagaaggaccaggagatgcagctgatccacgagatcagcaacctgaagaacctggtgaagcacgccgaggtgtacaaccaggacctggagaatgagctgagcagcaaggtggagctgctgcgggagaaggaggaccagatcaagaagctgcaggagtacatcgacagccagaagctggagaacatcaagatggacctgagctacagcctggagagcattgaggaccccaagcagatgaagcagaccctgtttgatgctgagaccgtggccctggatgccaagcgggagagcgccttcctgcggtctgagaacctggagctgaaggagaagatgaaggagctggccaccacctacaagcagatggagaatgacatccagctgtaccagagccagctggaggccaagaagaagatgcaggtggacctggagaaggagctgcagagcgccttcaatgagatcaccaagctgaccagcctgattgatggcaaggtgcccaaggacctgctgtgcaacctggagctggagggcaagatcacagacctgcagaaggagctgaacaaggaggtggaggagaatgaggccctgcgggaggaggtgatcctgctgtctgagctgaagagcctgcccagcgaggtggagcggctgaggaaggagatccaggacaagtctgaggagctgcacatcatcaccagcgagaaggacaagctgttcagcgaggtggtgcacaaggagagccgggtgcagggcctgctggaggagatcggcaagaccaaggatgacctggccaccacccagagcaactacaagagcacagaccaggagttccagaacttcaagaccctgcacatggactttgagcagaagtacaagatggtgctggaggagaatgaaagaatgaaccaggagatcgtgaacctgagcaaggaggcccagaagtttgacagcagcctgggcgccctgaagacagagctgagctacaagacccaggagctgcaggagaagacccgggaggtgcaggagcggctgaatgagatggagcagctgaaggagcagctggagaacagagacagcaccctgcagacagtggagcgggagaagaccctcatcacagagaagctgcagcagaccctggaggaggtgaagaccctgacccaggagaaggatgacctgaagcagctgcaggagagcctgcagatcgagcgggaccagctgaagagtgacatccatgacacagtgaacatgaacatcgacacccaggagcagctgagaaatgccctggagagcctgaagcagcaccaggagaccatcaacaccctgaagagcaagatcagcgaggaggtgtccaggaacctgcacatggaggagaacacaggagagaccaaggatgagttccagcagaagatggtgggcatcgacaagaagcaggacctggaggccaagaacacccagaccctgacagcagatgtgaaggacaatgagatcatcgagcagcagaggaagatcttcagcctcatccaggagaagaatgagctgcagcagatgctggagagcgtgattgctgagaaggagcagctgaagacagacctgaaggaaaatattgagatgaccatcgagaaccaggaggagctgcggctgctgggagatgagctgaagaagcagcaggagatcgtggcccaggagaagaaccacgccatcaagaaggagggggagctgagcaggacctgtgaccggctggccgaggtggaggagaagctgaaggagaagagccagcagctgcaggagaagcagcagcagctgctgaatgtgcaggaggagatgtctgagatgcagaagaagatcaatgaaattgagaacctgaagaatgagctgaagaacaaggagctgaccctggagcacatggagacagagcggctggagctggcccagaagctgaatgaaaattatgaggaggtgaagagcatcaccaaggagaggaaggtgctgaaggagctgcagaagagctttgaaacagagcgggaccacctgcggggctacatccgggagattgaggccaccggcctgcagaccaaggaggagctgaagatcgcccacatccacctgaaggagcaccaggagaccattgatgagctgcggcgctctgtgtctgagaagacagcccagatcatcaacacccaggacctggagaagagccacaccaagctgcaggaggagatccctgtgctgcacgaggagcaggagctgctgcccaacgtgaaggaggtgtctgagacccaggagaccatgaatgagctggagctgctgacagagcagagcaccaccaaggacagcaccaccctggcccgcatcgagatggagcggctgcggctgaatgagaagttccaggagagccaggaggagatcaagagcctgaccaaggagcgggacaacctgaagaccatcaaggaggccctggaggtgaagcatgaccagctgaaggagcacatccgggagaccctggccaagatccaggagagccagagcaagcaggagcagagcctgaacatgaaggagaaggacaatgagaccaccaagatcgtgtctgagatggagcagttcaagcccaaggacagcgccctgctgagaattgaaattgagatgctgggcctgagcaagaggctgcaggagagccatgatgagatgaagtctgtggccaaggagaaggatgacctgcagaggctgcaggaggtgctgcagagcgagagtgaccagctgaaggagaacatcaaggagatcgtggccaagcacctggagacagaggaggagctgaaggtggcccactgctgcctgaaggagcaggaggagaccatcaatgagctgcgggtgaacctgtctgagaaggagacagagatcagcaccatccagaagcagctggaggccatcaatgacaagctgcagaacaagatccaggagatctatgagaaggaggagcagttcaacatcaagcagatcagcgaggtgcaggagaaggtgaatgagctgaagcagttcaaggagcacaggaaggccaaggacagcgccctgcagagcattgagagcaagatgctggagctgaccaaccggctgcaggagagccaggaggagatccagatcatgatcaaggagaaggaggagatgaagagggtgcaggaggccctgcagatcgagcgggaccagctgaaggagaacaccaaggagatcgtggccaagatgaaggagagccaggagaaggagtaccagttcctgaagatgacagctgtgaatgagacccaggagaagatgtgtgaaattgagcacctgaaggagcagtttgagacccagaagctgaacctggagaacattgaaacagagaacatccggctgacccagatcctgcacgagaacctggaggagatgaggtctgtgaccaaggagagagatgacctgcggtctgtggaggagaccctgaaggtggagcgggaccagctgaaggagaacctgcgggagaccatcacccgggacctggagaagcaggaggagctgaagatcgtgcacatgcacctgaaggagcaccaggagaccatcgacaagctgcggggcatcgtgtctgagaagaccaatgagatcagcaacatgcagaaggacctggagcacagcaatgatgccctgaaggcccaggacctgaagatccaggaggagctgcgcatcgcccacatgcacctgaaggagcagcaggagaccatcgacaagctgcggggcatcgtgtctgagaagacagacaagctgagcaacatgcagaaggacctggagaacagcaatgccaagctgcaggagaagatccaggagctgaaggccaatgagcaccagctgatcaccctgaagaaggatgtgaatgagacccagaagaaggtgtctgagatggagcagctgaagaagcagatcaaggaccagagcctgaccctgagcaagctggagattgagaacctgaacctggcccagaagctgcacgagaacctggaggagatgaagtctgtgatgaaggagcgggacaacctgcggcgggtggaggagaccctgaagctggagcgggaccagctgaaggagagcctgcaggagaccaaggcccgggacctggagatccagcaggagctgaagacagccaggatgctgagcaaggagcacaaggagaccgtggacaagctgcgggagaagatcagcgagaagaccatccagatcagtgacatccagaaggacctggacaagagcaaggatgagctgcagaagaagatccaggagctgcagaagaaggagctgcagctgctgcgggtgaaggaggatgtgaacatgagccacaagaagatcaatgagatggagcagctgaagaagcagtttgaggcccagaacctgtccatgcagagcgtgaggatggacaacttccagctgaccaagaagctgcacgagagcctggaggagatccgcatcgtggccaaggagagagatgagctgcggcgcatcaaggagagcctgaagatggagcgggaccagttcatcgccaccctgcgggagatgattgcccgggaccggcagaaccaccaggtgaagccagagaagaggctgctgagtgatggccagcagcacctgacagagagcctgcgggagaagtgcagccgcatcaaggagctgctgaagcgctacagcgagatggatgaccactatgaatgtctgaaccggctgagcctggacctggagaaggagattgagttccaccgcatcatgaagaagctgaagtatgtgctgtcctatgtgaccaagatcaaggaggagcagcacgagagcatcaacaagtttgagatggacttcattgatgaggtggagaagcagaaggagctgctgatcaagatccagcacctgcagcaggactgtgatgtgcccagccgggagctgcgggacctgaagctgaaccagaacatggacctgcacatcgaggagatcctgaaggacttcagcgagagcgagttccccagcatcaagacagagttccagcaggtgctgagcaacaggaaggagatgacccagttcctggaggagtggctgaacaccaggtttgacatcgagaagctgaagaatggcatccagaaggaaaatgaccgcatctgccaggtgaacaacttcttcaacaaccgcatcatcgccatcatgaatgaaagcacagaatttgaggagaggtctgccaccatcagcaaggagtgggagcaggacctgaagagcctgaaggagaagaatgagaagctgttcaagaactaccagaccctgaagaccagcctggccagcggggcccaggtgaaccccaccacccaggacaacaagaacccccacgtgaccagccgggccacccagctgaccacagaatag

SEQ ID NO: 147024 - DNA, 9345 bp, Artificial Sequence
  Description of Artificial Sequence: Synthetic coding sequence
atgtcctgggccctggaggagtggaaggagggcctgcccacccgggccctgcagaagatccaggagctggagggccagctggacaagctgaagaaggagaagcagcagaggcagttccagctggacagcctggaggccgccctgcagaagcagaagcagaaggtggagaatgagaagacagagggcaccaacctgaagcgggagaaccagaggctgatggagatctgtgagagcctggagaagaccaagcagaagatcagccatgagctgcaggtgaaggagagccaggtgaacttccaggagggccagctgaacagcggcaagaagcagatcgagaagctggagcaggagctgaagcgctgcaagtctgagctggagaggagccagcaggccgcccagagcgcagatgtgtccctgaacccctgcaacaccccccagaagatcttcaccacccccctgacccccagccagtactacagcggcagcaaatatgaggacctgaaggagaagtacaacaaggaggtggaggagaggaagaggctggaggccgaggtgaaggccctgcaggccaagaaggccagccagaccctgccccaggccaccatgaaccaccgggacatcgcccggcaccaggccagcagctctgtgttctcctggcagcaggagaagacccccagccacctgagcagcaacagccagaggacccccatccggcgggacttcagcgccagctacttctctggagagcaggaggtgacccccagccgcagcaccctgcagatcggcaagagagatgccaacagcagcttctttgacaacagcagcagcccccacctgctggaccagctgaaggcccagaaccaggagctgaggaacaagatcaatgagctggagctgcggctgcagggccacgagaaggagatgaagggccaggtgaacaagttccaggagctgcagctgcagctggagaaggccaaggtggagctgattgagaaggagaaggtgctgaacaagtgcagagatgagctggtgaggaccacagcccagtatgaccaggccagcaccaagtacacagccctggagcagaagctgaagaagctgacagaggacctgagctgccagaggcagaatgctgagagcgcccgctgcagcctggagcagaagatcaaggagaaggagaaggagttccaggaggagctgagccggcagcagaggagcttccagaccctggaccaggagtgcatccagatgaaggcccggctgacccaggagctgcagcaggccaagaacatgcacaacgtgctgcaggccgagctggacaagctgacctctgtgaagcagcagctggagaacaacctggaggagttcaagcagaagctgtgcagagctgagcaggccttccaggccagccagatcaaggaaaatgagctgcggcgctccatggaggagatgaagaaggagaacaacctgctgaagagccacagcgagcagaaggcccgggaggtgtgccacctggaggccgagctgaagaacatcaagcagtgcctgaaccagagccagaactttgctgaggagatgaaggccaagaacaccagccaggagaccatgctgcgggacctgcaggagaagatcaaccagcaggagaacagcctgaccctggagaagctgaagctggccgtggccgacctggagaagcagagggactgcagccaggacctgctgaagaagcgggagcaccacatcgagcagctgaatgacaagctgagcaagacagagaaggagagcaaggccctgctgagcgccctggagctgaagaagaaggagtatgaggagctgaaggaggagaagaccctcttcagctgctggaagtcagaaaatgagaagctgctgacccagatggagagcgagaaggagaacctgcagagcaagatcaaccacctggagacctgcctgaagacccagcagatcaagagccatgagtacaatgaaagagtgaggaccctggagatggaccgggagaacctgtctgtggagatccggaacctgcacaacgtgctggacagcaagtctgtggaggtggagacccagaagctggcctacatggagctgcagcagaaggccgagttcagtgaccagaagcaccagaaggagattgagaacatgtgcctgaagaccagccagctgaccggccaggtggaggacctggagcacaagctgcagctgctgagcaatgagatcatggacaaggaccgctgctaccaggacctgcacgccgagtatgagagcctgcgggacctgctgaagagcaaggatgccagcctggtgaccaatgaagaccaccagaggagcctgctggcctttgaccagcagcctgccatgcaccacagctttgccaacatcattggagagcagggctccatgcccagcgagaggagtgaatgtcggctggaggccgaccagagccccaagaacagcgccatcctgcagaacagagtggacagcctggagttcagcctggagagccagaagcagatgaacagcgacctgcagaagcagtgtgaggagctggtgcagatcaagggggagattgaggagaacctgatgaaggccgagcagatgcaccagagctttgtggccgagaccagccagaggatcagcaagctgcaggaggacaccagcgcccaccagaatgtggtggccgagaccctgagcgccctggagaacaaggagaaggagctgcagctgctgaatgacaaggtggagacagagcaggccgagatccaggagctgaagaagagcaaccacctgctggaggacagcctgaaggagctgcagctgctgtctgagaccctgagcctggagaagaaggagatgagcagcatcatcagcctgaacaagcgggagattgaggagctgacccaggagaatggcaccctgaaggagatcaatgccagcctgaaccaggagaagatgaacctgatccagaagtctgagagctttgccaactacattgatgagcgggagaagagcatcagcgagctgagtgaccagtacaagcaggagaagctgatcctgctgcagagatgtgaggagactggaaatgcctatgaggacctgagccagaagtacaaggccgcccaggagaagaacagcaagctggagtgcctgctgaatgaatgtaccagcctgtgtgaaaataggaagaatgagctggagcagctgaaggaggcctttgccaaggagcaccaggagttcctgaccaagctggcctttgctgaggagaggaaccagaacctgatgctggagctggagaccgtgcagcaggccctgcggtctgagatgacagacaaccagaacaacagcaagtctgaggccggcggcctgaagcaggagatcatgaccctgaaggaggagcagaacaagatgcagaaggaggtgaatgacctgctgcaggagaatgagcagctgatgaaggtgatgaagaccaagcatgagtgccagaacctggagagcgagcccatcagaaattctgtgaaggagcgggagagcgagaggaaccagtgcaacttcaagccccagatggacctggaggtgaaggagatcagcctggacagctacaatgcccagctggtgcagctggaggccatgctgaggaacaaggagctgaagctgcaggagagcgagaaggagaaggagtgcctgcagcacgagctgcagaccatccggggggacctggagaccagcaacctgcaggacatgcagagccaggagatcagcggcctgaaggactgtgaaattgatgctgaggagaagtacatcagcggcccccatgagctgagcaccagccagaatgacaatgcccacctgcagtgcagcctgcagaccaccatgaacaagctgaatgagctggagaagatctgtgagatcctgcaggccgagaagtatgagctggtgacagagctgaatgacagccgctctgagtgcatcacagccaccaggaagatggccgaggaggtgggcaagctgctgaatgaggtgaagatcctgaatgatgattctggcctgctgcatggagagctggtggaggacatccctggaggagaatttggagagcagcccaatgagcagcaccctgtgtccctggcccccctggatgagagcaacagctatgagcacctgaccctgagtgacaaggaggtgcagatgcactttgctgagctgcaggagaagttcctgagcctgcagagcgagcacaagatcctgcatgaccagcactgccagatgagcagcaagatgtctgagctgcagacctacgtggacagcctgaaggccgagaacctggtgctgagcaccaacctgaggaacttccagggcgacctggtgaaggagatgcagctgggcctggaggagggcctggtgcccagcctgagcagcagctgtgtgcctgacagcagcagcctgagcagcctgggggacagcagcttctaccgggccctgctggagcagacaggagacatgagcctgctgagcaacctggagggcgctgtgtctgccaaccagtgcagcgtggatgaggtgttctgcagcagcctgcaggaggagaacctgaccaggaaggagaccccatctgccccagccaagggcgtggaggagctggagagcctgtgtgaggtgtaccggcagagcctggagaagctggaggagaagatggagagccagggcatcatgaagaacaaggagatccaggagctggagcagctgctgagcagcgagcggcaggagctggactgcctgaggaagcagtacctgtctgaaaatgagcagtggcagcagaagctgacctctgtgaccctggagatggagagcaagctggccgctgagaagaagcagacagagcagctgagcctggagctggaggtggcccggctgcagctgcagggcctggacctgagcagccgcagcctgctgggcatcgacacagaagatgccatccagggcagaaatgaaagctgtgacatcagcaaggagcacaccagcgagaccacagagaggacccccaagcatgatgtgcaccagatctgtgacaaggatgcccagcaggacctgaacctggacatcgagaagatcacagagaccggggctgtgaagcccaccggggagtgcagcggggagcagagcccagacaccaactatgagcccccaggagaggacaagacccagggcagcagcgagtgcatcagcgagctgtccttcagcggccccaatgccctggtgcccatggacttcctgggcaaccaggaggacatccacaacctgcagctgcgggtgaaggagaccagcaatgaaaacctgcggctgctgcacgtgattgaagatcgggacaggaaggtggagagcctgctgaatgagatgaaggagctggacagcaagctgcacctgcaggaggtgcagctgatgaccaagattgaggcctgcatcgagctggagaagatcgtgggggagctgaagaaggagaacagcgacctgtctgagaagctggagtacttcagctgtgaccaccaggagctgctgcagagggtggagaccagcgagggcctgaacagcgacctggagatgcacgccgacaagagcagccgggaggacatcggggacaacgtggccaaggtgaatgacagctggaaggagcgcttcctggatgtggagaatgagctgagccgcatccgctctgagaaggccagcattgagcacgaggccctgtacctggaggccgacctggaggtggtgcagacagagaagctgtgcctggagaaggacaatgaaaacaagcagaaggtgattgtgtgcctggaggaggagctgtctgtggtgaccagcgagaggaaccagctgcggggggagctggacaccatgagcaagaagaccacagccctggaccagctgtctgagaagatgaaggagaagacccaggagctggagagccaccagagtgaatgtctgcactgcatccaggtggccgaggccgaggtgaaggagaagacagagctgctgcagaccctgagcagtgatgtgtctgagctgctgaaggacaagacccacctgcaggagaagctgcagagcctggagaaggacagccaggccctgagcctgaccaagtgtgagctggagaaccagatcgcccagctgaacaaggagaaggagctgctggtgaaggagagcgagagcctgcaggcccggctgtctgagagtgactatgagaagctgaatgtgtccaaggccctggaggccgccctggtggagaagggggagtttgccctgcggctgagcagcacccaggaggaggtgcaccagctgcggcggggcatcgagaagctgcgggtgcgcatcgaggctgatgagaagaagcagctgcacatcgccgagaagctgaaggagcgggagcgggagaatgacagcctgaaggacaaggtggagaacctggagcgggagctgcagatgtctgaggagaaccaggagctggtgatcctggatgctgagaacagcaaggccgaggtggagaccctgaagacccagatcgaggagatggcccggagcctgaaggtgtttgagctggacctggtgaccctgcggtctgagaaggagaacctgaccaagcagatccaggagaagcagggccagctgtctgagctggacaagctgctgagcagcttcaagagcctgctggaggagaaggagcaggccgagatccagatcaaggaggagagcaagacagctgtggagatgctgcagaaccagctgaaggagctgaatgaagctgtggccgccctgtgtggggaccaggagatcatgaaggccacagagcagagcctggacccccccatcgaggaggagcaccagctgaggaacagcattgagaagctgcgggcccggctggaggctgatgagaagaagcagctgtgtgtgctgcagcagctgaaggagagcgagcaccacgccgacctgctgaagggccgggtggagaacctggagcgggagctggagatcgcccggaccaaccaggagcacgccgccctggaggccgagaacagcaaaggagaggtggagaccctgaaggccaagattgagggcatgacccagagcctgcggggcctggagctggatgtggtgaccatccgctctgagaaggagaacctgaccaatgagctgcagaaggagcaggagcgcatcagcgagctggagatcatcaacagcagctttgagaacatcctgcaggagaaggagcaggagaaggtgcagatgaaggagaagagcagcacagccatggagatgctgcagacccagctgaaggagctgaatgaaagagtggccgccctgcacaatgaccaggaggcctgcaaggccaaggagcagaacctgagcagccaggtggagtgcctggagctggagaaggcccagctgctgcagggcctggatgaggccaagaacaactacatcgtgctgcagagctctgtgaatggcctcatccaggaggtggaggatggcaagcagaagctggagaagaaggatgaggagatcagccggctgaagaaccagatccaggaccaggagcagctggtgtccaagctgagccaggtggagggggagcaccagctgtggaaggagcagaacctggagctgaggaacctgactgtggagctggagcagaagatccaggtgctgcagagcaagaatgccagcctgcaggacaccctggaggtgctgcagagcagctacaagaacctggagaatgagctggagctgaccaagatggacaagatgagctttgtggagaaggtgaacaagatgacagccaaggagacagagctgcagcgggagatgcatgagatggcccagaagacagctgagctgcaggaggagctgagcggggagaagaaccggctggccggggagctgcagctgctgctggaggagatcaagagcagcaaggaccagctgaaggagctgaccctggagaacagcgagctgaagaagagcctggactgcatgcacaaggaccaggtggagaaggagggcaaggtgcgggaggagattgctgagtaccagctgcggctgcacgaggccgagaagaagcaccaggccctgctgctggacaccaacaagcagtatgaggtggagatccagacctaccgggagaagctgaccagcaaggaggagtgcctgagcagccagaagctggagattgacctgctgaagagcagcaaggaggagctgaacaacagcctgaaggccaccacccagatcctggaggagctgaagaagaccaagatggacaacctgaagtatgtgaaccagctgaagaaggaaaatgaaagagcccagggcaagatgaagctgctgatcaagagctgcaagcagctggaggaggagaaggagatcctgcagaaggagctgagccagctgcaggccgcccaggagaagcagaagacaggcaccgtgatggacaccaaggtggatgagctgaccacagagatcaaggagctgaaggagaccctggaggagaagaccaaggaggctgatgagtacctggacaagtactgcagcctgctgatcagccatgagaagctggagaaggccaaggagatgctggagacccaggtggcccacctgtgcagccagcagagcaagcaggacagccggggcagccccctgctgggccctgtggtgcccggccccagccccatccccagcgtgacagagaagaggctgagcagcggccagaacaaggccagcggcaagaggcagaggagcagcggcatctgggagaatggccggggccccaccccagccaccccagagagcttcagcaagaagagcaagaaggctgtgatgagcggcatccaccctgctgaggacacagagggcacagaatttgagcctgagggcctgcctgaggtggtgaagaagggctttgctgacatccccaccgggaagaccagcccctacatcctgcggaggaccaccatggccaccaggaccagcccccggctggccgcccagaagctggccctgagccccctgagcctgggcaaggagaacctggccgagagcagcaagcccacagctgggggcagccgcagccagaaggtgaaggtggcccagaggagccctgtggacagcggcaccatcctgcgggagcccaccaccaagtctgtgcctgtgaacaacctgcctgagaggagccccacagacagcccccgggagggcctgcgggtgaagaggggccgcctggtgcccagccccaaggccggcctggagagcaatggaagtgagaactgcaaggtgcagtag

SEQ ID NO: 147025 - DNA, 528 bp, Artificial Sequence
  Description of Artificial Sequence: Synthetic coding sequence
ctgatgatcaagggcaggaagggcaaggtgaacaagatgacagccaaggagacagagctgcagcgggagatgcatgagatggcccagaagacagctgagctgcaggaggagctgtctggagagaagaaccggctggccggggagctgcagctgctgctggaggagatcaagagcagcaaggaccagctgaaggagctgaccctggagaacagcgagctgaagaagagcctggactgcatgcacaaggaccaggtggagaaggagggcaaggtgcgggaggagattgctgagtaccagctgcggctgcatgaagctgagaagaagcaccaggccctgctgctggacaccaacaagcagtatgaggtggagatccagacctaccgggagaagctgaccagcaaggaggagtgcctgagcagccagaagctggagattgacctgctgaagagcagcaaggaggagctgaacaacagcctgaaggccaccacccagatcctggaggagctgaagaagaccaaggagaactag

SEQ ID NO: 147026 - DNA, 4017 bp, Artificial Sequence
  Description of Artificial Sequence: Synthetic coding sequence
atgttcctgatgcccaccagcagcgagctgaacagcggccagaacttcctgacccagtggatgaccaaccccagcagagctggggtcatcctgaacagaggcttccccatcctggaggccgacaaggagaagagagctgctgtggacatcagcaccagcttccccatcaagggcacccacttcagtgacagcttctccttcatcaatgaggaggacagcctgctggaggagcagaagctggagagcaacaacccctacaagccccagagcgacaagtctgagacccacacagccttcccctgcatcaagaagggcccccaggtggccgcctgccacagcgcccctggccaccaggaggagaacaagaatgacttcatcccagacctggccagcgagttcaaggagggcgcctacaaggaccccctcttcaagaagctggagcagctgaaggaggtgcagcagaagaagcaggagcagctgaagaggcagcagctggagcagctgcagaggctgatggaggagcaggagaagctgctgaccatggtgtctggccagtgcaccctgcccggcctgagcctgctgcctgatgaccagagccagaagcacaggagccctggcaacaccaccaccggggagcgggccacctgctgcttccccagctatgtgtacccagaccccacccaggaggagacctaccccagcaacatcctgagccatgagcagagcaacttctgcaggacagcccatggagactttgtgctgaccagcaagagggccagccccaacctcttcagcgaggcccagtaccaggaggcccctgtggagaagaacaacctgaaggaggagaacagaaaccaccccaccggggagagcatcctgtgctgggagaaggtgacagagcagatccaggaggccaatgacaagaacctgcagaagcatgatgacagcagcgaggtggccaacatcgaggagcggcccatcaaggccgccatcggggagaggaagcagacctttgaggactacctggaggagcagatccagctggaggagcaggagctgaagcagaagcagctgaaggaggccgagggccccctgcccatcaaggccaagcccaagcagcccttcctgaagagaggagagggcctggcccgcttcaccaatgccaagagcaagttccagaagggcaaggagagcaagctggtgaccaaccagagcaccagcgaggaccagcccctcttcaagatggaccggcagcagctgcagaggaagacagccctgaagaacaaggagctgtgtgccgacaaccccatcctgaagaaggacagcaaggcccggaccaagagcggctctgtgaccctgagccagaagcccaagatgctgaagtgcagcaacaggaagagcctgagccccagcggcctgaagatccagacaggcaagaagtgtgatggccagttccgggaccagatcaagtttgagaacaaggtgaccagcaacaacaaggaaaatgtgacagaatgtcccaagccctgtgacaccggctgcaccggctggaacaagacccagggcaaggaccggctgcccctgagcacaggccctgccagccggctggccgccaagagccccatccgggagaccatgaaggagagcgagagcagcctggatgtgtccctgcagaagaagctggagacctgggagcgggagaaggagaaggagaacctggagctggatgagttcctgttcctggagcaggccgcagatgagatctccttcagcagcaacagcagctttgtgctgaagatcctggagcgggaccagcagatctgcaagggccacaggatgagcagcacccctgtgaaggctgtgccccagaagaccaacccagctgaccccatcagccactgcaacagaagtgaggacctggaccacacagcccgggagaaggagagtgaatgtgaggtggcccccaagcagctgcacagcctgagcagcgcagatgagctgcgggagcagccctgcaagatcaggaaggctgtgcagaagagcaccagcgagaaccagacagagtggaatgccagagatgatgagggcgtgcccaacagcgacagcagcacagacagcgaggagcagctggatgtgaccatcaagcccagcacagaagatcgggagcggggcatcagcagccgggaggacagcccccaggtgtgtgatgacaagggccccttcaaggacaccaggacccaggaggacaagagaagagatgtggacctggacctgagtgacaaggactacagcagtgatgagagcatcatggagagcatcaagcacaaggtgtctgagcccagccgcagcagcagcctgagcctgagcaagatggactttgatgatgagaggacctggacagacctggaggagaacctgtgcaaccatgatgtggtgctgggcaatgaaagcacctacggcaccccccagacctgctaccccaacaatgaaattggcatcctggacaagaccatcaagaggaagatcgcccctgtgaagagaggagaggacctgagcaagagcagaagaagccgcagcccccccaccagcgagctgatgatgaagttcttccccagcctgaagcccaagcccaagagtgacagccacctgggcaatgagctgaagctgaacatcagccaggaccagcccccaggggacaatgcccggagccaggtgctgcgggagaagatcatcgagctggagacagaaattgagaagttcaaggcagaaaatgccagcctggccaagctgcgcatcgagcgggagagcgccctggagaagctgaggaaggagattgctgactttgagcagcagaaggccaaggagctggccagaattgaggagttcaagaaggaggagatgaggaagctgcagaaggagaggaaggtgtttgagaagtacaccacagctgcccggaccttcccagacaagaaggagcgggaggagatccagaccctgaagcagcagattgctgacctgcgggaggacctgaagaggaaggagaccaagtggagcagcacccacagccggctgcggagccagatccagatgctggtgcgggagaacacagacctgcgggaggagatcaaggtgatggagcgcttccggctggatgcctggaagagagctgaggccatcgagagcagcctggaggtggagaagaaggacaagctggccaacacctctgtgcgcttccagaacagccagatcagcagcggcacccaggtggagaagtacaagaagaactacctgcccatgcagggcaaccccccaagaagaagcaagagcgccccaccccgggacctgggcaacctggacaagggccaggccgccagcccccgggagcccctggagcccctgaacttcccagaccctgagtacaaggaggaggaggaggaccaggacatccagggcgagatcagccacccagatggcaaggtggagaaggtgtacaagaatggctgcagggtcatcctcttccccaacggcaccaggaaggaggtgtctgcagatggcaagaccatcaccgtgaccttcttcaatggagatgtgaagcaggtgatgccagaccagagggtcatctactactatgctgctgcccagaccacccacaccacctacccagagggcctggaggtgctgcacttcagcagcggccagatcgagaagcactacccagatggcaggaaggagatcaccttcccagaccagacagtgaagaacctcttcccagatggccaggaggagagcatcttcccagatggcaccatcgtgcgggtgcagagagatggcaacaagctgattgagttcaacaacggccagcgggagctgcacacagcccagttcaagagaagagagtacccagatggcaccgtgaagacagtgtatgccaacggccaccaggagaccaagtaccgcagcggccgcatccgggtgaaggacaaggagggcaatgtgctgatggacacagagctgtag

SEQ ID NO: 147027 - DNA, 3411 bp, Artificial Sequence
  Description of Artificial Sequence: Synthetic coding sequence
atgttcctgatgcccaccagcagcgagctgaacagcggccagaacttcctgacccagtggatgaccaaccccagcagagctggggtcatcctgaacagaggcttccccatcctggaggccgacaaggagaagagagctgctgtggacatcagcaccagcttccccatcaagggcacccacttcagtgacagcttctccttcatcaatgaggaggacagcctgctggaggagcagaagctggagagcaacaacccctacaagccccagagcgacaagtctgagacccacacagccttcccctgcatcaagaagggcccccaggtggccgcctgccacagcgcccctggccaccaggaggagaacaagaatgacttcatcccagacctggccagcgagttcaaggagggcgcctacaaggaccccctcttcaagaagctggagcagctgaaggaggtgcagcagaagaagcaggagcagctgaagaggcagcagctggagcagctgcagaggctgatggaggagcaggagaagctgctgaccatggtgtctggccagtgcaccctgcccggcctgagcctgctgcctgatgaccagagccagaagcacaggagccctggcaacaccaccaccggggagcgggccacctgctgcttccccagctatgtgtacccagaccccacccaggaggagacctaccccagcaacatcctgagccatgagcagagcaacttctgcaggacagcccatggagactttgtgctgaccagcaagagggccagccccaacctcttcagcgaggcccagtaccaggaggcccctgtggagaagaacaacctgaaggaggagaacagaaaccaccccaccggggagagcatcctgtgctgggagaaggtgacagagcagatccaggaggccaatgacaagaacctgcagaagcatgatgacagcagcgaggtggccaacatcgaggagcggcccatcaaggccgccatcggggagaggaagcagacctttgaggactacctggaggagcagatccagctggaggagcaggagctgaagcagaagcagctgaaggaggccgagggccccctgcccatcaaggccaagcccaagcagcccttcctgaagagaggagagggcctggcccgcttcaccaatgccaagagcaagttccagaagggcaaggagagcaagctggtgaccaaccagagcaccagcgaggaccagcccctcttcaagatggaccggcagcagctgcagaggaagacagccctgaagaacaaggagctgtgtgccgacaaccccatcctgaagaaggacagcaaggcccggaccaagagcggctctgtgaccctgagccagaagcccaagatgctgaagtgcagcaacaggaagagcctgagccccagcggcctgaagatccagacaggcaagaagtgtgatggccagttccgggaccagatcaagtttgagaacaaggtgaccagcaacaacaaggaaaatgtgacagaatgtcccaagccctgtgacaccggctgcaccggctggaacaagacccagggcaaggaccggctgcccctgagcacaggccctgccagccggctggccgccaagagccccatccgggagaccatgaaggagagcgagagcagcctggatgtgtccctgcagaagaagctggagacctgggagcgggagaaggagaaggagaacctggagctggatgagttcctgttcctggagcaggccgcagatgagatctccttcagcagcaacagcagctttgtgctgaagatcctggagcgggaccagcagatctgcaagggccacaggatgagcagcacccctgtgaaggctgtgccccagaagaccaacccagctgaccccatcagccactgcaacagaagtgaggacctggaccacacagcccgggagaaggagagtgaatgtgaggtggcccccaagcagctgcacagcctgagcagcgcagatgagctgcgggagcagccctgcaagatcaggaaggctgtgcagaagagcaccagcgagaaccagacagagtggaatgccagagatgatgagggcgtgcccaacagcgacagcagcacagacagcgaggagcagctggatgtgaccatcaagcccagcacagaagatcgggagcggggcatcagcagccgggaggacagcccccaggtgtgtgatgacaagggccccttcaaggacaccaggacccaggaggacaagagaagagatgtggacctggacctgagtgacaaggactacagcagtgatgagagcatcatggagagcatcaagcacaaggtgtctgagcccagccgcagcagcagcctgagcctgagcaagatggactttgatgatgagaggacctggacagacctggaggagaacctgtgcaaccatgatgtggtgctgggcaatgaaagcacctacggcaccccccagacctgctaccccaacaatgaaattggcatcctggacaagaccatcaagaggaagatcgcccctgtgaagagaggagaggacctgagcaagagcagaagaagccgcagcccccccaccagcgagctgatgatgaagttcttccccagcctgaagcccaagcccaagagtgacagccacctgggcaatgagctgaagctgaacatcagccaggaccagcccccaggggacaatgcccggagccaggtgctgcgggagaagatcatcgagctggagacagaaattgagaagttcaaggcagaaaatgccagcctggccaagctgcgcatcgagcgggagagcgccctggagaagctgaggaaggagattgctgactttgagcagcagaaggccaaggagctggccagaattgaggagttcaagaaggaggagatgaggaagctgcagaaggagaggaaggtgtttgagaagtacaccacagctgcccggaccttcccagacaagaaggagcgggaggagatccagaccctgaagcagcagattgctgacctgcgggaggacctgaagaggaaggagaccaagtggagcagcacccacagccggctgcggagccagatccagatgctggtgcgggagaacacagacctgcgggaggagatcaaggtgatggagcgcttccggctggatgcctggaagagagctgaggccatcgagagcagcctggaggtggagaagaaggacaagctggccaacacctctgtgcgcttccagaacagccagatcagcagcggcacccaggtggagaagtacaagaagaactacctgcccatgcagggcacagcccagcccccccacacccccagcagcctgctggccgaccacctgccccccctgagcagcttccggcccttcagcaggaacatccagctgtgctacaccttctag

SEQ ID NO: 147028 - DNA, 3261 bp, Artificial Sequence
  Description of Artificial Sequence: Synthetic coding sequence
atgttcctgatgcccaccagcagcgagctgaacagcggccagaacttcctgacccagtggatgaccaaccccagcagagctggggtcatcctgaacagaggcttccccatcctggaggccgacaaggagaagagagctgctgtggacatcagcaccagcttccccatcaagggcacccacttcagtgacagcttctccttcatcaatgaggaggacagcctgctggaggagcagaagctggagagcaacaacccctacaagccccagagcgacaagtctgagacccacacagccttcccctgcatcaagaagggcccccaggtggccgcctgccacagcgcccctggccaccaggaggagaacaagaatgacttcatcccagacctggccagcgagttcaaggagggcgcctacaaggaccccctcttcaagaagctggagcagctgaaggaggtgcagcagaagaagcaggagcagctgaagaggcagcagctggagcagctgcagaggctgatggaggagcaggagaagctgctgaccatggtgtctggccagtgcaccctgcccggcctgagcctgctgcctgatgaccagagccagaagcacaggagccctggcaacaccaccaccggggagcgggccacctgctgcttccccagctatgtgtacccagaccccacccaggaggagacctaccccagcaacatcctgagccatgagcagagcaacttctgcaggacagcccatggagactttgtgctgaccagcaagagggccagccccaacctcttcagcgaggcccagtaccaggaggcccctgtggagaagaacaacctgaaggaggagaacagaaaccaccccaccggggagagcatcctgtgctgggagaaggtgacagagcagatccaggaggccaatgacaagaacctgcagaagcatgatgacagcagcgaggtggccaacatcgaggagcggcccatcaaggccgccatcggggagaggaagcagacctttgaggactacctggaggagcagatccagctggaggagcaggagctgaagcagaagcagctgaaggaggccgagggccccctgcccatcaaggccaagcccaagcagcccttcctgaagagaggagagggcctggcccgcttcaccaatgccaagagcaagttccagaagggcaaggagagcaagctggtgaccaaccagagcaccagcgaggaccagcccctcttcaagatggaccggcagcagctgcagaggaagacagccctgaagaacaaggagctgtgtgccgacaaccccatcctgaagaaggacagcaaggcccggaccaagagcggctctgtgaccctgagccagaagcccaagatgctgaagtgcagcaacaggaagagcctgagccccagcggcctgaagatccagacaggcaagaagtgtgatggccagttccgggaccagatcaagtttgagaacaaggtgaccagcaacaacaaggaaaatgtgacagaatgtcccaagccctgtgacaccggctgcaccggctggaacaagacccagggcaaggaccggctgcccctgagcacaggccctgccagccggctggccgccaagagccccatccgggagaccatgaaggagagcgagagcagcctggatgtgtccctgcagaagaagctggagacctgggagcgggagaaggagaaggagaacctggagctggatgagttcctgttcctggagcaggccgcagatgagatctccttcagcagcaacagcagctttgtgctgaagatcctggagcgggaccagcagatctgcaagggccacaggatgagcagcacccctgtgaaggctgtgccccagaagaccaacccagctgaccccatcagccactgcaacagaagtgaggacctggaccacacagcccgggagaaggagagtgaatgtgaggtggcccccaagcagctgcacagcctgagcagcgcagatgagctgcgggagcagccctgcaagatcaggaaggctgtgcagaagagcaccagcgagaaccagacagagtggaatgccagagatgatgagggcgtgcccaacagcgacagcagcacagacagcgaggagcagctggatgtgaccatcaagcccagcacagaagatcgggagcggggcatcagcagccgggaggacagcccccaggtgtgtgatgacaagggccccttcaaggacaccaggacccaggaggacaagagaagagatgtggacctggacctgagtgacaaggactacagcagtgatgagagcatcatggagagcatcaagcacaaggtgtctgagcccagccgcagcagcagcctgagcctgagcaagatggactttgatgatgagaggacctggacagacctggaggagaacctgtgcaaccatgatgtggtgctgggcaatgaaagcacctacggcaccccccagacctgctaccccaacaatgaaattggcatcctggacaagaccatcaagaggaagatcgcccctgtgaagagaggagaggacctgagcaagagcagaagaagccgcagcccccccaccagcgagctgatgatgaagttcttccccagcctgaagcccaagcccaagagtgacagccacctgggcaatgagctgaagctgaacatcagccaggaccagcccccaggggacaatgcccggagccaggtgctgcgggagaagatcatcgagctggagacagaaattgagaagttcaaggcagaaaatgccagcctggccaagctgcgcatcgagcgggagagcgccctggagaagctgaggaaggagattgctgactttgagcagcagaaggccaaggagctggccagaattgaggagttcaagaaggaggagatgaggaagctgcagaaggagaggaaggtgtttgagaagtacaccacagctgcccggaccttcccagacaagaaggagcgggaggagatccagaccctgaagcagcagattgctgacctgcgggaggacctgaagaggaaggagaccaagtggagcagcacccacagccggctgcggagccagatccagatgctggtgcgggagaacacagacctgcgggaggagatcaaggtgatggagcgcttccggctggatgcctggaagagagctgaggccatcgagagcagcctggaggtggagaagaaggacaagctggccgccatccacctggaggaccccagcctgcacctgctggtgatctag

SEQ ID NO: 147029 - DNA, 1035 bp, Artificial Sequence
  Description of Artificial Sequence: Synthetic coding sequence
atggacagctacagcgcccctgagagcacccccagcgccagcagcaggcctgaggactacttcatcggggccacccccctgcagaagaggctggagagcgtgaggaagcagagcagcttcatcctgaccccacccaggaggaagatcccccagtgcagccagctgcaggaggatgtggacccccagaaggtggccttcctgctgcacaagcagtggaccctgtacagcctgacccccctgtacaagttctcctacagcaacctgaaggagtacagccggctgctgaatgccttcatcgtggccgagaagcagaagggcctggccgtggaggtgggggaggacttcaacatcaaggtgatcttcagcaccctgctgggcatgaagggcacccagagggaccctgaggccttcctggtgcagatcgtgtccaagagccagctgcccagcgagaaccgggagggcaaggtgctgtggacaggctggttctgctgcgtgtttggagacagcctgctggagaccgtgtctgaggacttcacctgcctgcccctcttcctggccaatggagctgagagcaacacagccatcatcggcacctggttccagaagacctttgactgctacttcagccccctggccatcaatgccttcaacctgtcctggatggccgccatgtggacagcctgcaagatggaccactacgtggccaccacagagttcctgtggagcgtgccctgcagcccccagagcctggacatcagctttgccatccacccagaagatgccaaggccctgtgggacagcgtgcacaagaccccaggagaggtgacccaggaggaggtggacctcttcatggactgcctgtacagccacttccaccgccacttcaagatccacctgagcgccacccggctggtgcgggtgtccacctctgtggccagcgcccacacagatggcaagatcaagatcctgtgccacaagtacctgattggagtgctggcctacctgacagagctggccatcttccagattgaatag

SEQ ID NO: 147030 - DNA, 1173 bp, Artificial Sequence
  Description of Artificial Sequence: Synthetic coding sequence
atggacagctacagcgcccctgagagcacccccagcgccagcagcaggcctgaggactacttcatcggggccacccccctgcagaagaggctggagagcgtgaggaagcagagcagcttcatcctgaccccacccaggaggaagatcccccagtgcagccagctgcaggaggatgtggacccccagaaggtggccttcctgctgcacaagcagtggaccctgtacagcctgacccccctgtacaagttctcctacagcaacctgaaggagtacagccggctgctgaatgccttcatcgtggccgagaagcagaagggcctggccgtggaggtgggggaggacttcaacatcaaggtgatcttcagcaccctgctgggcatgaagggcacccagagggaccctgaggccttcctggtgcagggcctcatcctgagcccccggctggagtacagcggcaccatcctggtggactgcaacctgtgcctgctgggcagcagtgaccccagcaccctggccttccaggtggccggcacagctggggcctgccaccacaccagaattgtgtccaagagccagctgcccagcgagaaccgggagggcaaggtgctgtggacaggctggttctgctgcgtgtttggagacagcctgctggagaccgtgtctgaggacttcacctgcctgcccctcttcctggccaatggagctgagagcaacacagccatcatcggcacctggttccagaagacctttgactgctacttcagccccctggccatcaatgccttcaacctgtcctggatggccgccatgtggacagcctgcaagatggaccactacgtggccaccacagagttcctgtggagcgtgccctgcagcccccagagcctggacatcagctttgccatccacccagaagatgccaaggccctgtgggacagcgtgcacaagaccccaggagaggtgacccaggaggaggtggacctcttcatggactgcctgtacagccacttccaccgccacttcaagatccacctgagcgccacccggctggtgcgggtgtccacctctgtggccagcgcccacacagatggcaagatcaagatcctgtgccacaagtacctgattggagtgctggcctacctgacagagctggccatcttccagattgaatag

SEQ ID NO: 147031 - DNA, 1035 bp, Artificial Sequence; identical to SEQ ID NO: 147029
  Description of Artificial Sequence: Synthetic coding sequence

SEQ ID NO: 147032 - DNA, 615 bp, Artificial Sequence
  Description of Artificial Sequence: Synthetic coding sequence
atggatgagaccgtggccgagttcatcaagaggaccatcctgaagatccccatgaatgagctgaccaccatcctgaaggcctgggacttcctgtctgagaaccagctgcagacagtgaacttccggcagaggaaggagagcgtggtgcagcacctgatccacctgtgtgaggagaagagggccagcatcagtgatgctgccctgctggacatcatctacatgcagttccaccagcaccagaaggtgtgggaggtgttccagatgagcaagggccctggagaagatgtggacctgtttgacatgaagcagttcaagaacagcttcaagaagatcctgcagagggccctgaagaatgtgacagtgtccttccgggagacagaggagaatgctgtgtggatcagaattgcctggggcacccagtacaccaagcccaaccagtacaagcccacctacgtggtgtactacagccagaccccctatgccttcaccagcagctccatgctgcggaggaacacccccctgctgggccaggagctggaggccaccgggaagatctacctgcggcaggaggagatcatcctggacatcacagagatgaagaaggcctgcaactag

SEQ ID NO: 147033 - DNA, 1020 bp, Artificial Sequence
  Description of Artificial Sequence: Synthetic coding sequence
atggatgagaccgtggccgagttcatcaagaggaccatcctgaagatccccatgaatgagctgaccaccatcctgaaggcctgggacttcctgtctgagaaccagctgcagacagtgaacttccggcagaggaaggagagcgtggtgcagcacctgatccacctgtgtgaggagaagagggccagcatcagtgatgctgccctgctggacatcatctacatgcagttccaccagcaccagaaggtgtgggaggtgttccagatgagcaagggccctggagaagatgtggacctgtttgacatgaagcagttcaagaacagcttcaagaagatcctgcagagggccctgaagaatgtgacagtgtccttccgggagacagaggagaatgctgtgtggatcagaattgcctggggcacccagtacaccaagcccaaccagtacaagcccacctacgtggtgtactacagccagaccccctatgccttcaccagcagctccatgctgcggaggaacacccccctgctgggccaggccctgaccatcgccagcaagcaccaccagatcgtgaagatggacctgcggagccgctacctggacagcctgaaggccatcgtgttcaagcagtacaaccagacctttgagacccacaacagcaccacccccctgcaggagaggagcctgggcctggacatcaacatggacagccgcatcatccacgagaacatcgtggagaaggagcgggtgcagaggatcacccaggagaccttcggggactacccccagccccagctggagtttgcccagtacaagctggagaccaagttcaagagcggcctgaatggcagcatcctggccgagcgggaggagcccctgcgctgcctgatcaagttcagcagcccccacctgctggaggccctgaagagcctggccccagctggcattgctgatgcccccctgagccccctgctgacctgcatccccaacaagaggatgaactacttcaagatccgggacaagtag

SEQ ID NO: 147034 - DNA, 918 bp, Artificial Sequence
  Description of Artificial Sequence: Synthetic coding sequence
atggatgagaccgtggccgagttcatcaagaggaccatcctgaagatccccatgaatgagctgaccaccatcctgaaggcctgggacttcctgtctgagaaccagctgcagacagtgaacttccggcagaggaaggagagcgtggtgcagcacctgatccacctgtgtgaggagaagagggccagcatcagtgatgctgccctgctggacatcatctacatgcagttccaccagcaccagaaggtgtgggaggtgttccagatgagcaagggccctggagaagatgtggacctgtttgacatgaagcagttcaagaacagcttcaagaagatcctgcagagggccctgaagaatgtgacagtgtccttccgggagacagaggagaatgctgtgtggatcagaattgcctggggcacccagtacaccaagcccaaccagtacaagcccacctacgtggtgtactacagccagaccccctatgccttcaccagcagctccatgctgcggaggaacacccccctgctgggccagacctttgagacccacaacagcaccacccccctgcaggagaggagcctgggcctggacatcaacatggacagccgcatcatccacgagaacatcgtggagaaggagcgggtgcagaggatcacccaggagaccttcggggactacccccagccccagctggagtttgcccagtacaagctggagaccaagttcaagagcggcctgaatggcagcatcctggccgagcgggaggagcccctgcgctgcctgatcaagttcagcagcccccacctgctggaggccctgaagagcctggccccagctggcattgctgatgcccccctgagccccctgctgacctgcatccccaacaagaggatgaactacttcaagatccgggacaagtag

SEQ ID NO: 147035 - DNA, 960 bp, Artificial Sequence
  Description of Artificial Sequence: Synthetic coding sequence
atggatgagaccgtggccgagttcatcaagaggaccatcctgaagatccccatgaatgagctgaccaccatcctgaaggcctgggacttcctgtctgagaaccagctgcagacagtgaacttccggcagaggaaggagagcgtggtgcagcacctgatccacctgtgtgaggagaagagggccagcatcagtgatgctgccctgctggacatcatctgtgaagatgtggacctgtttgacatgaagcagttcaagaacagcttcaagaagatcctgcagagggccctgaagaatgtgacagtgtccttccgggagacagaggagaatgctgtgtggatcagaattgcctggggcacccagtacaccaagcccaaccagtacaagcccacctacgtggtgtactacagccagaccccctatgccttcaccagcagctccatgctgcggaggaacacccccctgctgggccaggccctgaccatcgccagcaagcaccaccagatcgtgaagatggacctgcggagccgctacctggacagcctgaaggccatcgtgttcaagcagtacaaccagacctttgagacccacaacagcaccacccccctgcaggagaggagcctgggcctggacatcaacatggacagccgcatcatccacgagaacatcgtggagaaggagcgggtgcagaggatcacccaggagaccttcggggactacccccagccccagctggagtttgcccagtacaagctggagaccaagttcaagagcggcctgaatggcagcatcctggccgagcgggaggagcccctgcgctgcctgatcaagttcagcagcccccacctgctggaggccctgaagagcctggccccagctggcattgctgatgcccccctgagccccctgctgacctgcatccccaacaagaggatgaactacttcaagatccgggacaagtag

SEQ ID NO: 147036 - DNA, 1062 bp, Artificial Sequence
  Description of Artificial Sequence: Synthetic coding sequence
atggatgagaccgtggccgagttcatcaagaggaccatcctgaagatccccatgaatgagctgaccaccatcctgaaggcctgggacttcctgtctgagaaccagctgcagacagtgaacttccggcagaggaaggagagcgtggtgcagcacctgatccacctgtgtgaggagaagagggccagcatcagtgatgctgccctgctggacatcatctacatgcagttccaccagcaccagaaggtgtgggaggtgttccagatgagcaagggccctggagaagatgtggacctgtttgacatgaagcagttcaagaacagcttcaagaagatcctgcagagggccctgaagaatgtgacagtgtccttccgggagacagaggagaatgctgtgtggatcagaattgcctggggcacccagtacaccaagcccaaccagtacaagcccacctacgtggtgtactacagccagaccccctatgccttcaccagcagctccatgctgcggaggaacacccccctgctgggccaggccctgaccatcgccagcaagcaccaccagatcgtgaagatggacctgcggagccgctacctggacagcctgaaggccatcgtgttcaagcagtacaaccagacctttgagacccacaacagcaccacccccctgcaggagaggagcctgggcctggacatcaacatggacagccgcatcatccacgagaacatcgtggagaaggagcgggtgcagaggatcacccaggagaccttcggggactacccccagccccagctggagtttgcccagtacaagctggagaccaagttcaagagcggcctgaatggcagcatcctggccgagcgggaggagcccctgcgctgcctgatcaagttcagcagcccccacctgctggaggccctgaagagcctggccccagctgccctggtgtgccgcatccagaagctgctgtgctacagcggcagccacagccagggcacccaggaccccagctcctggcagaaggacctgtacctgctgtttgtgcccctgtacccccgctgctag

SEQ ID NO: 147037 - DNA, 903 bp, Artificial Sequence
  Description of Artificial Sequence: Synthetic coding sequence
atggagcaggccaaccccctgcggccagatggagagagcaagggcggcgtgctggcccacctggagcggctggagacccaggtgagccgcagcaggaagcagagcgaggagctgcagagcgtgcaggcccaggagggcgccctgggcaccaagatccacaagctgcggcggctgagagatgagctgcgggctgtggtgcgccacagaagagcctctgtgaaggcctgcatcgccaacgtggagcccaaccagacagtggagatcaatgagcaggaggccctggaggagaagctggagaatgtgaaggccatcctgcaggcctaccacttcaccggcctgagcggcaagctgaccagcagaggagtgtgtgtgtgcatcagcacagcctttgagggcaacctgctggacagctactttgtggacctggtgatccagaagcccctgcgcatccaccaccacagcgtgcctgtgttcatccccctggaggagattgctgccaagtacctgcagaccaacatccagcacttcctgttcagcctgtgtgagtacctgaatgcctacagcggcaggaagtaccaggccgaccggctgcagagcgactttgctgccctgctgaccggccccctgcagaggaaccccctgtgcaacctgctgtccttcacctacaagctggaccccggcggccagagcttccccttctgtgcccggctgctgtacaaggacctgacagccaccctgcccacagatgtgacagtgacctgccagggcgtggaggtgctgagcacctcctgggaggagcagagggccagccatgagaccctcttctgcaccaagcccctgcaccaggtgtttgccagcttcaccaggaagggggagaagctggacatgagcctggtgtcctag

SEQ ID NO: 147038 - DNA, 903 bp, Artificial Sequence; identical to SEQ ID NO: 147037
  Description of Artificial Sequence: Synthetic coding sequence

SEQ ID NO: 147039 - DNA, 885 bp, Artificial Sequence
  Description of Artificial Sequence: Synthetic coding sequence
atggccggcatcctggccagcggcctgggcgtgctggcccacctggagcggctggagacccaggtgagccgcagcaggaagcagagcgaggagctgcagagcgtgcaggcccaggagggcgccctgggcaccaagatccacaagctgcggcggctgagagatgagctgcgggctgtggtgcgccacagaagagcctctgtgaaggcctgcatcgccaacgtggagcccaaccagacagtggagatcaatgagcaggaggccctggaggagaagctggagaatgtgaaggccatcctgcaggcctaccacttcaccggcctgagcggcaagctgaccagcagaggagtgtgtgtgtgcatcagcacagcctttgagggcaacctgctggacagctactttgtggacctggtgatccagaagcccctgcgcatccaccaccacagcgtgcctgtgttcatccccctggaggagattgctgccaagtacctgcagaccaacatccagcacttcctgttcagcctgtgtgagtacctgaatgcctacagcggcaggaagtaccaggccgaccggctgcagagcgactttgctgccctgctgaccggccccctgcagaggaaccccctgtgcaacctgctgtccttcacctacaagctggaccccggcggccagagcttccccttctgtgcccggctgctgtacaaggacctgacagccaccctgcccacagatgtgacagtgacctgccagggcgtggaggtgctgagcacctcctgggaggagcagagggccagccatgagaccctcttctgcaccaagcccctgcaccaggtgtttgccagcttcaccaggaagggggagaagctggacatgagcctggtgtcctag

SEQ ID NO: 147040 - DNA, 309 bp, Artificial Sequence
  Description of Artificial Sequence: Synthetic coding sequence
atgcaggagaagtacccagatgctgtgtacctgtctgagggccccagcagctgcagcatgggcatccgcagcgccagccggcccggctttgagctggtgattgtgtggaggatccagattgatgaagatggcaaggtgttccccaagctggacctgctgaccaaggtgccccagagggccctggagctggacaagaacagagccattgaaacagcccccctgtccttccgcaccctggtgggcctgctgggcattgaagctgccctggagagcctcatcaagagcctgtgtgccgaggagaacaactag

SEQ ID NO: 147041 - DNA, 348 bp, Artificial Sequence
  Description of Artificial Sequence: Synthetic coding sequence
atggaggcccccagctggagcgtgctgcagaggtctggagatgaggagaagtacccagatgctgtgtacctgtctgagggccccagcagctgcagcatgggcatccgcagcgccagcaggcctggctttgagctggtgattgtgtggaggatccagattgatgaagatggcaaggtgttccccaagctggacctgctgaccaaggtgccccagagggccctggagctggacaagaacagagccatcgagacagcccccctgtccttccgcaccctggtgggcctgctgggcatcgaggccgccctggagagcctcatcaagagcctgtgtgccgaggagaacaactag

SEQ ID NO: 147042 - DNA, 867 bp, Artificial Sequence
  Description of Artificial Sequence: Synthetic coding sequence
atggatgctgagctggccgaggtgcgggccctgcaggccgagattgctgccctgcggcgggcctgtgaagatcctccagccccctgggaggagaagagccgggtgcagaagagcttccaggccatccaccagttcaacctggagggctggaagagcagcaaggacctgaagaaccagctgggccacctggagagcgagctgtccttcctgagcaccctgaccggcatcaacatccggaaccacagcaagcagacagaggacctgaccagcacagagatgacagagaagagcatcaggaaggtgctgcagaggcaccggctgagcggcaactgccacatggtgaccttccagctggagttccagatcctggagatccagaacaaggagcggctgagcagcgctgtgacagacctgaacatcatcatggagcccacagagtgcagcgagctgtctgaatttgtgtccagagctgaggagaggaaggacctcttcatgttcttccgcagcctgcacttctttgtggagtggtttgagtacaggaagaggaccttcaagcacctgaaggagaagtacccagatgctgtgtacctgtctgagggccccagcagctgcagcatgggcatccgcagcgccagccggcccggctttgagctggtgattgtgtggaggatccagattgatgaagatggcaaggtgttccccaagctggacctgctgaccaaggtgccccagagggccctggagctggacaagaacagagccattgaaacagcccccctgtccttccgcaccctggtgggcctgctgggcattgaagctgccctggagagcctcatcaagagcctgtgtgccgaggagaacaactag

SEQ ID NO: 147043 - DNA, 744 bp, Artificial Sequence
  Description of Artificial Sequence: Synthetic coding sequence
aagagagctggccgcagtgacagctgtgccgccggccctgctgctgtgtccaatgccccctggacccagagctggcagagatgtgccccctgcaagctgcggagccggccctgtggggagcgggtgaggacccaccggcggcctgggaagaggagccctgagagcagcatcaggaaggtgctgcagaggcaccggctgagcggcaactgccacatggtgaccttccagctggagttccagatcctggagatccagaacaaggagcggctgagcagcgctgtgacagacctgaacatcatcatggagcccacagaatgttctgagctgtctgaatttgtgtccagagctgaggagaggaaggacctcttcatgttcttccgcagcctgcacttctttgtggagtggtttgagtacaggaagaggaccttcaagcacctgaaggagaagtacccagatgctgtgtacctgtctgagggccccagcagctgcagcatgggcatccgcagcgccagcaggcctggctttgagctggtgattgtgtggaggatccagattgatgaagatggcaaggtgttccccaagctggacctgctgaccaaggtgccccagagggccctggagctggacaagaacagagccatcgagacagcccccctgtccttccgcaccctggtgggcctgctgggcatcgaggccgccctggagagcctcatcaagagcctgtgtgccgaggagaacaactag

SEQ ID NO: 147044 - DNA, 807 bp, Artificial Sequence
  Description of Artificial Sequence: Synthetic coding sequence
atgtctgggaaggccaatgccagcaagaagaatgcccagcagctgaagaggaaccccaagaggaagaaggacaatgaggaggtggtgctgtctgagaacaaggtgaggaacacagtgaagaagaacaagaaccacctgaaggacctgagcagcgagggccagaccaagcacaccaacctgaagcacggcaagacagctgccagcaagaggaagacctggcagcccctgagcaagagcacccgggaccacctgcagaccatgatggagagcgtcatcatgaccatcctgagcaacagcatcaaggagaaggaggagatccagtaccacctgaacttcctgaagaagaggctgctgcagcagtgtgagaccctgaaggtgccccccaagaagatggaggacctgaccaacgtgagcagcctgctgaacatggagcgggcccgggacaaggccaatgaggagggcctggccctgctgcaggaggagattgacaagatggtggagaccacagagctgatgactggaaacatccagagcctgaagaacaagatccagatcctggccagcgaggtggaggaggaggaggagcgggtgaagcagatgcaccagatcaacagcagcggcgtgctgagcctgcctgagctgagccagaagaccctgaaggcccccaccctgcagaaggagatcctggccctgatccccaaccagaatgccctgctgaaggacctggacatcctgcacaacagcagccagatgaagtccatgagcaccttcatcgaggaggcctacaagaagctggatgccagctag

SEQ ID NO: 147045 - DNA, 807 bp, Artificial Sequence; identical to SEQ ID NO: 147044
  Description of Artificial Sequence: Synthetic coding sequence

SEQ ID NO: 147046 - DNA, 384 bp, Artificial Sequence
  Description of Artificial Sequence: Synthetic coding sequence
atgggagacaagcccatctgggagcagatcggcagcagcttcatccagcactactaccagctgtttgacaatgacaggacccagctgggcgccatctacattgatgccagctgcctgacctgggagggccagcagttccagggcaaggccgccatcgtggagaagctgagcagcctgcccttccagaagatccagcacagcatcacagcccaggaccaccagcccaccccagacagctgcatcatctccatggtggtgggccagctgaaggcagatgaggaccccatcatgggcttccaccagatgttcctgctgaagaacatcaatgatgcctgggtgtgcaccaatgacatgttccggctggccctgcacaactttggatag

SEQ ID NO: 147047 - DNA, 786 bp, Artificial Sequence
  Description of Artificial Sequence: Synthetic coding sequence
atgtcctggtgctgcctgtggctgtgcctgagctctgtgggccgcacaggcagcgctggccccagcctgcccttcagcgagctgtgcagcctgggcctgctgcggctgcggcctgtgttcagccccctgcacagcggccctgggaagccagcccagttcctggccggggaggccgaggaggtgaatgcctttgccctgggcttcctgagcaccagcagtggagtgtctggagaagatgaggtggagcccctgcatgatggagtggaggaggccgagaagaagatggaggaggagggcgtgtctgtgtctgagatggaggccaccggggcccagggccccagccgggtggaggaggccgagggccacacagaggtgacagaggccgagggcagccagggcacagctgaggctgatggccctggggccagcagtggagatgaagatgccagcggccgggccgccagccctgagagcgccagcagcaccccagagagcctgcaggcccggcggcaccaccagttcctggagcccgccccagcccctggagctgctgtgctgagcagcgagcctgctgagcccctgctggtgcgccaccccccccggcccaggaccaccggcccccggccccggcaggacccccacaaggccggcctgagccactacgtgaagctgttctccttctacgccaagatgcccatggagaggaaggccctggagatggtggagaagtgcatctttgtgatgatctggagatacctgctgctgatgctggccgcccggctgtag

SEQ ID NO: 147048 - DNA, 1686 bp, Artificial Sequence
  Description of Artificial Sequence: Synthetic coding sequence
atggctgaccacaacccagacagcgacagcacccccaggaccctgctgcggcgggtgctggacacagctgaccccaggaccccaagaagacccaggtctgcccgggccggggcccggcgggccctgctggagacagccagccccaggaagctgagcggccagaccaggaccatcgcccggggccgcagccacggggcccggtctgtgggccgcagcgcccacatccaggccagcggccacctggaggagcagacccccaggaccctgctgaagaacatcctgctgacagcccctgagagcagcatcctgatgcctgagagcgtggtgaagcctgtgcctgccccccaggccgtgcagcccagccggcaggagagcagctgtggcagcctggagctgcagctgcctgagctggagccccccaccaccctggcccctggcctgctggcccctggccgcaggaagcagaggctgcggctgagcgtcttccagcagggcgtggaccagggcctgagcctgagccaggagccccagggcaatgctgatgccagcagcctgaccaggagcctgaacctgacctttgccacccccctgcagccccagagcgtgcagaggcctggcctggcccggcggcccccagcccggcgggctgtggatgtgggcgccttcctgcgggacctgcgggacaccagcctggccccacccaacatcgtgctggaggacacccagcccttcagccagcccatggtgggcagccccaacgtgtaccacagcctgccctgcaccccccacactggagcagaagatgctgagcaggccgccggcaggaagacccagagcagcggccctggcctgcagaagaacagccctgggaagccagcccagttcctggccggggaggccgaggaggtgaatgcctttgccctgggcttcctgagcaccagcagtggagtgtctggagaagatgaggtggagcccctgcatgatggagtggaggaggccgagaagaagatggaggaggagggcgtgtctgtgtctgagatggaggccaccggggcccagggccccagccgggtggaggaggccgagggccacacagaggtgacagaggccgagggcagccagggcacagctgaggctgatggccctggggccagcagtggagatgaagatgccagcggccgggccgccagccctgagagcgccagcagcaccccagagagcctgcaggcccggcggcaccaccagttcctggagcccgccccagcccctggagctgctgtgctgagcagcgagcctgctgagcccctgctggtgcgccaccccccccggcccaggaccaccggcccccggccccggcaggacccccacaaggccggcctgagccactacgtgaagctgttctccttctacgccaagatgcccatggagaggaaggccctggagatggtggagaagtgcctggacaagtacttccagcacctgtgtgatgacctggaggtgtttgctgcccatgctggcaggaagacagtgaagccagaggacctggagctgctgatgaggcggcagggcctggtgacagaccaggtgtccctgcacgtgctggtggagcggcacctgcccctggagtaccggcagctgctgatcccctgtgcctacagcggcaacagcgtcttccctgcccagtag

SEQ ID NO: 147049 - DNA, 447 bp, Artificial Sequence
  Description of Artificial Sequence: Synthetic coding sequence
atgcctgagagcgtggtgaagcctgtgcctgccccccaggccgtgcagcccagccggcaggagagcagctgtggcagcctggagctgcagctgcctgagctggagccccccaccaccctggcccctggcctgctggcccctggaagaaggaagcagaggctgcggctgtctgtgttccagcagggcgtggaccagggcctgagcctgagccaggagccccagggcaatgctgatgccagcagcctgaccaggagcctgaacctgacctttgccacccccctgcagccccagagcgtgcagaggcctggcctggcccggcggcccccagccaggagagctgtggatgtgggcgccttcctgcgggacctgcgggacaccagcctggccccacccagcaaggtgggcttcagccctgctggcctgtggggcaagctgagccccctgtag

SEQ ID NO: 147050 - DNA, 1686 bp, Artificial Sequence; identical to SEQ ID NO: 147048
  Description of Artificial Sequence: Synthetic coding sequence

SEQ ID NO: 147051 - DNA, 819 bp, Artificial Sequence
  Description of Artificial Sequence: Synthetic coding sequence
atgaggaggagccgcagcagcgctgctgccaagctgcggggccagaagaggtctggggccagcgctgccccagctgccagcgctgctgctgccctggcccccagcgccaccaggacccggcgcagcgccagccaggccggcagcaagagccaggccgtggagaagccacccagcgagaagccccggctgcggcgcagcagcccccgggcccaggaggagggccctggagagcccccacctcctgagctggccctgctgcccccacctcctcctcctccacccaccccagccacccccaccagcagcgccagcaacctggacctgggggagcagcgggagcgctgggagaccttccagaagaggcagaagctgaccagcgagggcgccgccaagctgctgctggacacctttgagtaccagggcctggtgaagcacactggaggctgccactgtggggctgtgcgctttgaggtgtgggccagcgctgacctgcacatctttgactgcaactgcagcatctgcaagaagaagcagaacagacacttcatcgtgcctgccagccgcttcaagctgctgaagggagctgagcacatcaccacctacaccttcaacacccacaaggcccagcacaccttctgcaagagatgtggggtgcagagcttctacacccccaggagcaaccctgggggctttggaattgccccccactgcctggatgagggcaccgtgcgctccatggtgacagaggagttcaacggcagtgactgggagaaggccatgaaggagcacaagaccatcaagaacatgagcaaggagtag

SEQ ID NO: 147052 - DNA, 2961 bp, Artificial Sequence
  Description of Artificial Sequence: Synthetic coding sequence
atggtgtccaagagtgaccagctgctgattgtggtgtccatcctggagggccgccacttccccaagaggcccaagcacatgctggtggtggaggccaagtttgatggagagcagctggccacagatcctgtggaccacacagaccagcctgagtttgccacagagctggcctgggagattgacaggaaggccctgcaccagcaccggctgcagaggacccccatcaagctgcagtgctttgccctggaccctgtgaccagcgccaaggagaccatcggctacatcgtgctggacctgaggacagcccaggagaccaagcaggcccccaagtggtaccagctgctgagcaacaagtacaccaagttcaagtctgagatccagatcagcatcgccctggagacagacaccaagccccctgtggacagcttcaaggccaagggggcccccccaagagatggcaaggtgcctgccatcctggccggcctggacccccgggacatcgtggccgtgctgaatgaggagggcggctaccaccagatcggccctgctgagtactgcacagacagcttcatcatgtctgtgaccatcgcctttgccacccagctggagcagctgatcccctgcaccatgaagctgcctgagcggcagcctgagttcttcttctactacagcctgctgggcaatgatgtgaccaatgagcccttcaatgacctgatcaaccccaactttgagcctgagcgggcctctgtgcgcatccgcagctctgtggagatcctgcgggtgtacctggccctgcagagcaagctgcagatccacctgtgctgcggggaccagagcctgggcagcacagagatccccctgaccggcctgctgaagaagggcagcacagagatcaaccagcaccctgtgacagtggagggcgccttcaccctggacccccccaacagagccaagcagaagctggcccccatccctgtggagctggcccccaccgtgggcgtgtctgtggccctgcagcgggagggcatcgacagccagagcctgattgagctgaagacccagaatgaacatgagcctgagcacagcaagaagaaggtgctgacccccatcaaggagaagaccctgaccggccccaagagccccaccgtgtcccctgtgcccagccacaaccagagcccccccaccaaggatgatgccacagagagcgaggtggagagcctgcagtatgacaaggacaccaagcccaaccccaaggccagcagctctgtgcctgccagcctggcccagctggtgaccaccagcaatgccagcgaggtggccagcggccagaagattgctgtgcctgccaccagccaccacttctgcttcagcattgacctgcggagcatccacgccctggagatcggcttccccatcaactgcatcctgcgctacagctaccccttctttggatctgctgcccccatcatgaccaacccccctgtggaggtgaggaagaacatggaggtgttcctgccccagagctactgtgcctttgattttgccaccatgccccaccagctgcaggacaccttcctgcgcatccccctgctggtggagctgtggcacaaggacaagatgagcaaggacctgctgctgggcatcgcccgcatccagctgagcaacatcctgagcagcgagaagacccgcttcctgggcagcaatggagagcagtgctggaggcagacctacagcgagagcgtgcctgtgattgctgcccagggcagcaacaacagaattgctgacctgagctacacagtgaccctggaggactatggcctggtgaagatgagggagatcttcatcagtgacagcagccagggcgtgtctgctgtgcagcagaagcccagcagcctgcccccagccccctgccccagcgagatccagacagagccccgggagaccctggagtacaaggccgccctggagctggagatgtggaaggagatgcaggaggacatctttgagaaccagctgaagcagaaggagctggcccacatgcaggccctggccgaggagtggaagaagagggaccgggagcgggagagcctggtgaagaagaaggtggccgagtacaccatcctggagggcaagctgcagaagaccctgattgacctggagaagcgggagcagcagctggcctctgtggagagcgagctgcagcgggagaagaaggagctgcagagcgagcggcagaggaacctgcaggagctgcaggacagcatccggcgggccaaggaggactgcatccaccaggtggagctggagcggctgaagatcaagcagctggaggaggacaagcaccggctgcagcagcagctgaatgatgctgagaacaagtacaagatcctggagaaggagttccagcagttcaaggaccagcagaacaacaagccagagatccggctgcagagcgagatcaacctgctgaccctggagaaggtggagctggagaggaagctggagagcgccaccaagagcaagctgcactacaagcagcagtggggccgggccctgaaggagctggcccggctgaagcagcgggagcaggagagccagatggcccggctgaagaagcagcaggaggagctggagcagatgaggctgcgctacctggccgctgaggagaaggacacagtgaagacagagcggcaggagctgctggacatcagaaatgagctgaaccggctgcggcagcaggagcagaagcagtaccaggacagcacagagatcgccagcggcaagaaggatggcccccacggctctgtgctggaggagggcctggatgactacctgacccggctgattgaggagcgggacaccctgatgaggactggagtgtacaaccacgaggaccgcatcatcagcgagctggaccggcagatccgggagatcctggccaagagcaatgccagcaactag

SEQ ID NO: 147053 - DNA, 2883 bp, Artificial Sequence
  Description of Artificial Sequence: Synthetic coding sequence
atgctggtggtggaggccaagtttgatggagagcagctggccacagatcctgtggaccacacagaccagcctgagtttgccacagagctggcctgggagattgacaggaaggccctgcaccagcaccggctgcagaggacccccatcaagctgcagtgctttgccctggaccctgtgaccagcgccaaggagaccatcggctacatcgtgctggacctgaggacagcccaggagaccaagcaggcccccaagtggtaccagctgctgagcaacaagtacaccaagttcaagtctgagatccagatcagcatcgccctggagacagacaccaagccccctgtggacagcttcaaggccaagggggcccccccaagagatggcaaggtgcctgccatcctggccggcctggacccccgggacatcgtggccgtgctgaatgaggagggcggctaccaccagatcggccctgctgagtactgcacagacagcttcatcatgtctgtgaccatcgcctttgccacccagctggagcagctgatcccctgcaccatgaagctgcctgagcggcagcctgagttcttcttctactacagcctgctgggcaatgatgtgaccaatgagcccttcaatgacctgatcaaccccaactttgagcctgagcgggcctctgtgcgcatccgcagctctgtggagatcctgcgggtgtacctggccctgcagagcaagctgcagatccacctgtgctgcggggaccagagcctgggcagcacagagatccccctgaccggcctgctgaagaagggcagcacagagatcaaccagcaccctgtgacagtggagggcgccttcaccctggacccccccaacagagccaagcagaagctggcccccatccctgtggagctggcccccaccgtgggcgtgtctgtggccctgcagcgggagggcatcgacagccagagcctgattgagctgaagacccagaatgaacatgagcctgagcacagcaagaagaaggtgctgacccccatcaaggagaagaccctgaccggccccaagagccccaccgtgtcccctgtgcccagccacaaccagagcccccccaccaaggatgatgccacagagagcgaggtggagagcctgcagtatgacaaggacaccaagcccaaccccaaggccagcagctctgtgcctgccagcctggcccagctggtgaccaccagcaatgccagcgaggtggccagcggccagaagattgctgtgcctgccaccagccaccacttctgcttcagcattgacctgcggagcatccacgccctggagatcggcttccccatcaactgcatcctgcgctacagctaccccttctttggatctgctgcccccatcatgaccaacccccctgtggaggtgaggaagaacatggaggtgttcctgccccagagctactgtgcctttgattttgccaccatgccccaccagctgcaggacaccttcctgcgcatccccctgctggtggagctgtggcacaaggacaagatgagcaaggacctgctgctgggcatcgcccgcatccagctgagcaacatcctgagcagcgagaagacccgcttcctgggcagcaatggagagcagtgctggaggcagacctacagcgagagcgtgcctgtgattgctgcccagggcagcaacaacagaattgctgacctgagctacacagtgaccctggaggactatggcctggtgaagatgagggagatcttcatcagtgacagcagccagggcgtgtctgctgtgcagcagaagcccagcagcctgcccccagccccctgccccagcgagatccagacagagccccgggagaccctggagtacaaggccgccctggagctggagatgtggaaggagatgcaggaggacatctttgagaaccagctgaagcagaaggagctggcccacatgcaggccctggccgaggagtggaagaagagggaccgggagcgggagagcctggtgaagaagaaggtggccgagtacaccatcctggagggcaagctgcagaagaccctgattgacctggagaagcgggagcagcagctggcctctgtggagagcgagctgcagcgggagaagaaggagctgcagagcgagcggcagaggaacctgcaggagctgcaggacagcatccggcgggccaaggaggactgcatccaccaggtggagctggagcggctgaagatcaagcagctggaggaggacaagcaccggctgcagcagcagctgaatgatgctgagaacaagtacaagatcctggagaaggagttccagcagttcaaggaccagcagaacaacaagccagagatccggctgcagagcgagatcaacctgctgaccctggagaaggtggagctggagaggaagctggagagcgccaccaagagcaagctgcactacaagcagcagtggggccgggccctgaaggagctggcccggctgaagcagcgggagcaggagagccagatggcccggctgaagaagcagcaggaggagctggagcagatgaggctgcgctacctggccgctgaggagaaggacacagtgaagacagagcggcaggagctgctggacatcagaaatgagctgaaccggctgcggcagcaggagcagaagcagtaccaggacagcacagagatcgccagcggcaagaaggatggcccccacggctctgtgctggaggagggcctggatgactacctgacccggctgattgaggagcgggacaccctgatgaggactggagtgtacaaccacgaggaccgcatcatcagcgagctggaccggcagatccgggagatcctggccaagagcaatgccagcaactag

SEQ ID NO: 147054 - DNA, 2961 bp, Artificial Sequence; identical to SEQ ID NO: 147052
  Description of Artificial Sequence: Synthetic coding sequence

SEQ ID NO: 147055 - DNA, 1143 bp, Artificial Sequence
  Description of Artificial Sequence: Synthetic coding sequence
atggtgtccaagagtgaccagctgctgattgtggtgtccatcctggagggccgccacttccccaagaggcccaagcacatgctggtggtggaggccaagtttgatggagagcagctggccacagatcctgtggaccacacagaccagcctgagtttgccacagagctggcctgggagattgacaggaaggccctgcaccagcaccggctgcagaggacccccatcaagctgcagtgctttgccctggaccctgtgaccagcgccaaggagaccatcggctacatcgtgctggacctgaggacagcccaggagaccaagcaggcccccaagtggtaccagctgctgagcaacaagtacaccaagttcaagtctgagatccagatcagcatcgccctggagacagacaccaagccccctgtggacagcttcaaggccaagggggcccccccaagagatggcaaggtgcctgccatcctggccggcctggacccccgggacatcgtggccgtgctgaatgaggagggcggctaccaccagatcggccctgctgagtactgcacagacagcttcatcatgtctgtgaccatcgcctttgccacccagctggagcagctgatcccctgcaccatgaagctgcctgagcggcagcctgagttcttcttctactacagcctgctgggcaatgatgtgaccaatgagcccttcaatgacctgatcaaccccaactttgagcctgagcgggcctctgtgcgcatccgcagctctgtggagatcctgcgggtgtacctggccctgcagagcaagctgcagatccacctgtgctgcggggaccagagcctgggcagcacagagatccccctgaccggcctgctgaagaagggcagcacagagatcaaccagcaccctgtgacagtggagggcgccttcaccctggacccccccaacagagccaagcagaagctggcccccatccctgtggagctggcccccaccgtgggcgtgtctgtggccctgcagcgggagggcatcgacagccaggatgccttctggtacagcgccctggacatcatcttccccctcttcatcttcctgttcctggtgctggatgccatcaggaagtttgccaactatgaggagaagtag

SEQ ID NO: 147056 - DNA, 3828 bp, Artificial Sequence
  Description of Artificial Sequence: Synthetic coding sequence
atgagcctggactttggatctgtggccctgcctgtgcagaatgaagatgaggagtatgatgaggaggactatgaaagagagaaggagctgcagcagctgctgacagacctgccccatgacatgctggatgatgacctgagcagccctgagctgcagtacagcgactgcagtgaagatggaacagatggccagccccaccaccctgagcagctggagatgtcctggaatgagcagatgctgcccaagagccagagcgtgaatggccccagctgccagggcctggagccctacaacaaggtgacctacaagccctaccagagcagcgcccagaacaacggcagccctgcccaggagatcaccggcagtgacacctttgagggcctgcagcagcagttcctgggcgccaatgaaaattctgctgagaacatgcagatcatccagctgcaggtgctgaacaaggccaaggagcggcagctggagaacctgattgagaagctgaatgaaagtgagcggcagatccgctacctgaaccaccagctggtgatcatcaaggatgagaaggatggcctgaccctgagcctgcgggagagccagaagctgttccagaatggcaaggagcgggagatccagctggaggcccagatcaaggccctggagacccagatccaggccctgaaggtgaatgaggagcagatgatcaagaagagcaggaccacagagatggccctggagagcctgaagcagcagctggtggacctgcaccacagcgagagcctgcagagggcccgggagcagcacgagagcatcgtgatgggcctgaccaagaagtatgaggagcaggtgctgagcctgcagaagaacctggatgccaccgtgacagccctgaaggagcaggaggacatctgcagccggctgaaggaccacgtgaagcagctggagaggaaccaggaggccatcaagctggagaagacagagatcatcaacaagctgaccaggagcctggaggagagccagaagcagtgtgcccacctgctgcagagcggctctgtgcaggaggtggcccagctgcagttccagctgcagcaggcccagaaggcccacgccatgtctgccaacatgaacaaggccctgcaggaggagctgacagagctgaaggatgagatcagcctgtatgaatctgctgccaagctgggcatccaccccagcgacagcgagggggagctgaacatcgagctgacagagagctatgtggacctgggcatcaagaaggtgaactggaagaagagcaaggtgaccagcatcgtgcaggaggaggaccccaatgaggagctgagcaaggatgagttcatcctgaagctgaaggccgaggtgcagaggctgctgggcagcaacagcatgaagaggcacctggtgtcccagctgcagaatgacctgaaggactgccacaagaagattgaggacctgcaccaggtgaagaaggatgagaagagcattgaggtggagaccaagacagacaccagcgagaagcccaagaaccagctgtggccagagagcagcaccagtgatgtggtgagagatgacatcctgctgctgaagaatgagatccaggtgctgcagcagcagaaccaggagctgaaggagacagagggcaagctgaggaacaccaaccaggacctgtgcaaccagatgaggcagatggtgcaggactttgaccatgacaagcaggaggccgtggacagatgtgagaggacctaccagcagcaccacgaggccatgaagacccagatccgggagagcctgctggccaagcacgccctggagaagcagcagctgtttgaggcctatgaaagaacccacctgcagctgcggtctgagctggacaagctgaacaaggaggtgacagctgtgcaggagtgctacctggaggtgtgccgggagaaggacaacctggagctgaccctgaggaagaccacagagaaggagcagcagacccaggagaagatcaaggagaagctgatccagcagctggagaaggagtggcagagcaagctggaccagaccatcaaggccatgaagaagaagaccctggactgtggcagccagacagaccaggtgaccaccagtgatgtgatcagcaagaaggagatggccatcatgattgaggagcagaagtgcaccatccagcagaacctggagcaggagaaggacatcgccatcaagggggccatgaagaagctggagattgagctggagctgaagcactgtgagaacatcaccaagcaggtggagattgctgtgcagaatgcccaccagcgctggctgggggagctgcctgagctggccgagtaccaggccctggtgaaggccgagcagaagaagtgggaggagcagcacgaggtgtctgtgaacaagaggatcagctttgctgtgtctgaggccaaggagaagtggaagtctgagctggagaacatgaggaagaacatcctgcccgggaaggagctggaggagaagatccacagcctgcagaaggagctggagctgaagaatgaggaggtgcctgtggtgatccgggcagagctggccaaggcccggtctgagtggaacaaggagaagcaggaggagatccaccgcatccaggagcagaatgagcaggactaccggcagttcctggatgaccacaggaacaagatcaatgaggtgctggccgccgccaaggaggacttcatgaagcagaagacagagctgctgctgcagaaggagacagagctgcagacctgcctggaccagagcagaagagagtggaccatgcaggaggccaagaggatccagctggagatctaccagtatgaggaggacatcctgactgtgctgggcgtgctgctgagtgacacccagaaggagcacatcagtgacagcgaggacaagcagctgctggagatcatgagcacctgcagcagcaagtggatgtctgtgcagtactttgagaagctgaagggctgcatccagaaggccttccaggacaccctgcccctgctggtggagaatgctgaccctgagtggaagaagaggaacatggccgagctgagcaaggacagcgccagccagggcaccggccagggcgaccccggccctgctgctggccaccacgcccagcccctggccctgcaggccacagaggccgaggccgacaagaagaaggtgctggagatcaaggacctgtgctgcggccactgcttccaggagctggagaaggccaagcaggagtgccaggacctgaagggcaagctggagaagtgctgccgccacctgcagcacctggagaggaagcacaaggctgtggtggagaagattggagaggagaacaacaaggtggtggaggagctgattgaagaaaataatgacatgaagaacaagctggaggagctgcagaccctgtgcaagaccccacccaggagcctgtctgctggggccattgaaaatgcctgcctgccctgcagcggcggggccctggaggagctgcggggccagtacatcaaggctgtgaagaagatcaagtgtgacatgctgcgctacatccaggagagcaaggagagagctgctgagatggtgaaggccgaggtgctgcgggagcggcaggagacagccaggaagatgaggaagtactacctgatctgcctgcagcagatcctgcaggatgatggcaaggagggcgctgagaagaagatcatgaatgctgccagcaagctggccaccatggccaagctgctggagacccccatcagcagcaagagccagagcaagaccacccagagcggcatgagcaagtag

SEQ ID NO: 147057 - DNA, 5133 bp, Artificial Sequence
  Description of Artificial Sequence: Synthetic coding sequence
atgagcctggactttggatctgtggccctgcctgtgcagaatgaagatgaggagtatgatgaggaggactatgaaagagagaaggagctgcagcagctgctgacagacctgccccatgacatgctggatgatgacctgagcagccctgagctgcagtacagcgactgcagtgaagatggaacagatggccagccccaccaccctgagcagctggagatgtcctggaatgagcagatgctgcccaagagccagagcgtgaatggctacaatgagatccagagcctgtatgctggggagaagtgtggaaatgtgtgggaggagaacagaagcaagacagaagatagacaccctgtgtaccaccctgaggagggcggagatgagggcggcagcggctacagcccccccagcaaatgtgagcagacagacctgtaccacctgcctgagaacttccggccctacaccaacggccagaagcaggagttcaacaaccaggccaccaacgtcatcaagttcagtgacccccagtggaaccacttccagggccccagctgccagggcctggagccctacaacaaggtgacctacaagccctaccagagcagcgcccagaacaacggcagccctgcccaggagatcactggaagtgacacctttgagggcctgcagcagcagttcctgggcgccaatgaaaacagcgctgagaacatgcagatcatccagctgcaggtgctgaacaaggccaaggagcggcagctggagaacctgattgagaagctgaatgaaagtgagcggcagatccgctacctgaaccaccagctggtgatcatcaaggatgagaaggatggcctgaccctgagcctgcgggagagccagaagctgttccagaatggcaaggagcgggagatccagctggaggcccagatcaaggccctggagacccagatccaggccctgaaggtgaatgaggagcagatgatcaagaagagcaggaccacagagatggccctggagagcctgaagcagcagctggtggacctgcaccacagcgagagcctgcagagggcccgggagcagcacgagagcatcgtgatgggcctgaccaagaagtatgaggagcaggtgctgagcctgcagaagaacctggatgccaccgtgacagccctgaaggagcaggaggacatctgcagccggctgaaggaccacgtgaagcagctggagaggaaccaggaggccatcaagctggagaagacagagatcatcaacaagctgaccaggagcctggaggagagccagaagcagtgtgcccacctgctgcagagcggctctgtgcaggaggtggcccagctgcagttccagctgcagcaggcccagaaggcccacgccatgtctgccaacatgaacaaggccctgcaggaggagctgacagagctgaaggatgagatcagcctgtatgagagcgctgccaagctgggcatccaccccagcgacagcgagggggagctgaacatcgagctgacagagagctatgtggacctgggcatcaagaaggtgaactggaagaagagcaaggtgaccagcatcgtgcaggaggaggaccccaatgaggagctgagcaaggatgagttcatcctgaagctgaaggccgaggtgcagaggctgctgggcagcaacagcatgaagaggcacctggtgtcccagctgcagaatgacctgaaggactgccacaagaagattgaggacctgcaccaggtgaagaaggatgagaagagcattgaggtggagaccaagacagacaccagcgagaagcccaagaaccagctgtggccagagagcagcaccagtgatgtggtgagagatgacatcctgctgctgaagaatgagatccaggtgctgcagcagcagaaccaggagctgaaggagacagagggcaagctgaggaacaccaaccaggacctgtgcaaccagatgaggcagatggtgcaggactttgaccatgacaagcaggaggccgtggacagatgtgagaggacctaccagcagcaccacgaggccatgaagacccagatccgggagagcctgctggccaagcacgccctggagaagcagcagctgtttgaggcctatgaaagaacccacctgcagctgcggtctgagctggacaagctgaacaaggaggtgacagctgtgcaggagtgctacctggaggtgtgccgggagaaggacaacctggagctgaccctgaggaagaccacagagaaggagcagcagacccaggagaagatcaaggagaagctgatccagcagctggagaaggagtggcagagcaagctggaccagaccatcaaggccatgaagaagaagaccctggactgtggcagccagacagaccaggtgaccaccagtgatgtgatcagcaagaaggagatggccatcatgattgaggagcagaagtgcaccatccagcagaacctggagcaggagaaggacatcgccatcaagggggccatgaagaagctggagattgagctggagctgaagcactgtgagaacatcaccaagcaggtggagattgctgtgcagaatgcccaccagcgctggctgggggagctgcctgagctggccgagtaccaggccctggtgaaggccgagcagaagaagtgggaggagcagcacgaggtgtctgtgaacaagaggatcagctttgctgtgtctgaggccaaggagaagtggaagtctgagctggagaacatgaggaagaacatcctgcccgggaaggagctggaggagaagatccacagcctgcagaaggagctggagctgaagaatgaggaggtgcctgtggtgatccgggcagagctggccaaggcccggtctgagtggaacaaggagaagcaggaggagatccaccgcatccaggagcagaatgagcaggactaccggcagttcctggatgaccacaggaacaagatcaatgaggtgctggccgccgccaaggaggacttcatgaagcagaagacagagctgctgctgcagaaggagacagagctgcagacctgcctggaccagagccggcgggagtggaccatgcaggaggccaagaggatccagctggagatctaccagtatgaggaggacatcctgactgtgctgggcgtgctgctgagtgacacccagaaggagcacatcagtgacagcgaggacaagcagctgctggagatcatgagcacctgcagcagcaagtggatgtctgtgcagtactttgagaagctgaagggctgcatccagaaggccttccaggacaccctgcccctgctggtggagaatgctgaccctgagtggaagaagaggaacatggccgagctgagcaaggacagcgccagccagggcaccggccagggcgaccccggccctgctgctggccaccacgcccagcccctggccctgcaggccacagaagctgaggccgacaagaagaaggtgctggagatcaaggacctgtgctgcggccactgcttccaggagctggagaaggccaagcaggagtgccaggacctgaagggcaagctggagaagtgctgccgccacctgcagcacctggagaggaagcacaaggctgtggtggagaagatcggggaggagaacaacaaggtggtggaggagctgattgaggagaacaatgacatgaagaacaagctggaggagctgcagaccctgtgcaagaccccacccaggagcctgtctgctggggccattgaaaatgcctgcctgccctgcagcggcggggccctggaggagctgcggggccagtacatcaaggctgtgaagaagatcaagtgtgacatgctgcgctacatccaggagagcaaggagagagctgctgagatggtgaaggccgaggtgctgcgggagcggcaggagacagccaggaagatgaggaagtactacctgatctgcctgcagcagatcctgcaggatgatggcaaggagggcgctgagaagaagatcatgaatgctgccagcaagctggccaccatggccaagctgctggagacccccatcagcagcaagagccagagcaagaccacccagagcgccctgcccctgaccagcgagatgctgattgctgtgaagaagagcaagagaaatgatgtgaaccagaagatcccctgctgcatcgagagcaagagcaacagcgtgaacaccatcaccaggaccctgtgtgagcaggcccccaagagaagagctgcctgcaacctgcagaggctgctggagaacagcgagcaccagagcatcaagcacgtgggcagcaaggagacccacctggagttccagtttggagatggcagctgcaagcacctgaacagcctgcccagaaatgtgtccccagagtttgtgccctgtgagggggagggcggcttcggcctgcacaagaagaaggacctgctgagtgacaatggaagtgagagcctgccccacagcgctgcctaccccttcctgggcaccctgggcaacaagcccagcccccgctgcaccccaggccccagcgagagcggctgcatgcacatcaccttccgggacagcaatgaaaggctgggcctgaaggtgtacaagtgcaaccccctgatggagagtgaaaatgctgccagcgagaagagccagggcctggatgtgcaggagccccctgtgaaggatggaggagacctgagtgactgcctgggctggcccagcagcagcgccaccctgagctttgacagccgggaggccagctttgtgcacggccggccccagggcaccctggagatccccagcgagagcgtgaagagcaagcagttcagccccagcggctacctgagtgacacagaggagagcaacatgatctgccagaccatgaagtgccagcgctaccagaccccctacctgtctgaggagaccacctacctggagcccgggaagatctctgtgaactgtggccaccccagccgccacaaggctgaccggctgaagagtgacttcaagaagctgagcagcaccctgcccagctctgtgtgccagcagcccagcaggaagctgattgtgcccctgagcagccagcaggacagcggctttgacagcccctttgtgaacctggactag

SEQ ID NO: 147058 - DNA, 4965 bp, Artificial Sequence
  Description of Artificial Sequence: Synthetic coding sequence
atgagcctggactttggatctgtggccctgcctgtgcagaatgaagatgaggagtatgatgaggaggactatgaaagagagaaggagctgcagcagctgctgacagacctgccccatgacatgctggatgatgacctgagcagccctgagctgcagtacagcgactgcagtgaagatggaacagatggccagccccaccaccctgagcagctggagatgtcctggaatgagcagatgctgcccaagagccagagcgtgaatggctacaatgagatccagagcctgtatgctggggagaagtgtggaaatgtgtgggaggagaacagaagcaagacagaagatagacaccctgtgtaccaccctgaggagggcggagatgagggcggcagcggctacagcccccccagcaaatgtgagcagacagacctgtaccacctgcctgagaacttccggccctacaccaacggccagaagcaggagttcaacaaccaggccaccaacgtcatcaagttcagtgacccccagtggaaccacttccagggccccagctgccagggcctggagccctacaacaaggtgacctacaagccctaccagagcagcgcccagaacaacggcagccctgcccaggagatcactggaagtgacacctttgagggcctgcagcagcagttcctgggcgccaatgaaaacagcgctgagaacatgcagatcatccagctgcaggtgctgaacaaggccaaggagcggcagctggagaacctgattgagaagctgaatgaaagtgagcggcagatccgctacctgaaccaccagctggtgatcatcaaggatgagaaggatggcctgaccctgagcctgcgggagagccagaagctgttccagaatggcaaggagcgggagatccagctggaggcccagatcaaggccctggagacccagatccaggccctgaaggtgaatgaggagcagatgatcaagaagagcaggaccacagagatggccctggagagcctgaagcagcagctggtggacctgcaccacagcgagagcctgcagagggcccgggagcagcacgagagcatcgtgatgggcctgaccaagaagtatgaggagcaggtgctgagcctgcagaagaacctggatgccaccgtgacagccctgaaggagcaggaggacatctgcagccggctgaaggaccacgtgaagcagctggagaggaaccaggaggccatcaagctggagaagacagagatcatcaacaagctgaccaggagcctggaggagagccagaagcagtgtgcccacctgctgcagagcggctctgtgcaggaggtggcccagctgcagttccagctgcagcaggcccagaaggcccacgccatgtctgccaacatgaacaaggccctgcaggaggagctgacagagctgaaggatgagatcagcctgtatgagagcgctgccaagctgggcatccaccccagcgacagcgagggggagctgaacatcgagctgacagagagctatgtggacctgggcatcaagaaggtgaactggaagaagagcaaggtgaccagcatcgtgcaggaggaggaccccaatgaggagctgagcaaggatgagttcatcctgaagctgaaggccgaggtgcagaggctgctgggcagcaacagcatgaagaggcacctggtgtcccagctgcagaatgacctgaaggactgccacaagaagattgaggacctgcaccaggtgaagaaggatgagaagagcattgaggtggagaccaagacagacaccagcgagaagcccaagaaccagctgtggccagagagcagcaccagtgatgtggtgagagatgacatcctgctgctgaagaatgagatccaggtgctgcagcagcagaaccaggagctgaaggagacagagggcaagctgaggaacaccaaccaggacctgtgcaaccagatgaggcagatggtgcaggactttgaccatgacaagcaggaggccgtggacagatgtgagaggacctaccagcagcaccacgaggccatgaagacccagatccgggagagcctgctggccaagcacgccctggagaagcagcagctgtttgaggcctatgaaagaacccacctgcagctgcggtctgagctggacaagctgaacaaggaggtgacagctgtgcaggagtgctacctggaggtgtgccgggagaaggacaacctggagctgaccctgaggaagaccacagagaaggagcagcagacccaggagaagatcaaggagaagctgatccagcagctggagaaggagtggcagagcaagctggaccagaccatcaaggccatgaagaagaagaccctggactgtggcagccagacagaccaggtgaccaccagtgatgtgatcagcaagaaggagatggccatcatgattgaggagcagaagtgcaccatccagcagaacctggagcaggagaaggacatcgccatcaagggggccatgaagaagctggagattgagctggagctgaagcactgtgagaacatcaccaagcaggtggagattgctgtgcagaatgcccaccagcgctggctgggggagctgcctgagctggccgagtaccaggccctggtgaaggccgagcagaagaagtgggaggagcagcacgaggtgtctgtgaacaagaggatcagctttgctgtgtctgaggccaaggagaagtggaagtctgagctggagaacatgaggaagaacatcctgcccgggaaggagctggaggagaagatccacagcctgcagaaggagctggagctgaagaatgaggaggtgcctgtggtgatccgggcagagctggccaaggcccggtctgagtggaacaaggagaagcaggaggagatccaccgcatccaggagcagaatgagcaggactaccggcagttcctggatgaccacaggaacaagatcaatgaggtgctggccgccgccaaggaggacttcatgaagcagaagacagagctgctgctgcagaaggagacagagctgcagacctgcctggaccagagccggcgggagtggaccatgcaggaggccaagaggatccagctggagatctaccagtatgaggaggacatcctgactgtgctgggcgtgctgctgagtgacacccagaaggagcacatcagtgacagcgaggacaagcagctgctggagatcatgagcacctgcagcagcaagtggatgtctgtgcagtactttgagaagctgaagggctgcatccagaaggccttccaggacaccctgcccctgctggtggagaatgctgaccctgagtggaagaagaggaacatggccgagctgagcaaggacagcgccagccagggcaccggccagggcgaccccggccctgctgctggccaccacgcccagcccctggccctgcaggccacagaagctgaggccgaggagaacaacaaggtggtggaggagctgattgaggagaacaatgacatgaagaacaagctggaggagctgcagaccctgtgcaagaccccacccaggagcctgtctgctggggccattgaaaatgcctgcctgccctgcagcggcggggccctggaggagctgcggggccagtacatcaaggctgtgaagaagatcaagtgtgacatgctgcgctacatccaggagagcaaggagagagctgctgagatggtgaaggccgaggtgctgcgggagcggcaggagacagccaggaagatgaggaagtactacctgatctgcctgcagcagatcctgcaggatgatggcaaggagggcgctgagaagaagatcatgaatgctgccagcaagctggccaccatggccaagctgctggagacccccatcagcagcaagagccagagcaagaccacccagagcgccctgcccctgaccagcgagatgctgattgctgtgaagaagagcaagagaaatgatgtgaaccagaagatcccctgctgcatcgagagcaagagcaacagcgtgaacaccatcaccaggaccctgtgtgagcaggcccccaagagaagagctgcctgcaacctgcagaggctgctggagaacagcgagcaccagagcatcaagcacgtgggcagcaaggagacccacctggagttccagtttggagatggcagctgcaagcacctgaacagcctgcccagaaatgtgtccccagagtttgtgccctgtgagggggagggcggcttcggcctgcacaagaagaaggacctgctgagtgacaatggaagtgagagcctgccccacagcgctgcctaccccttcctgggcaccctgggcaacaagcccagcccccgctgcaccccaggccccagcgagagcggctgcatgcacatcaccttccgggacagcaatgaaaggctgggcctgaaggtgtacaagtgcaaccccctgatggagagtgaaaatgctgccagcgagaagagccagggcctggatgtgcaggagccccctgtgaaggatggaggagacctgagtgactgcctgggctggcccagcagcagcgccaccctgagctttgacagccgggaggccagctttgtgcacggccggccccagggcaccctggagatccccagcgagagcgtgaagagcaagcagttcagccccagcggctacctgagtgacacagaggagagcaacatgatctgccagaccatgaagtgccagcgctaccagaccccctacctgtctgaggagaccacctacctggagcccgggaagatctctgtgaactgtggccaccccagccgccacaaggctgaccggctgaagagtgacttcaagaagctgagcagcaccctgcccagctctgtgtgccagcagcccagcaggaagctgattgtgcccctgagcagccagcaggacagcggctttgacagcccctttgtgaacctggactag

SEQ ID NO: 147059 - DNA, 1779 bp, Artificial Sequence
  Description of Artificial Sequence: Synthetic coding sequence
atgagcctggactttggatctgtggccctgcctgtgcagaatgaagatgaggagtatgatgaggaggactatgaaagagagaaggagctgcagcagctgctgacagacctgccccatgacatgctggatgatgacctgagcagccctgagctgcagtacagcgactgcagtgaagatggaacagatggccagccccaccaccctgagcagctggagatgtcctggaatgagcagatgctgcccaagagccagagcgtgaatggctacaatgagatccagagcctgtatgctggggagaagtgtggaaatgtgtgggaggagaacagaagcaagacagaagatagacaccctgtgtaccaccctgaggagggcggagatgagggcggcagcggctacagcccccccagcaaatgtgagcagacagacctgtaccacctgcctgagaacttccggccctacaccaacggccagaagcaggagttcaacaaccaggccaccaacgtcatcaagttcagtgacccccagtggaaccacttccagggccccagctgccagggcctggagccctacaacaaggtgacctacaagccctaccagagcagcgcccagaacaacggcagccctgcccaggagatcactggaagtgacacctttgagggcctgcagcagcagttcctgggcgccaatgaaaacagcgctgagaacatgcagatcatccagctgcaggtgctgaacaaggccaaggagcggcagctggagaacctgattgagaagctgaatgaaagtgagcggcagatccgctacctgaaccaccagctggtgatcatcaaggatgagaaggatggcctgaccctgagcctgcgggagagccagaagctgttccagaatggcaaggagcgggagatccagctggaggcccagatcaaggccctggagacccagatccaggccctgaaggtgaatgaggagcagatgatcaagaagagcaggaccacagagatggccctggagagcctgaagcagcagctggtggacctgcaccacagcgagagcctgcagagggcccgggagcagcacgagagcatcgtgatgggcctgaccaagaagtatgaggagcaggtgctgagcctgcagaagaacctggatgccaccgtgacagccctgaaggagcaggaggacatctgcagccggctgaaggaccacgtgaagcagctggagaggaaccaggaggccatcaagctggagaagacagagatcatcaacaagctgaccaggagcctggaggagagccagaagcagtgtgcccacctgctgcagagcggctctgtgcaggaggtggcccagctgcagttccagctgcagcaggcccagaaggcccacgccatgtctgccaacatgaacaaggccctgcaggaggagctgacagagctgaaggatgagatcagcctgtatgagagcgctgccaagctgggcatccaccccagcgacagcgagggggagctgaacatcgagctgacagagagctatgtggacctgggcatcaagaaggtgaactggaagaagagcaaggtgaccagcatcgtgcaggaggaggaccccaatgaggagctgagcaaggatgagttcatcctgaagctgaaggccgaggtgcagaggctgctgggcagcaacagcatgaagaggcacctggtgtcccagctgcagaatgacctgaaggactgccacaagaagattgaggacctgcaccaggtgaagaagaagaagaagaagaagaagtag

SEQ ID NO: 147060 - DNA, 207 bp, Artificial Sequence
  Description of Artificial Sequence: Synthetic coding sequence
atgagcctggactttggatctgtggccctgcctgtgcagaatgaagatgaggagtatgatgaggaggactatgaaagagagaaggagctgcagcagctgctgacagacctgccccatgacatgctggatgatgacctgagcagccctgagctgcagtacagcgactgcagtgaagatggaacagatggccagccccaccacccctag

SEQ ID NO: 147061 - DNA, 4755 bp, Artificial Sequence
  Description of Artificial Sequence: Synthetic coding sequence
atgagcctgacctcctggttcctggtgtcctctgggggcaccaggcaccggctgccccgggagatgatctttgtgggcagagatgactgtgagctgatgctgcagagccgctctgtggacaagcagcacgccgtcatcaactatgatgccagcacagatgagcacctggtgaaggacctgggcagcctgaatggcacctttgtgaatgatgtgcgcatccctgagcagacctacatcaccctgaagctggaggacaagctgcgcttcggctatgacaccaacctcttcaccgtggtgcagggcgagatgagggtgcctgaggaggccctgaagcatgagaagttcaccatccagctgcagctgagccagaagagcagcgagagcgagctgagcaagagcgccagcgccaagagcattgacagcaaggtggctgatgctgccacagaggtgcagcacaagaccacagaggccctgaagtctgaggagaaggccatggacatcagcgccatgccccggggcacccccctgtatggccagcccagctggtggggagatgatgaggtggatgagaagagggccttcaagaccaacgggaagccagaggagaagaaccatgaagctggcaccagcggctgcggcattgatgccaagcaggtggaggagcagagcgctgctgccaatgaggaggtgctcttccccttctgccgggagcccagctactttgagatccccaccaaggagttccagcagcccagccagatcacagagagcaccatccacgagatccccaccaaggacacccccagcagccacatcactggagctggccacgccagcttcaccatcgagtttgatgacagcaccccaggcaaggtgaccatccgggaccacgtgaccaagttcaccagtgaccagaggcacaagagcaagaagagcagccctggcacccaggacctgctgggcatccagacaggcatgatggcccctgagaacaaggtggccgactggctggcccagaacaaccccccccagatgctgtgggagaggacagaggaggacagcaagagcatcaagagtgatgtgcctgtgtacctgaagaggctgaagggcaacaagcatgatgatggcacccagagcgacagtgaaaatgctggggcccaccggcgctgcagcaagagggccaccctggaggagcacctgcggcggcaccacagcgagcacaagaagctgcagaaggtgcaggccacagagaagcaccaggaccaggccgtgaccagcagcgcccaccaccggggcggccacggcgtgccccacggcaagctgctgaagcagaagtctgaggagcccagcgtgtccatccccttcctgcagacagccctgctgcggagcagcggcagcctgggccaccggcccagccaggagatggacaagatgctgaagaaccaggccaccagcgccaccagcgagaaggacaatgatgatgaccagagcgacaagggcacctacaccatcgagctggagaaccccaacagcgaggaggtggaggccaggaagatgattgacaaggtgtttggagtggatgacaaccaggactacaacagacctgtgatcaatgagaagcacaaggacctgatcaaggactgggccctgagcagcgctgctgctgtgatggaggagaggaagcccctgaccaccagcggcttccaccacagcgaggagggcaccagcagcagcggcagcaagcgctgggtgtcccagtgggccagcctggccgccaaccacaccaggcatgaccaggaggagcgcatcatggagttcagcgcccccctgcccctggagaatgaaacagagatcagcgagagcggcatgacagtgcgcagcacaggcagcgccaccagcctggccagccagggcgagaggagaagaaggaccctgccccagctgcccaatgaggagaagagcctggagagccaccgggccaaggtggtgacccagaggagtgaaattggagagaagcaggacacagagctgcaggagaaggagacccccacccaggtgtaccagaaggacaagcaggatgctgaccggcccctgagcaagatgaacagagctgtgaatggagagaccctgaagacaggaggagacaacaagaccctgctgcacctgggcagcagcgcccctgggaaggagaagtcagaaacagacaaggagaccagcctggtgaagcagaccctggccaagctgcagcagcaggagcagcgggaggaggcccagtggacccccaccaagctgagcagcaagaatgtgtctggccagacagacaagtgccgggaggagaccttcaagcaggagagccagcccccagagaagaacagcggccacagcaccagcaagggggacagagtggcccagagcgagagcaagaggaggaaggccgaggagatcctgaagagccagacccccaagggcggggacaagaaggagagcagcaagagcctggtgcggcagggcagcttcaccatcgagaagcccagccccaacatccccatcgagctgatcccccacatcaacaagcagaccagcagcacccccagcagcctggccctgaccagcgccagccgcatccgggagaggtctgagagcctggaccctgacagctccatggacaccaccctcatcctgaaggacacagaagctgtgatggccttcctggaggccaagctgcgggaggacaacaagacagatgagggccctgacacccccagctacaacagagacaacagcatcagccctgagagtgatgtggacacagccagcaccatcagcctggtgactggagaaacagagaggaagagcacccagaagaggaagagcttcaccagcctgtacaaggaccgctgcagcacaggcagccccagcaaggatgtgaccaagagcagcagcagcggggcccgggagaagatggagaagaagaccaagagccgcagcacagatgtgggcagcagagcagatggcaggaagtttgtgcagagcagcggccgcatccggcagcccagcgtggacctgacagatgatgaccagaccagctctgtgccccacagcgccatcagtgacatcatgagcagtgaccaggagacctacagctgcaagccccacggccgcacccccctgaccagcgcagatgaacatgtgcacagcaagctggagggcagcaaggtgaccaagagcaagaccagccctgtggtgtctggcagcagcagcaagagcaccaccctgccccggccccggcccaccaggaccagcctgctgcggcgggcccggctgggggaggccagtgacagcgagctggctgatgctgacaaggcctctgtggccagcgaggtgtccaccaccagcagcaccagcaagcccccaactggaagaagaaacatcagcagaattgacctgctggcccagcccaggaggacccggctgggcagcctgagcgcccggagtgacagcgaggccaccatcagccgcagcagcgccagcagcaggacagctgaggccatcatccgcagcggggcccggctggtgcccagcgacaagttcagcccccgcatccgggccaacagcatcagccggctgagtgacagcaaggtgaagtccatgaccagcgcccacggcagcgcctctgtgaacagccgctggaggcgcttccccacagattatgccagcaccagtgaagatgaatttggcagcaacagaaacagccccaagcacacccggctgcggaccagccctgccctgaagaccacccggctgcagagcgctggcagcgccatgcccaccagcagcagcttcaagcaccgcatcaaggagcaggaggactacatccgggactggacagcccaccgggaggagatcgcccgcatcagccaggacctggccctgattgcccgggagatcaatgatgtggccggggagattgattctgtgaccagcagcggcacagcccccagcaccaccgtgtccacagctgccaccaccccaggcagcgccatcgacacccgggaggagctggtggacagagtgtttgatgagagcctgaacttcaggaagatcccccccctggtgcacagcaagaccccagagggcaacaacggccgcagcggggacccccggccccaggccgctgagcccccagaccacctgaccatcaccaggaggaggacctggagcagagatgaggtgatgggagacaacctgctgctgagcagcgtcttccagttcagcaagaagatccggcagagcattgacaagacagctgggaagatccgcatcctcttcaaggacaaggacaggaactgggatgacatcgagagcaagctgcgggcagagagcgaggtgcccatcgtgaagaccagctccatggagatcagcagcatcctgcaggagctgaagagggtggagaagcagctgcaggccatcaatgccatgattgatcctgatggcaccctggaggccctgaacaacatgggcttccccagcgccatgctgcccagcccccccaagcagaagagcagccctgtgaacaaccaccacagccctggccagacccccaccctgggccagcctgaggcccgggccctgcaccctgctgctgtgtctgctgctgctgagtttgaaaatgctgagagcgaggccgacttcagcatccacttcaaccgcttcaacccagatggagaggaggaggatgtgacagtgcaggagtag

SEQ ID NO: 147062 - DNA, 4383 bp, Artificial Sequence
  Description of Artificial Sequence: Synthetic coding sequence
atgagcctgacctcctggttcctggtgtcctctgggggcaccaggcaccggctgccccgggagatgatctttgtgggcagagatgactgtgagctgatgctgcagagccgctctgtggacaagcagcacgccgtcatcaactatgatgccagcacagatgagcacctggtgaaggacctgggcagcctgaatggcacctttgtgaatgatgtgcgcatccctgagcagacctacatcaccctgaagctggaggacaagctgcgcttcggctatgacaccaacctcttcaccgtggtgcagggcgagatgagggtgcctgaggaggccctgaagcatgagaagttcaccatccagctgcagctgagccagaagagcagcgagagcgagctgagcaagagcgccagcgccaagagcattgacagcaaggtggctgatgctgccacagaggtgcagcacaagaccacagaggccctgaagtctgaggagaaggccatggacatcagcgccatgccccggggcacccccctgtatggccagcccagctggtggggagatgatgaggtggatgagaagagggccttcaagaccaacgggaagccagaggagaagaaccatgaagctggcaccagcggctgcggcattgatgccaagcaggtggaggagcagagcgctgctgccaatgaggaggtgctcttccccttctgccgggagcccagctactttgagatccccaccaaggagttccagcagcccagccagatcacagagagcaccatccacgagatccccaccaaggacacccccagcagccacatcactggagctggccacgccagcttcaccatcgagtttgatgacagcaccccaggcaaggtgaccatccgggaccacgtgaccaagttcaccagtgaccagaggcacaagagcaagaagagcagccctggcacccaggacctgctgggcatccagacaggcatgatggcccctgagaacaaggtggccgactggctggcccagaacaaccccccccagatgctgtgggagaggacagaggaggacagcaagagcatcaagagtgatgtgcctgtgtacctgaagaggctgaagggcaacaagcatgatgatggcacccagagcgacagtgaaaatgctggggcccaccggcgctgcagcaagagggccaccctggaggagcacctgcggcggcaccacagcgagcacaagaagctgcagaaggtgcaggccacagagaagcaccaggaccaggccgtggtgtttggagtggatgacaaccaggactacaacagacctgtgatcaatgagaagcacaaggacctgatcaaggactgggccctgagcagcgctgctgctgtgatggaggagaggaagcccctgaccaccagcggcttccaccacagcgaggagggcaccagcagcagcggcagcaagcgctgggtgtcccagtgggccagcctggccgccaaccacaccaggcatgaccaggaggagcgcatcatggagttcagcgcccccctgcccctggagaatgaaacagagatcagcgagagcggcatgacagtgcgcagcacaggcagcgccaccagcctggccagccagggcgagaggagaagaaggaccctgccccagctgcccaatgaggagaagagcctggagagccaccgggccaaggtggtgacccagaggagtgaaattggagagaagcaggacacagagctgcaggagaaggagacccccacccaggtgtaccagaaggacaagcaggatgctgaccggcccctgagcaagatgaacagagctgtgaatggagagaccctgaagacaggaggagacaacaagaccctgctgcacctgggcagcagcgcccctgggaaggagaagtcagaaacagacaaggagaccagcctggtgaagcagaccctggccaagctgcagcagcaggagcagcgggaggaggcccagtggacccccaccaagctgagcagcaagaatgtgtctggccagacagacaagtgccgggaggagaccttcaagcaggagagccagcccccagagaagaacagcggccacagcaccagcaagggggacagagtggcccagagcgagagcaagaggaggaaggccgaggagatcctgaagagccagacccccaagggcggggacaagaaggagagcagcaagagcctggtgcggcagggcagcttcaccatcgagaagcccagccccaacatccccatcgagctgatcccccacatcaacaagcagaccagcagcacccccagcagcctggccctgaccagcgccagccgcatccgggagaggtctgagagcctggaccctgacagctccatggacaccaccctcatcctgaaggacacagaagctgtgatggccttcctggaggccaagctgcgggaggacaacaagacagatgagggccctgacacccccagctacaacagagacaacagcatcagccctgagagtgatgtggacacagccagcaccatcagcctggtgactggagaaacagagaggaagagcacccagaagaggaagagcttcaccagcctgtacaaggaccgctgcagcacaggcagccccagcaaggatgtgaccaagagcagcagcagcggggcccgggagaagatggagaagaagaccaagagccgcagcacagatgtgggcagcagagcagatggcaggaagtttgtgcagagcagcggccgcatccggcagcccagcgtggacctgacagatgatgaccagaccagctctgtgccccacagcgccatcagtgacatcatgagcagtgaccaggagacctacagctgcaagccccacggccgcacccccctgaccagcgcagatgaacatgtgcacagcaagctggagggcagcaaggtgaccaagagcaagaccagccctgtggtgtctggcagcagcagcaagagcaccaccctgccccggccccggcccaccaggaccagcctgctgcggcgggcccggctgggggaggccagtgacagcgagctggctgatgctgacaaggcctctgtggccagcgaggtgtccaccaccagcagcaccagcaagcccccaactggaagaagaaacatcagcagaattgacctgctggcccagcccaggaggacccggctgggcagcctgagcgcccggagtgacagcgaggccaccatcagccgcagcagcgccagcagcaggacagctgaggccatcatccgcagcggggcccggctggtgcccagcgacaagttcagcccccgcatccgggccaacagcatcagccggctgagtgacagcaaggtgaagtccatgaccagcgcccacggcagcgccagcgccctgaagaccacccggctgcagagcgctggcagcgccatgcccaccagcagcagcttcaagcaccgcatcaaggagcaggaggactacatccgggactggacagcccaccgggaggagatcgcccgcatcagccaggacctggccctgattgcccgggagatcaatgatgtggccggggagattgattctgtgaccagcagcggcacagcccccagcaccaccgtgtccacagctgccaccaccccaggcagcgccatcgacacccgggaggaggtgggggacctgcacggggagatgcacaagctggtggacagagtgtttgatgagagcctgaacttcaggaagatcccccccctggtgcacagcaagaccccagagggcaacaacggccgcagcggggacccccggccccaggccgctgagcccccagaccacctgaccatcaccaggaggaggacctggagcagagatgaggtgatgggagacaacctgctgctgagcagcgtcttccagttcagcaagaagatccggcagagcattgacaagacagctgggaagatccgcatcctcttcaaggacaaggacaggaactgggatgacatcgagagcaagctgcgggcagagagcgaggtgcccatcgtgaagaccagctccatggagatcagcagcatcctgcaggagctgaagagggtggagaagcagctgcaggccatcaatgccatgattgatcctgatggcaccctggaggccctgaacaacatgggcttccccagcgccatgctgcccagcccccccaagcagaagagcagccctgtgaacaaccaccacagccctggccagacccccaccctgggccagcctgaggcccgggccctgcaccctgctgctgtgtctgctgctgctgagtttgaaaatgctgagagcgaggccgacttcagcatccacttcaaccgcttcaacccagatggagaggaggaggatgtgacagtgcaggagtag

SEQ ID NO: 147063 - DNA, 4461 bp, Artificial Sequence
  Description of Artificial Sequence: Synthetic coding sequence
atgagcctgacctcctggttcctggtgtcctctgggggcaccaggcaccggctgccccgggagatgatctttgtgggcagagatgactgtgagctgatgctgcagagccgctctgtggacaagcagcacgccgtcatcaactatgatgccagcacagatgagcacctggtgaaggacctgggcagcctgaatggcacctttgtgaatgatgtgcgcatccctgagcagacctacatcaccctgaagctggaggacaagctgcgcttcggctatgacaccaacctcttcaccgtggtgcagggcgagatgagggtgcctgaggaggccctgaagcatgagaagttcaccatccagctgcagctgagccagaagagcagcgagagcgagctgagcaagagcgccagcgccaagagcattgacagcaaggtggctgatgctgccacagaggtgcagcacaagaccacagaggccctgaagtctgaggagaaggccatggacatcagcgccatgccccggggcacccccctgtatggccagcccagctggtggggagatgatgaggtggatgagaagagggccttcaagaccaacgggaagccagaggagaagaaccatgaagctggcaccagcggctgcggcattgatgccaagcaggtggaggagcagagcgctgctgccaatgaggaggtgctcttccccttctgccgggagcccagctactttgagatccccaccaaggagttccagcagcccagccagatcacagagagcaccatccacgagatccccaccaaggacacccccagcagccacatcactggagctggccacgccagcttcaccatcgagtttgatgacagcaccccaggcaaggtgaccatccgggaccacgtgaccaagttcaccagtgaccagaggcacaagagcaagaagagcagccctggcacccaggacctgctgggcatccagacaggcatgatggcccctgagaacaaggtggccgactggctggcccagaacaaccccccccagatgctgtgggagaggacagaggaggacagcaagagcatcaagagtgatgtgcctgtgtacctgaagaggctgaagggcaacaagcatgatgatggcacccagagcgacagtgaaaatgctggggcccaccggcgctgcagcaagagggccaccctggaggagcacctgcggcggcaccacagcgagcacaagaagctgcagaaggtgcaggccacagagaagcaccaggaccaggccgtggtgtttggagtggatgacaaccaggactacaacagacctgtgatcaatgagaagcacaaggacctgatcaaggactgggccctgagcagcgctgctgctgtgatggaggagaggaagcccctgaccaccagcggcttccaccacagcgaggagggcaccagcagcagcggcagcaagcgctgggtgtcccagtgggccagcctggccgccaaccacaccaggcatgaccaggaggagcgcatcatggagttcagcgcccccctgcccctggagaatgaaacagagatcagcgagagcggcatgacagtgcgcagcacaggcagcgccaccagcctggccagccagggcgagaggagaagaaggaccctgccccagctgcccaatgaggagaagagcctggagagccaccgggccaaggtggtgacccagaggagtgaaattggagagaagcaggacacagagctgcaggagaaggagacccccacccaggtgtaccagaaggacaagcaggatgctgaccggcccctgagcaagatgaacagagctgtgaatggagagaccctgaagacaggaggagacaacaagaccctgctgcacctgggcagcagcgcccctgggaaggagaagtcagaaacagacaaggagaccagcctggtgaagcagaccctggccaagctgcagcagcaggagcagcgggaggaggcccagtggacccccaccaagctgagcagcaagaatgtgtctggccagacagacaagtgccgggaggagaccttcaagcaggagagccagcccccagagaagaacagcggccacagcaccagcaagggggacagagtggcccagagcgagagcaagaggaggaaggccgaggagatcctgaagagccagacccccaagggcggggacaagaaggagagcagcaagagcctggtgcggcagggcagcttcaccatcgagaagcccagccccaacatccccatcgagctgatcccccacatcaacaagcagaccagcagcacccccagcagcctggccctgaccagcgccagccgcatccgggagaggtctgagagcctggaccctgacagctccatggacaccaccctcatcctgaaggacacagaagctgtgatggccttcctggaggccaagctgcgggaggacaacaagacagatgagggccctgacacccccagctacaacagagacaacagcatcagccctgagagtgatgtggacacagccagcaccatcagcctggtgactggagaaacagagaggaagagcacccagaagaggaagagcttcaccagcctgtacaaggaccgctgcagcacaggcagccccagcaaggatgtgaccaagagcagcagcagcggggcccgggagaagatggagaagaagaccaagagccgcagcacagatgtgggcagcagagcagatggcaggaagtttgtgcagagcagcggccgcatccggcagcccagcgtggacctgacagatgatgaccagaccagctctgtgccccacagcgccatcagtgacatcatgagcagtgaccaggagacctacagctgcaagccccacggccgcacccccctgaccagcgcagatgaacatgtgcacagcaagctggagggcagcaaggtgaccaagagcaagaccagccctgtggtgtctggcagcagcagcaagagcaccaccctgccccggccccggcccaccaggaccagcctgctgcggcgggcccggctgggggaggccagtgacagcgagctggctgatgctgacaaggcctctgtggccagcgaggtgtccaccaccagcagcaccagcaagcccccaactggaagaagaaacatcagcagaattgacctgctggcccagcccaggaggacccggctgggcagcctgagcgcccggagtgacagcgaggccaccatcagccgcagcagcgccagcagcaggacagctgaggccatcatccgcagcggggcccggctggtgcccagcgacaagttcagcccccgcatccgggccaacagcatcagccggctgagtgacagcaaggtgaagtccatgaccagcgcccacggcagcgcctctgtgaacagccgctggaggcgcttccccacagattatgccagcaccagtgaagatgaatttggcagcaacagaaacagccccaagcacacccggctgcggaccagccctgccctgaagaccacccggctgcagagcgctggcagcgccatgcccaccagcagcagcttcaagcaccgcatcaaggagcaggaggactacatccgggactggacagcccaccgggaggagatcgcccgcatcagccaggacctggccctgattgcccgggagatcaatgatgtggccggggagattgattctgtgaccagcagcggcacagcccccagcaccaccgtgtccacagctgccaccaccccaggcagcgccatcgacacccgggaggagctggtggacagagtgtttgatgagagcctgaacttcaggaagatcccccccctggtgcacagcaagaccccagagggcaacaacggccgcagcggggacccccggccccaggccgctgagcccccagaccacctgaccatcaccaggaggaggacctggagcagagatgaggtgatgggagacaacctgctgctgagcagcgtcttccagttcagcaagaagatccggcagagcattgacaagacagctgggaagatccgcatcctcttcaaggacaaggacaggaactgggatgacatcgagagcaagctgcgggcagagagcgaggtgcccatcgtgaagaccagctccatggagatcagcagcatcctgcaggagctgaagagggtggagaagcagctgcaggccatcaatgccatgattgatcctgatggcaccctggaggccctgaacaacatgggcttccccagcgccatgctgcccagcccccccaagcagaagagcagccctgtgaacaaccaccacagccctggccagacccccaccctgggccagcctgaggcccgggccctgcaccctgctgctgtgtctgctgctgctgagtttgaaaatgctgagagcgaggccgacttcagcatccacttcaaccgcttcaacccagatggagaggaggaggatgtgacagtgcaggagtag

SEQ ID NO: 147064 - DNA, 1239 bp, Artificial Sequence
  Description of Artificial Sequence: Synthetic coding sequence
atgagggtgcctgaggaggccctgaagcatgagaagttcaccatccagctgcagctgagccagaagagcagcgagagcgagctgagcaagagcgccagcgccaagagcattgacagcaaggtggctgatgctgccacagaggtgcagcacaagaccacagaggccctgaagtctgaggagaaggccatggacatcagcgccatgccccggggcacccccctgtatggccagcccagctggtggggagatgatgaggtggatgagaagagggccttcaagaccaacgggaagccagaggagaagaaccatgaagctggcaccagcggctgcggcattgatgccaagcaggtggaggagcagagcgctgctgccaatgaggaggtgctcttccccttctgccgggagcccagctactttgagatccccaccaaggagttccagcagcccagccagatcacagagagcaccatccacgagatccccaccaaggacacccccagcagccacatcactggagctggccacgccagcttcaccatcgagtttgatgacagcaccccaggcaaggtgaccatccgggaccacgtgaccaagttcaccagtgaccagaggcacaagagcaagaagagcagccctggcacccaggacctgctgggcatccagacaggcatgatggcccctgagaacaaggtggccgactggctggcccagaacaaccccccccagatgctgtgggagaggacagaggaggacagcaagagcatcaagagtgatgtgcctgtgtacctgaagaggctgaagggcaacaagcatgatgatggcacccagagcgacagtgaaaatgctggggcccaccggcgctgcagcaagagggccaccctggaggagcacctgcggcggcaccacagcgagcacaagaagctgcagaaggtgcaggccacagagaagcaccaggaccaggccgtgaccagcagcgcccaccaccggggcggccacggcgtgccccacggcaagctgctgaagcagaagtctgaggagcccagcgtgtccatccccttcctgcagacagccctgctgcggagcagcggcagcctgggccaccggcccagccaggagatggacaagatgctgaagaaccaggccgactgtggctctgtggccttctgtggcttcatgatcttcaagctgaacctgatgatcacccccttccccttcatcgacctcttctccttcttctag

SEQ ID NO: 147065 - DNA, 402 bp, Artificial Sequence
  Description of Artificial Sequence: Synthetic coding sequence
atgagcctgacctcctggttcctggtgtcctctgggggcaccaggcaccggctgccccgggagatgatctttgtgggcagagatgactgtgagctgatgctgcagagccgctctgtggacaagcagcacgccgtcatcaactatgatgccagcacagatgagcacctggtgaaggacctgggcagcctgaatggcacctttgtgaatgatgtgcgcatccctgagcagacctacatcaccctgaagctggaggacaagctgcgcttcggctatgacaccaacctcttcaccgtggtgcagggcgagatgagggtgcctgaggaggccctgaagcatgagaagttcaccatccagctgcagctgagccagaagagcagcgagagcgagctgagcaagagctag

SEQ ID NO: 147066 - DNA, 267 bp, Artificial Sequence
  Description of Artificial Sequence: Synthetic coding sequence
atgagcctgacctcctggttcctggtgtcctctgggggcaccaggcaccggctgccccgggagatgatctttgtgggcagagatgactgtgagctgatgctgcagagccgctctgtggacaagcagcacgccgtcatcaactatgatgccagcacagatgagcacctggtgaaggacctgggcagcctgaatggcacctttgtgaatgatgtgcgcatccctgagcagacctacatcaccctgaagctggaggacaagctgaggtag

SEQ ID NO: 147067 - DNA, 336 bp, Artificial Sequence
  Description of Artificial Sequence: Synthetic coding sequence
atgagcctgacctcctggttcctggtgtcctctgggggcaccaggcaccggctgccccgggagatgatctttgtgggcagagatgactgtgagctgatgctgcagagccgctctgtggacaagcagcacgccgtcatcaactatgatgccagcacagatgagcacctggtgaaggacctgggcagcctgaatggcacctttgtgaatgatgtgcgcatccctgagcagacctacatcaccctgaagctggaggacaagctgcgcttcggctatgacaccaacctcttcaccgtggtgcagggcgagatgagggtgcctgaggaggccctgaagtag

SEQ ID NO: 147068 - DNA, 1407 bp, Artificial Sequence
  Description of Artificial Sequence: Synthetic coding sequence
atgagcagtgaccaggagacctacagctgcaagccccacggccgcacccccctgaccagcgcagatgagcacgtgcacagcaagctggagggcagcaaggtgaccaagagcaagaccagccctgtggtgtctggcagcagcagcaagagcaccaccctgccccggccccggcccaccaggaccagcctgctgcggcgggcccggctgggggaggccagtgacagcgagctggctgatgctgacaaggcctctgtggccagcgaggtgtccaccaccagcagcaccagcaagccacccaccggcagaagaaacatcagcagaattgacctgctggcccagcccaggaggacccggctgggcagcctgagcgcccggagtgacagcgaggccaccatcagccgcagcagcgccagcagcaggacagctgaggccatcatccgcagcggggcccggctggtgcccagcgacaagttcagcccccgcatccgggccaacagcatcagccggctgagtgacagcaaggtgaagtccatgaccagcgcccacggcagcgccagcgccctgaagaccacccggctgcagagcgctggcagcgccatgcccaccagcagcagcttcaagcaccgcatcaaggagcaggaggactacatccgggactggacagcccaccgggaggagatcgcccgcatcagccaggacctggccctgattgcccgggagatcaatgatgtggccggggagattgacagcgtgaccagcagcggcacagcccccagcaccaccgtgtccacagctgccaccaccccaggcagcgccatcgacacccgggaggaggtgggggacctgcatggagagatgcacaagctggtggacagagtgtttgatgagagcctgaacttcaggaagatcccccccctggtgcacagcaagaccccagagggcaacaacggccgcagcggggacccccggccccaggccgctgagcccccagaccacctgaccatcaccaggaggaggacctggagcagagatgaggtgatgggagacaacctgctgctgagctctgtgttccagttcagcaagaagatccggcagagcattgacaagacagctgggaagatccgcatcctcttcaaggacaaggacaggaactgggatgacatcgagagcaagctgcgggcagagagcgaggtgcccatcgtgaagaccagctccatggagatcagcagcatcctgcaggagctgaagagggtggagaagcagctgcaggccatcaatgccatgattgatcctgatggcaccctggaggccctgaacaacatgggcttccccagcgccatgctgcccagcccccccaagcagaagagcagccctgtgaacaaccaccacagccctgccatgctgtag

SEQ ID NO: 147069 - DNA, 7161 bp, Artificial Sequence
  Description of Artificial Sequence: Synthetic coding sequence
atggagaccaggagccctggcctgaacaacatgaagccccagagcctgcagctggtgctggaggagcaggtgctggccctgcagcagcagatggccgagaaccaggccgcctcctggaggaagctgaagaacagccaggaggcccagcagaggcaggccaccctggtgaggaagctgcaggccaaggtgctgcagtaccgctcctggtgccaggagctggagaagaggctggaggccaccggcggccccatcccccagcgctgggagaatgtggaggagcccaacctggatgagctgctggtgcggctggaggaggagcagcagagatgtgagagcctggccgaggtgaacacccagctgcggctgcacatggagaaggcagatgtggtgaacaaggccctgcgggaggatgtggagaagctgactgtggactggagccgggccagagatgagctgatgaggaaggagagccagtggcagatggagcaggagttcttcaagggctacctgaagggggagcacggccgcctgctgagcctgtggagggaggtggtgaccttccgccgccacttcctggagatgaagagcgccacagaccgggacctgatggagctgaaggccgagcacgtgcggctgagcggcagcctgctgacctgctgcctgcggctgactgtgggcgcccagagccgggagcccaatggaagtggccgcatggatggccgggagcccgcccagctgctgctgctgctggccaagacccaggagctggagaaggaggcccacgagaggagccaggagctgatccagctgaagagccagggcgacctggagaaggccgagctgcaggacagagtgacagagctgagcgccctgctgacccagagccagaagcagaatgaagattatgagaagatgatcaaggccctgcgggagaccgtggagatcctggagaccaaccacacagagctgatggagcacgaggccagcctgagcagaaatgcccaggaggagaagctgagcctgcagcaggtgatcaaggacatcacccaggtgatggtggaggagggggacaacatcgcccagggcagcggccacgagaacagcctggagctggacagcagcatcttcagccagtttgactaccaggatgctgacaaggccctgaccctggtgcgctctgtgctgacccggcggcggcaggccgtgcaggacctgcggcagcagctggccggctgccaggaggccgtgaacctgctgcagcagcagcacgaccagtgggaggaggagggcaaggccctgcggcagaggctgcagaagctgactggagagcgggacaccctggccggccagacagtggacctgcagggcgaggtggacagcctgagcaaggagcgggagctgctgcagaaggcccgggaggagctgcggcagcagctggaggtgctggagcaggaggcctggaggctgcggcgggtgaatgtggagctgcagctgcagggcgacagcgcccagggccagaaggaggagcagcaggaggagctgcacctggccgtgcgggagcgggagcggctgcaggagatgctgatgggcctggaggccaagcagagcgagagcctgtctgagctgatcaccctgcgggaggccctggagagcagccacctggagggggagctgctgcggcaggagcagacagaggtgacagctgccctggcccgggcagagcagagcattgctgagctgagcagcagcgagaacaccctgaagacagaggtggccgacctgcgggctgctgctgtgaagctgagcgccctgaatgaggccctggccctggacaaggtgggcctgaaccagcagctgctgcagctggaggaggagaaccagagcgtgtgcagcaggatggaggccgctgagcaggccagaaatgccctgcaggtggacctggccgaggccgagaagagaagagaggccctgtgggagaagaacacccacctggaggcccagctgcagaaggccgaggaggccggggctgagctgcaggccgacctgcgggacatccaggaggagaaggaggagatccagaagaagctgtctgagagccgccaccagcaggaggccgccaccacccagctggagcagctgcaccaggaggccaagaggcaggaggaggtgctggcccgggctgtgcaggagaaggaggccctggtgcgggagaaggccgccctggaggtgcggctgcaggccgtggagcgggaccggcaggacctggccgagcagctgcagggcctgagcagcgccaaggagctgctggagagcagcctgtttgaggcccagcagcagaacagcgtgattgaggtgaccaagggccagctggaggtgcagatccagacagtgacccaggccaaggaggtgatccagggcgaggtgcgctgcctgaagctggagctggacacagagaggagccaggccgagcaggagagagatgctgctgcccggcagctggcccaggccgagcaggagggcaagacagccctggagcagcagaaggccgcccacgagaaggaggtgaaccagctgcgggagaagtggatgcagctggagacagagaaggagcgggtgtccctgctggagaccctgctgcagacccagaaggagctggctgatgccagccagcagctggagcggctgcggcaggacatgaaggtgcagaagctgaaggagcaggagaccaccggcatcctgcagacccagctgcaggaggcccagcgggagctgaaggaggccgcccggcagcacagagatgacctggccgccctgcaggaggagagcagcagcctgctgcaggacaagatggacctgcagaagcaggtggaggacctgaagagccagctggtggcccaggatgacagccagaggctggtggagcaggaggtgcaggagaagctgcgggagacccaggagtacaaccgcatccagaaggagctggagcgggagaaggccagcctgaccctgagcctgatggagaaggagcagaggctgctggtgctgcaggaggccgacagcatccggcagcaggagctgagcgccctgcggcaggacatgcaggaggcccagggcgagcagaaggagctgagcgcccagatggagctgctgcggcaggaggtgaaggagaaggaggccgacttcctggcccaggaggcccagctgctggaggagctggaggccagccacatcacagagcagcagctgcgggccagcctgtgggcccaggaggccaaggccgcccagctgcagctgcggctgcggagcacagagagccagctggaggccctggccgctgagcagcagcccggcaaccaggcccaggcccaggcccagctggccagcctgtacagcgccctgcagcaggccctgggctctgtgtgtgagagcaggcctgagctgagcggcggcggggacagcgcccccagcgtgtggggcctggagccagaccagaatggagcccggagcctcttcaagaggggccccctgctgacagccctgtctgctgaggccgtggccagcgccctgcacaagctgcaccaggacctgtggaagacccagcagaccagagatgtgctgcgggaccaggtgcagaagctggaggagcggctgacagacacagaggccgagaagagccaggtgcacacagagctgcaggacctgcagaggcagctgagccagaaccaggaggagaagagcaagtgggagggcaagcagaacagcctggagagcgagctgatggagctgcacgagaccatggccagcctgcagagccggctgcggcgggcagagctgcagaggatggaggcccagggcgagcgggagctgctgcaggccgccaaggagaacctgacagcccaggtggagcacctgcaggccgctgtggtggaggcccgggcccaggccagcgctgctggcatcctggaggaggacctgaggacagcccggagcgccctgaagctgaagaatgaggaggtggagagcgagcgggagcgggcccaggccctgcaggagcagggcgagctgaaggtggcccagggcaaggccctgcaggagaacctggccctgctgacccagaccctggccgagcgggaggaggaggtggagaccctgcggggccagatccaggagctggagaagcagcgggagatgcagaaggccgccctggagctgctgagcctggacctgaagaagaggaaccaggaggtggacctgcagcaggagcagatccaggagctggagaagtgccgctctgtgctggagcacctgcccatggctgtgcaggagcgggagcagaagctgactgtgcagcgggagcagatccgggagctggagaaggaccgggagacccagagaaatgtgctggagcaccagctgctggagctggagaagaaggaccagatgattgagagccagaggggccaggtgcaggacctgaagaagcagctggtgaccctggagtgcctggccctggagctggaggagaaccaccacaagatggagtgccagcagaagctgatcaaggagctggagggccagcgggagacccagagggtggccctgacccacctgaccctggacctggaggagaggagccaggagctgcaggcccagagcagccagatccatgacctggagagccacagcacagtgctggcccgggagctgcaggagcgggaccaggaggtgaagagccagcgggagcagatcgaggagctgcagaggcagaaggagcacctgacccaggacctggagcggcgggaccaggagctgatgctgcagaaggagcgcatccaggtgctggaggaccagaggacccggcagaccaagatcctggaggaggacctggagcagatcaagctgagcctgcgggagcggggccgggagctgaccacccagaggcagctgatgcaggagcgggcagaggagggcaagggccccagcaaggcccagaggggcagcctggagcacatgaagctgatcctgcgggacaaggagaaggaggtggagtgccagcaggagcacatccacgagctgcaggagctgaaggaccagctggagcagcagctgcagggcctgcacaggaaggtgggggagaccagcctgctgctgagccagcgggagcaggagatcgtggtgctgcagcagcagctgcaggaggcccgggagcagggcgagctgaaggagcagagcctgcagagccagctggatgaggcccagagggccctggcccagagggaccaggagctggaggccctgcagcaggagcagcagcaggcccagggccaggaggagcgggtgaaggagaaggcagatgccctgcagggcgccctggagcaggcccacatgaccctgaaggagcggcacggggagctgcaggaccacaaggagcaggcccggcggctggaggaggagctggccgtggagggccggcgggtgcaggccctggaggaggtgctgggggacctgcgggcagagagccgggagcaggagaaggccctgctggccctgcagcagcagtgtgccgagcaggcccaggagcacgaggtggagacccgggccctgcaggacagctggctgcaggcccaggccgtgctgaaggagcgggaccaggagctggaggccctgcgggcagagagccagagcagccgccaccaggaggaggccgcccgggcccgggcagaggccctgcaggaggccctgggcaaggcccatgctgccctgcagggcaaggagcagcacctgctggagcaggccgagctgagccgcagcctggaggccagcacagccaccctgcaggccagcctggatgcctgccaggcccacagccggcagctggaggaggccctgcgcatccaggagggggagatccaggaccaggacctgcgctaccaggaggatgtgcagcagctgcagcaggccctggcccagagagatgaggagctgcggcaccagcaggagcgggagcagctgctggagaagagcctggcccagagggtgcaggagaacatgatccaggagaagcagaacctgggccaggagcgggaggaggaggagatccggggcctgcaccagagcgtgcgggagctgcagctgaccctggcccagaaggagcaggagatcctggagctgcgggagacccagcagaggaacaacctggaggccctgccccacagccacaagaccagccccatggaggagcagagcctgaagctggacagcctggagccccggctgcagcgggagctggagcggctgcaggccgccctgcggcagacagaggcccgggagattgagtggagggagaaggcccaggacctggccctgagcctggcccagaccaaggcctctgtgagcagcctgcaggaggtggccatgttcctgcaggcctctgtgctggagcgggacagcgagcagcagaggctgcaggatgagctggagctgacccggcgggccctggagaaggagcggctgcacagccctggggccaccagcacagctgagctgggcagcagaggagagcagggcgtgcagctgggggaggtgtctggagtggaggccgagcccagcccagatggcatggagaagcagagctggaggcagaggctggagcacctgcagcaggccgtggcccggctggagattgacaggagccggctgcagaggcacaacgtgcagctgcggagcaccctggagcaggtggagcgggagaggaggaagctgaagcgggaggccatgagagctgcccaggccggcagcctggagatcagcaaggccacagccagcagccccacccagcaggacggccggggccagaagaacagtgatgccaagtgtgtggccgagctgcagaaggaggtggtgctgctgcaggcccagctgaccctggagaggaagcagaagcaggactacatcaccaggtctgcccagaccagccgggagctggccggcctgcaccacagcctgagccacagcctgctggccgtggcccaggcccctgaggccaccgtgctggaggccgagacccggcggctggatgagagcctgacccagagcctgaccagccctggccctgtgctgctgcaccccagccccagcaccacccaggccgccagcaggtag

SEQ ID NO: 147070 - DNA, 1020 bp, Artificial Sequence
  Description of Artificial Sequence: Synthetic coding sequence
atggagaccaggagccctggcctgaacaacatgaagccccagagcctgcagctggtgctggaggagcaggtgctggccctgcagcagcagatggccgagaaccaggccgcctcctggaggaagctgaagaacagccaggaggcccagcagaggcaggccaccctggtgaggaagctgcaggccaaggtgctgcagtaccgctcctggtgccaggagctggagaagaggctggaggccaccggcggccccatcccccagcgctgggagaatgtggaggagcccaacctggatgagctgctggtgcggctggaggaggagcagcagagatgtgagagcctggccgaggtgaacacccagctgcggctgcacatggagaaggcagatgtggtgaacaaggccctgcgggaggatgtggagaagctgactgtggactggagccgggccagagatgagctgatgaggaaggagagccagtggcagatggagcaggagttcttcaagggctacctgaagggggagcacggccgcctgctgagcctgtggagggaggtggtgaccttccgccgccacttcctggagatgaagagcgccacagaccgggacctgatggagctgaaggccgagcacgtgcggctgagcggcagcctgctgacctgctgcctgcggctgactgtgggcgcccagagccgggagcccaatggaagtggccgcatggatggccgggagcccgcccagctgctgctgctgctggccaagacccaggagctggagaaggaggcccacgagaggagccaggagctgatccagctgaagagccagggcgacctggagaaggccgagctgcaggacagagtgacagagctgagcgccctgctgacccagagccagaagcagaatgaagattatgagaagatgatcaaggccctgcgggagaccgtggagatcctggtgcatgaccccctgctgtggaagggcgtgggccggggcctggtgggcagcctgtgcttcatggacagatag

SEQ ID NO: 147071 - DNA, 7329 bp, Artificial Sequence
  Description of Artificial Sequence: Synthetic coding sequence
atggagaccaggagccctggcctgaacaacatgaagccccagagcctgcagctggtgctggaggagcaggtgctggccctgcagcagcagatggccgagaaccaggccgcctcctggaggaagctgaagaacagccaggaggcccagcagaggcaggccaccctggtgaggaagctgcaggccaaggtgctgcagtaccgctcctggtgccaggagctggagaagaggctggaggccaccggcggccccatcccccagcgctgggagaatgtggaggagcccaacctggatgagctgctggtgcggctggaggaggagcagcagagatgtgagagcctggccgaggtgaacacccagctgcggctgcacatggagaaggcagatgtggtgaacaaggccctgcgggaggatgtggagaagctgactgtggactggagccgggccagagatgagctgatgaggaaggagagccagtggcagatggagcaggagttcttcaagggctacctgaagggggagcacggccgcctgctgagcctgtggagggaggtggtgaccttccgccgccacttcctggagatgaagagcgccacagaccgggacctgatggagctgaaggccgagcacgtgcggctgagcggcagcctgctgacctgctgcctgcggctgactgtgggcgcccagagccgggagcccaatggaagtggccgcatggatggccgggagcccgcccagctgctgctgctgctggccaagacccaggagctggagaaggaggcccacgagaggagccaggagctgatccagctgaagagccagggcgacctggagaaggccgagctgcaggacagagtgacagagctgagcgccctgctgacccagagccagaagcagaatgaagattatgagaagatgatcaaggccctgcgggagaccgtggagatcctggagaccaaccacacagagctgatggagcacgaggccagcctgagcagaaatgcccaggaggagaagctgagcctgcagcaggtgatcaaggacatcacccaggtgatggtggaggagggggacaacatcgcccagggcagcggccacgagaacagcctggagctggacagcagcatcttcagccagtttgactaccaggatgctgacaaggccctgaccctggtgcgctctgtgctgacccggcggcggcaggccgtgcaggacctgcggcagcagctggccggctgccaggaggccgtgaacctgctgcagcagcagcacgaccagtgggaggaggagggcaaggccctgcggcagaggctgcagaagctgactggagagcgggacaccctggccggccagacagtggacctgcagggcgaggtggacagcctgagcaaggagcgggagctgctgcagaaggcccgggaggagctgcggcagcagctggaggtgctggagcaggaggcctggaggctgcggcgggtgaatgtggagctgcagctgcagggcgacagcgcccagggccagaaggaggagcagcaggaggagctgcacctggccgtgcgggagcgggagcggctgcaggagatgctgatgggcctggaggccaagcagagcgagagcctgtctgagctgatcaccctgcgggaggccctggagagcagccacctggagggggagctgctgcggcaggagcagacagaggtgacagctgccctggcccgggcagagcagagcattgctgagctgagcagcagcgagaacaccctgaagacagaggtggccgacctgcgggctgctgctgtgaagctgagcgccctgaatgaggccctggccctggacaaggtgggcctgaaccagcagctgctgcagctggaggaggagaaccagagcgtgtgcagcaggatggaggccgctgagcaggccagaaatgccctgcaggtggacctggccgaggccgagaagagaagagaggccctgtgggagaagaacacccacctggaggcccagctgcagaaggccgaggaggccggggctgagctgcaggccgacctgcgggacatccaggaggagaaggaggagatccagaagaagctgtctgagagccgccaccagcaggaggccgccaccacccagctggagcagctgcaccaggaggccaagaggcaggaggaggtgctggcccgggctgtgcaggagaaggaggccctggtgcgggagaaggccgccctggaggtgcggctgcaggccgtggagcgggaccggcaggacctggccgagcagctgcagggcctgagcagcgccaaggagctgctggagagcagcctgtttgaggcccagcagcagaacagcgtgattgaggtgaccaagggccagctggaggtgcagatccagacagtgacccaggccaaggaggtgatccagggcgaggtgcgctgcctgaagctggagctggacacagagaggagccaggccgagcaggagagagatgctgctgcccggcagctggcccaggccgagcaggagggcaagacagccctggagcagcagaaggccgcccacgagaaggaggtgaaccagctgcgggagaagtgggagaaggagaggtcctggcaccagcaggagctggccaaggccctggagagcctggagcgggagaagatggagctggagatgaggctgaaggagcagcagacagagatggaggccatccaggcccagcgggaggaggagaggacccaggccgagagcgccctgtgccagatgcagctggagacagagaaggagcgggtgtccctgctggagaccctgctgcagacccagaaggagctggctgatgccagccagcagctggagcggctgcggcaggacatgaaggtgcagaagctgaaggagcaggagaccaccggcatcctgcagacccagctgcaggaggcccagcgggagctgaaggaggccgcccggcagcacagagatgacctggccgccctgcaggaggagagcagcagcctgctgcaggacaagatggacctgcagaagcaggtggaggacctgaagagccagctggtggcccaggatgacagccagaggctggtggagcaggaggtgcaggagaagctgcgggagacccaggagtacaaccgcatccagaaggagctggagcgggagaaggccagcctgaccctgagcctgatggagaaggagcagaggctgctggtgctgcaggaggccgacagcatccggcagcaggagctgagcgccctgcggcaggacatgcaggaggcccagggcgagcagaaggagctgagcgcccagatggagctgctgcggcaggaggtgaaggagaaggaggccgacttcctggcccaggaggcccagctgctggaggagctggaggccagccacatcacagagcagcagctgcgggccagcctgtgggcccaggaggccaaggccgcccagctgcagctgcggctgcggagcacagagagccagctggaggccctggccgctgagcagcagcccggcaaccaggcccaggcccaggcccagctggccagcctgtacagcgccctgcagcaggccctgggctctgtgtgtgagagcaggcctgagctgagcggcggcggggacagcgcccccagcgtgtggggcctggagccagaccagaatggagcccggagcctcttcaagaggggccccctgctgacagccctgtctgctgaggccgtggccagcgccctgcacaagctgcaccaggacctgtggaagacccagcagaccagagatgtgctgcgggaccaggtgcagaagctggaggagcggctgacagacacagaggccgagaagagccaggtgcacacagagctgcaggacctgcagaggcagctgagccagaaccaggaggagaagagcaagtgggagggcaagcagaacagcctggagagcgagctgatggagctgcacgagaccatggccagcctgcagagccggctgcggcgggcagagctgcagaggatggaggcccagggcgagcgggagctgctgcaggccgccaaggagaacctgacagcccaggtggagcacctgcaggccgctgtggtggaggcccgggcccaggccagcgctgctggcatcctggaggaggacctgaggacagcccggagcgccctgaagctgaagaatgaggaggtggagagcgagcgggagcgggcccaggccctgcaggagcagggcgagctgaaggtggcccagggcaaggccctgcaggagaacctggccctgctgacccagaccctggccgagcgggaggaggaggtggagaccctgcggggccagatccaggagctggagaagcagcgggagatgcagaaggccgccctggagctgctgagcctggacctgaagaagaggaaccaggaggtggacctgcagcaggagcagatccaggagctggagaagtgccgctctgtgctggagcacctgcccatggctgtgcaggagcgggagcagaagctgactgtgcagcgggagcagatccgggagctggagaaggaccgggagacccagagaaatgtgctggagcaccagctgctggagctggagaagaaggaccagatgattgagagccagaggggccaggtgcaggacctgaagaagcagctggtgaccctggagtgcctggccctggagctggaggagaaccaccacaagatggagtgccagcagaagctgatcaaggagctggagggccagcgggagacccagagggtggccctgacccacctgaccctggacctggaggagaggagccaggagctgcaggcccagagcagccagatccatgacctggagagccacagcacagtgctggcccgggagctgcaggagcgggaccaggaggtgaagagccagcgggagcagatcgaggagctgcagaggcagaaggagcacctgacccaggacctggagcggcgggaccaggagctgatgctgcagaaggagcgcatccaggtgctggaggaccagaggacccggcagaccaagatcctggaggaggacctggagcagatcaagctgagcctgcgggagcggggccgggagctgaccacccagaggcagctgatgcaggagcgggcagaggagggcaagggccccagcaaggcccagaggggcagcctggagcacatgaagctgatcctgcgggacaaggagaaggaggtggagtgccagcaggagcacatccacgagctgcaggagctgaaggaccagctggagcagcagctgcagggcctgcacaggaaggtgggggagaccagcctgctgctgagccagcgggagcaggagatcgtggtgctgcagcagcagctgcaggaggcccgggagcagggcgagctgaaggagcagagcctgcagagccagctggatgaggcccagagggccctggcccagagggaccaggagctggaggccctgcagcaggagcagcagcaggcccagggccaggaggagcgggtgaaggagaaggcagatgccctgcagggcgccctggagcaggcccacatgaccctgaaggagcggcacggggagctgcaggaccacaaggagcaggcccggcggctggaggaggagctggccgtggagggccggcgggtgcaggccctggaggaggtgctgggggacctgcgggcagagagccgggagcaggagaaggccctgctggccctgcagcagcagtgtgccgagcaggcccaggagcacgaggtggagacccgggccctgcaggacagctggctgcaggcccaggccgtgctgaaggagcgggaccaggagctggaggccctgcgggcagagagccagagcagccgccaccaggaggaggccgcccgggcccgggcagaggccctgcaggaggccctgggcaaggcccatgctgccctgcagggcaaggagcagcacctgctggagcaggccgagctgagccgcagcctggaggccagcacagccaccctgcaggccagcctggatgcctgccaggcccacagccggcagctggaggaggccctgcgcatccaggagggggagatccaggaccaggacctgcgctaccaggaggatgtgcagcagctgcagcaggccctggcccagagagatgaggagctgcggcaccagcaggagcgggagcagctgctggagaagagcctggcccagagggtgcaggagaacatgatccaggagaagcagaacctgggccaggagcgggaggaggaggagatccggggcctgcaccagagcgtgcgggagctgcagctgaccctggcccagaaggagcaggagatcctggagctgcgggagacccagcagaggaacaacctggaggccctgccccacagccacaagaccagccccatggaggagcagagcctgaagctggacagcctggagccccggctgcagcgggagctggagcggctgcaggccgccctgcggcagacagaggcccgggagattgagtggagggagaaggcccaggacctggccctgagcctggcccagaccaaggcctctgtgagcagcctgcaggaggtggccatgttcctgcaggcctctgtgctggagcgggacagcgagcagcagaggctgcaggatgagctggagctgacccggcgggccctggagaaggagcggctgcacagccctggggccaccagcacagctgagctgggcagcagaggagagcagggcgtgcagctgggggaggtgtctggagtggaggccgagcccagcccagatggcatggagaagcagagctggaggcagaggctggagcacctgcagcaggccgtggcccggctggagattgacaggagccggctgcagaggcacaacgtgcagctgcggagcaccctggagcaggtggagcgggagaggaggaagctgaagcgggaggccatgagagctgcccaggccggcagcctggagatcagcaaggccacagccagcagccccacccagcaggacggccggggccagaagaacagtgatgccaagtgtgtggccgagctgcagaaggaggtggtgctgctgcaggcccagctgaccctggagaggaagcagaagcaggactacatcaccaggtctgcccagaccagccgggagctggccggcctgcaccacagcctgagccacagcctgctggccgtggcccaggcccctgaggccaccgtgctggaggccgagacccggcggctggatgagagcctgacccagagcctgaccagccctggccctgtgctgctgcaccccagccccagcaccacccaggccgccagcaggtag

SEQ ID NO: 147072 - DNA, 345 bp, Artificial Sequence
  Description of Artificial Sequence: Synthetic coding sequence
atggagaccaggagccctggcctgaacaacatgaagccccagagcctgcagctggtgctggaggagcaggtgctggccctgcagcagcagatggccgagaaccaggccgcctcctggaggaagctgaagaacagccaggaggcccagcagaggcaggccaccctggtgaggaagctgcaggccaaggtgctgcagtaccgctcctggtgccaggagctggagaagaggctggaggccaccggcggccccatcccccagcgctgggagaatgtggaggagcccaacctggatgagctgctggtgcggctggaggaggagcagcagagatgtgagagcctggcctag

SEQ ID NO: 147073 - DNA, 2055 bp, Artificial Sequence
  Description of Artificial Sequence: Synthetic coding sequence
atggagaccaggagccctggcctgaacaacatgaagccccagagcctgcagctggtgctggaggagcaggtgctggccctgcagcagcagatggccgagaaccaggccgcctcctggaggaagctgaagaacagccaggaggcccagcagaggcaggccaccctggtgaggaagctgcaggccaaggtgctgcagtaccgctcctggtgccaggagctggagaagaggctggaggccaccggcggccccatcccccagcgctgggagaatgtggaggagcccaacctggatgagctgctggtgcggctggaggaggagcagcagagatgtgagagcctggccgaggtgaacacccagctgcggctgcacatggagaaggcagatgtggtgaacaaggccctgcgggaggatgtggagaagctgactgtggactggagccgggccagagatgagctgatgaggaaggagagccagtggcagatggagcaggagttcttcaagggctacctgaagggggagcacggccgcctgctgagcctgtggagggaggtggtgaccttccgccgccacttcctggagatgaagagcgccacagaccgggacctgatggagctgaaggccgagcacgtgcggctgagcggcagcctgctgacctgctgcctgcggctgactgtgggcgcccagagccgggagcccaatggaagtggccgcatggatggccgggagcccgcccagctgctgctgctgctggccaagacccaggagctggagaaggaggcccacgagaggagccaggagctgatccagctgaagagccagggcgacctggagaaggccgagctgcaggacagagtgacagagctgagcgccctgctgacccagagccagaagcagaatgaagattatgagaagatgatcaaggccctgcgggagaccgtggagatcctgaccaaccacacagagctgatggagcacgaggccagcctgagcagaaatgcccaggaggagaagctgagcctgcagcaggtgatcaaggacatcacccaggtgatggtggaggagggggacaacatcgcccagggcagcggccacgagaacagcctggagctggacagcagcatcttcagccagtttgactaccaggatgctgacaaggccctgaccctggtgcgctctgtgctgacccggcggcggcaggccgtgcaggacctgcggcagcagctggccggctgccaggaggccgtgaacctgctgcagcagcagcacgaccagtgggaggaggagggcaaggccctgcggcagaggctgcagaagctgaccggggagcgggacaccctggccggccagacagtggacctgcagggcgaggtggacagcctgagcaaggagcgggagctgctgcagaaggcccgggaggagctgcggcagcagctggaggtgctggagcaggaggcctggaggctgcggcgggtgaatgtggagctgcagctgcagggcgacagcgcccagggccagaaggaggagcagcaggaggagctgcacctggccgtgcgggagcgggagcggctgcaggagatgctgatgggcctggaggccaagcagagcgagagcctgtctgagctgatcaccctgcgggaggccctggagagcagccacctggagggggagctgctgcggcaggagcagacagaggtgacagctgccctggcccgggcagagcagagcattgctgagctgagcagcagcgagaacaccctgaagacagaggtggccgacctgcgggctgctgctgtgaagctgagcgccctgaatgaggccctggccctggacaaggtgggcctgaaccagcagctgctgcagctggaggaggagaaccagagcgtgtgcagcaggatggaggccgctgagcaggccagaaatgccctgcaggtggacctggccgaggccgagaagaggcgggaggccctgtgggagaagaacacccacctggaggcccagctgcagaaggccgaggaggccggggctgagctgcaggccgacctgcgggacatctag

SEQ ID NO: 147074 - DNA, 495 bp, Artificial Sequence
  Description of Artificial Sequence: Synthetic coding sequence
atggagaccaggagccctggcctgaacaacatgaagccccagagcctgcagctggtgctggaggagcaggtgctggccctgcagcagcagatggccgagaaccaggccgcctcctggaggaagctgaagaacagccaggaggcccagcagaggcaggccaccctggtgaggaagctgcaggccaaggtgctgcagtaccgctcctggtgccaggagctggagaagaggctggaggccaccggcggccccatcccccagcgctgggagaatgtggaggagcccaacctggatgagctgctggtgcggctggaggaggagcagcagagatgtgagagcctggccgaggtgaacacccagctgcggctgcacatggagaaggcagatgtggtgaacaaggccctgcgggaggatgtggagaagctgactgtggactggagccgggccagagatgagctgatgaggaaggagagccagtggcagatggagcaggagtag

SEQ ID NO: 147075 - DNA, 1617 bp, Artificial Sequence
  Description of Artificial Sequence: Synthetic coding sequence
atggagaccaggagccctggcctgaacaacatgaagccccagagcctgcagctggtgctggaggagcaggtgctggccctgcagcagcagatggccgagaaccaggccgcctcctggaggaagctgaagaacagccaggaggcccagcagaggcaggccaccctggtgaggaagctgcaggccaaggtgctgcagtaccgctcctggtgccaggagctggagaagaggctggaggccaccggcggccccatcccccagcgctgggagaatgtggaggagcccaacctggatgagctgctggtgcggctggaggaggagcagcagagatgtgagagcctggccgaggtgaacacccagctgcggctgcacatggagaaggcagatgtggtgaacaaggccctgcgggaggatgtggagaagctgactgtggactggagccgggccagagatgagctgatgaggaaggagagccagtggcagatggagcaggagttcttcaagggctacctgaagggggagcacggccgcctgctgagcctgtggagggaggtggtgaccttccgccgccacttcctggagatgaagagcgccacagaccgggacctgatggagctgaaggccgagcacgtgcggctgagcggcagcctgctgacctgctgcctgcggctgactgtgggcgcccagagccgggagcccaatggaagtggccgcatggatggccgggagcccgcccagctgctgctgctgctggccaagacccaggagctggagaaggaggcccacgagaggagccaggagctgatccagctgaagagccagggcgacctggagaaggccgagctgcaggacagagtgacagagctgagcgccctgctgacccagagccagaagcagaatgaagattatgagaagatgatcaaggccctgcgggagaccgtggagatcctggagaccaaccacacagagctgatggagcacgaggccagcctgagcagaaatgcccaggaggagaagctgagcctgcagcaggtgatcaaggacatcacccaggtgatggtggaggagggggacaacatcgcccagggcagcggccacgagaacagcctggagctggacagcagcatcttcagccagtttgactaccaggatgctgacaaggccctgaccctggtgcgctctgtgctgacccggcggcggcaggccgtgcaggacctgcggcagcagctggccggctgccaggaggccgtgaacctgctgcagcagcagcacgaccagtgggaggaggagggcaaggccctgcggcagaggctgcagaagctgactggagagcgggacaccctggccggccagacagtggacctgcagggcgaggtggacagcctgagcaaggagcgggagctgctgcagaaggcccgggaggagctgcggcagcagctggaggtgctggagcaggaggcctggaggctgcggcgggtgaatgtggagctgcagctgcagggcgacagcgcccagggccagaaggaggagcagcaggaggagctgcacctggccgtgcgggagcgggagcggctgcagagcagccagctgcagagctgccgggtgctgaagaccccctag

SEQ ID NO: 147076 - DNA, 7446 bp, Artificial Sequence
  Description of Artificial Sequence: Synthetic coding sequence
atgccacccaacatcaactggaaggagatcatgaaggtggaccctgatgacctgccccggcaggaggagctggccgacaacctgctgatcagcctgagcaaggtggaggtgaatgagctgaagtctgagaagcaggagaatgtcatccacctgttccgcatcacccagagcctgatgaagatgaaggcccaggaggtggagctggccctggaggaggtggagaaggccggggaggagcaggccaagtttgagaaccagctgaagaccaaggtgatgaagctggagaatgagctggagatggcccagcagagcgctgggggccgggacacccgcttcctgagaaatgagatctgccagctggagaagcagctggagcagaaggaccgggagctggaggacatggagaaggagctggagaaggagaagaaggtgaatgagcagctggccctgagaaatgaggaggccgagaatgaaaacagcaagctgcggcgggagaacaagaggctgaagaagaagaatgagcagctgtgccaggacatcatcgactaccagaagcagattgacagccagaaggagaccctgctgagcagaagaggagaggacagcgactaccgcagccagctgagcaagaagaactatgagctgatccagtacctggatgagatccagaccctgacagaggccaatgagaagattgaggtgcagaaccaggagatgaggaagaacctggaggagagcgtgcaggagatggagaagatgacagatgagtacaacaggatgaaggccatcgtgcaccagacagacaacgtgattgaccagctgaagaaggaaaatgaccactaccagctgcaggtgcaggagctgacagacctgctgaagagcaagaatgaggaggatgaccccatcatggtggccgtgaatgccaaggtggaggagtggaagctgatcctgagcagcaaggatgatgagatcatcgagtaccagcagatgctgcacaacctgcgggagaagctgaagaatgcccagctggatgctgacaagagcaatgtgatggccctgcagcagggcatccaggagcgggacagccagatcaagatgctgacagagcaggtggagcagtacaccaaggagatggagaagaacacctgcatcatcgaggacctgaagaatgagctgcagaggaacaagggggccagcaccctgagccagcagacccacatgaagatccagagcaccctggacatcctgaaggagaagaccaaggaggccgagaggacagctgagctggccgaggctgatgcccgggagaaggacaaggagctggtggaggccctgaagaggctgaaggactatgaaagtggagtgtatggcctggaggatgctgtggtggagatcaagaactgcaagaaccagatcaagatccgggaccgggagattgagatcctgaccaaggagatcaacaagctggagctgaagatcagtgacttcctggatgaaaatgaggccctgcgggagcgggtgggcctggagcccaagaccatgattgacctgacagagttcaggaacagcaagcacctgaagcagcagcagtacagagctgagaaccagatcctgctgaaggaggccagcattgagagcctggaggaggagcggctggacctgaagaagaagatccggcagatggcccaggagcggggcaagaggtctgccaccagcggcctgaccacagaggacctgaacctgacagagaacatcagccagggcgaccgcatcagcgagaggaagctggacctgctgagcctgaagaacatgtctgaggcccagagcaagaatgagttcctgagccgggagctgattgagaaggagcgggacctggagaggagcaggacagtcatcgccaagttccagaacaagctgaaggagctggtggaggagaacaagcagctggaggagggcatgaaggagatcctgcaggccatcaaggagatgcagaaggaccctgatgtgaagggcggggagaccagcctcatcatccccagcctggagcggctggtgaatgccatcgagagcaagaatgctgagggcatctttgatgccagcctgcacctgaaggcccaggtggaccagctgactggaagaaatgaggagctgcggcaggagctgcgggagagcaggaaggaggccatcaactacagccagcagctggccaaggccaacctgaagattgaccacctggagaaggagaccagcctgctgcggcagagcgagggcagcaatgtggtgttcaagggcatcgacctgcctgatggcatcgcccccagcagcgccagcatcatcaacagccagaatgagtacctgatccacctgctgcaggagctggagaacaaggagaagaagctgaagaacctggaggacagcctggaggactacaacaggaagtttgctgtgatccgccaccagcagagcctgctgtacaaggagtacctgtctgagaaggagacctggaagacagagagcaagaccatcaaggaggagaagaggaagctggaggaccaggtgcagcaggatgccatcaaggtgaaggagtacaacaacctgctgaatgccctgcagatggacagtgatgagatgaagaagatcctggccgagaacagcaggaagatcaccgtgctgcaggtgaatgagaagagcctcatccggcagtacaccaccctggtggagctggagcggcagctgaggaaagaaaatgagaagcagaagaatgagctgctgtccatggaggccgaggtgtgtgagaagattggctgcctgcagcgcttcaaggagatggccatcttcaagattgctgccctgcagaaggtggtggacaacagcgtgtccctgtctgagctggagctggccaacaagcagtacaatgagctgacagccaagtacagagacatcctgcagaaggacaacatgctggtgcagaggaccagcaacctggagcacctggagtgtgagaacatcagcctgaaggagcaggtggagagcatcaacaaggagctggagatcaccaaggagaagctgcacaccatcgagcaggcctgggagcaggagaccaagctgggcaatgaaagctccatggacaaggccaagaagagcatcaccaacagcgacatcgtgtccatcagcaagaagatcaccatgctggagatgaaggagctgaatgaaaggcagagagctgagcactgccagaagatgtatgagcacctgcggaccagcctgaagcagatggaggagaggaactttgagctggagaccaagtttgctgagctgaccaagatcaacctggatgcccagaaggtggagcagatgctgagagatgagctggccgacagcgtgtccaaggctgtgtctgatgctgaccggcagaggatcctggagctggagaagaatgagatggagctgaaggtggaggtgtccaagctgcgggagatcagtgacatcgcccggcggcaggtggagatcctgaatgcccagcagcagagccgggacaaggaggtggagagcctgaggatgcagctgctggactaccaggcccagagtgatgagaagagcctcatcgccaagctgcaccagcacaacgtgtccctgcagctgtctgaggccacagccctgggcaagctggagagcatcaccagcaagctgcagaagatggaggcctacaacctgcggctggagcagaagctggatgagaaggagcaggccctgtactatgcccggctggagggcaggaacagagccaagcacctgcggcagaccatccagagcctgcggcggcagttcagcggggccctgcccctggcccagcaggagaagttcagcaagaccatgatccagctgcagaatgacaagctgaagatcatgcaggagatgaagaacagccagcaggagcacaggaacatggagaacaagaccctggagatggagctgaagctgaagggcctggaggagctgatcagcaccctgaaggacaccaagggggcccagaaggtgatcaactggcacatgaagattgaggagctgcggctgcaggagctgaagctgaaccgggagctggtgaaggacaaggaggagatcaagtacctgaacaacatcatcagtgaatatgaaagaaccatcagcagcctggaggaggagatcgtgcagcagaacaagttccacgaggagcggcagatggcctgggaccagcgggaggtggacctggagcggcagctggacatctttgaccggcagcagaatgagatcctgaatgctgcccagaagtttgaggaggccaccggcagcatcccagaccccagcctgcccctgcccaaccagctggagatcgccctgaggaagatcaaggagaacatccgcatcatcctggagacccgggccacctgcaagagcctggaggagaagctgaaggagaaggagagcgccctgcggctggccgagcagaacatcctgagccgggacaaggtgatcaatgagctgcggctgcggctgcctgccacagctgagcgggagaagctgattgctgagctgggcaggaaggagatggagcccaagagccaccacaccctgaagatcgcccaccagaccatcgccaacatgcaggcccggctgaaccagaaggaggaggtgctgaagaagtaccagaggctgctggagaaggcccgggaggagcagcgggagatcgtgaagaagcatgaggaggacctgcacatcctgcaccaccggctggagctgcaggccgacagcagcctgaacaagttcaagcagacagcctgggacctgatgaagcagagccccacccctgtgcccaccaacaagcacttcatccggctggccgagatggagcagacagtggccgagcaggatgacagcctgagcagcctgctggtgaagctgaagaaggtgtcccaggacctggagcggcagcgggagatcacagagctgaaggtgaaggagtttgagaacatcaagctgcagctgcaggagaaccatgaagatgaggtgaagaaggtgaaggccgaggtggaggacctgaagtacctgctggaccagagccagaaggagagccagtgcctgaagtctgagctgcaggcccagaaggaggccaacagccgggcccccaccaccaccatgaggaacctggtggagcggctgaagagccagctggccctgaaggagaagcagcagaaggccctgagccgggccctgctggagctgcgggcagagatgacagctgctgctgaggagcgcatcatcagcgccaccagccagaaggaggcccacctgaatgtgcagcagatcgtggacagacacacccgggagctgaagacccaggtggaggacctgaatgaaaacctgctgaagctgaaggaggccctgaagaccagcaagaaccgggagaacagcctgacagacaacctgaatgacctgaacaatgagctgcagaagaagcagaaggcctacaacaagatcctgcgggagaaggaggagattgaccaggagaatgatgagctgaagaggcagatcaagaggctgaccagcggcctgcagggcaagcccctgacagacaacaagcagagcctcatcgaggagctgcagaggaaggtgaagaagctggagaaccagctggagggcaaggtggaggaggtggacctgaagcccatgaaggagaagaatgccaaggaggagctgatccgctgggaggagggcaagaagtggcaggccaagattgagggcatccggaacaagctgaaggagaaggagggggaggtgttcaccctgaccaagcagctgaacaccctgaaggacctgtttgccaaggctgacaaggagaagctgaccctgcagaggaagctgaagaccaccggcatgacagtggaccaggtgctgggcatccgggccctggagagcgagaaggagctggaggagctgaagaagaggaacctggacctggagaatgacatcctgtacatgagggcccaccaggccctgccccgggacagcgtggtggaggacctgcacctgcagaaccgctacctgcaggagaagctgcacgccctggagaagcagttcagcaaggacacctacagcaagcccagcatctctggaattgaaagtgatgaccactgccagcgggagcaggagctgcagaaggagaacctgaagctgagcagtgaaaatattgagctgaagttccagctggagcaggccaacaaggacctgccccggctgaagaaccaggtgcgggacctgaaggagatgtgtgagttcctgaagaaggagaaggccgaggtgcagaggaagctgggccacgtgcggggcagcggccgcagcggcaagaccatccctgagctggagaagaccatcggcctgatgaagaaggtggtggagaaggtgcagagagaaaatgagcagctgaagaaggccagcggcatcctgaccagcgagaagatggccaacatcgagcaggagaatgagaagctgaaggccgagctggagaagctgaaggcccacctgggccaccagctgtccatgcactatgagagcaagaccaagggcacagagaagatcatcgcagaaaatgaaaggctgaggaaggagctgaagaaggagacagatgctgctgagaagctgagaattgccaagaacaacctggagatcctgaatgagaagatgacagtgcagctggaggagaccgggaagaggctgcagtttgctgagagccggggcccccagctggagggcgctgacagcaagtcctggaagagcatcgtggtgaccaggatgtatgagaccaagctgaaggagctggagacagacatcgccaagaagaaccagagcatcacagacctgaagcagctggtgaaggaggccacagagcgggagcagaaggtgaacaagtacaatgaagacctggagcagcagatcaagatcctgaagcacgtgcctgagggcgctgagacagagcagggcctgaagcgggagctgcaggtgctgcggctggccaaccaccagctggacaaggagaaggccgagctgatccaccagatcgaggccaacaaggaccagagcggggctgagagcaccatcccagatgctgaccagctgaaggagaagatcaaggacctggagacccagctgaagatgtctgacctggagaagcagcacctgaaggaggagatcaagaagctgaagaaggagctggagaactttgaccccagcttctttgaggagattgaggacctgaagtacaactacaaggaggaggtgaagaagaacatcctgctggaggagaaggtgaagaagctgtctgagcagctgggcgtggagctgaccagccctgtggccgccagcgaggagtttgaagatgaggaggagagccctgtgaacttccccatctactag

SEQ ID NO: 147077 - DNA, 4620 bp, Artificial Sequence
  Description of Artificial Sequence: Synthetic coding sequence
atggccatcttcaagattgctgccctgcagaaggtggtggacaacagcgtgtccctgtctgagctggagctggccaacaagcagtacaatgagctgacagccaagtacagagacatcctgcagaaggacaacatgctggtgcagaggaccagcaacctggagcacctggagtgtgagaacatcagcctgaaggagcaggtggagagcatcaacaaggagctggagatcaccaaggagaagctgcacaccatcgagcaggcctgggagcaggagaccaagctgggcaatgaaagctccatggacaaggccaagaagagcatcaccaacagcgacatcgtgtccatcagcaagaagatcaccatgctggagatgaaggagctgaatgaaaggcagagagctgagcactgccagaagatgtatgagcacctgcggaccagcctgaagcagatggaggagaggaactttgagctggagaccaagtttgctgagctgaccaagatcaacctggatgcccagaaggtggagcagatgctgagagatgagctggccgacagcgtgtccaaggctgtgtctgatgctgaccggcagaggatcctggagctggagaagaatgagatggagctgaaggtggaggtgtccaagctgcgggagatcagtgacatcgcccggcggcaggtggagatcctgaatgcccagcagcagagccgggacaaggaggtggagagcctgaggatgcagctgctggactaccaggcccagagtgatgagaagagcctcatcgccaagctgcaccagcacaacgtgtccctgcagctgtctgaggccacagccctgggcaagctggagagcatcaccagcaagctgcagaagatggaggcctacaacctgcggctggagcagaagctggatgagaaggagcaggccctgtactatgcccggctggagggcaggaacagagccaagcacctgcggcagaccatccagagcctgcggcggcagttcagcggggccctgcccctggcccagcaggagaagttcagcaagaccatgatccagctgcagaatgacaagctgaagatcatgcaggagatgaagaacagccagcaggagcacaggaacatggagaacaagaccctggagatggagctgaagctgaagggcctggaggagctgatcagcaccctgaaggacaccaagggggcccagaaggtgatcaactggcacatgaagattgaggagctgcggctgcaggagctgaagctgaaccgggagctggtgaaggacaaggaggagatcaagtacctgaacaacatcatcagtgaatatgaaagaaccatcagcagcctggaggaggagatcgtgcagcagaacaagttccacgaggagcggcagatggcctgggaccagcgggaggtggacctggagcggcagctggacatctttgaccggcagcagaatgagatcctgaatgctgcccagaagtttgaggaggccaccggcagcatcccagaccccagcctgcccctgcccaaccagctggagatcgccctgaggaagatcaaggagaacatccgcatcatcctggagacccgggccacctgcaagagcctggaggagaagctgaaggagaaggagagcgccctgcggctggccgagcagaacatcctgagccgggacaaggtgatcaatgagctgcggctgcggctgcctgccacagctgagcgggagaagctgattgctgagctgggcaggaaggagatggagcccaagagccaccacaccctgaagatcgcccaccagaccatcgccaacatgcaggcccggctgaaccagaaggaggaggtgctgaagaagtaccagaggctgctggagaaggcccgggaggagcagcgggagatcgtgaagaagcatgaggaggacctgcacatcctgcaccaccggctggagctgcaggccgacagcagcctgaacaagttcaagcagacagcctgggacctgatgaagcagagccccacccctgtgcccaccaacaagcacttcatccggctggccgagatggagcagacagtggccgagcaggatgacagcctgagcagcctgctggtgaagctgaagaaggtgtcccaggacctggagcggcagcgggagatcacagagctgaaggtgaaggagtttgagaacatcaagctgcagctgcaggagaaccatgaagatgaggtgaagaaggtgaaggccgaggtggaggacctgaagtacctgctggaccagagccagaaggagagccagtgcctgaagtctgagctgcaggcccagaaggaggccaacagccgggcccccaccaccaccatgaggaacctggtggagcggctgaagagccagctggccctgaaggagaagcagcagaaggccctgagccgggccctgctggagctgcgggcagagatgacagctgctgctgaggagcgcatcatcagcgccaccagccagaaggaggcccacctgaatgtgcagcagatcgtggacagacacacccgggagctgaagacccaggtggaggacctgaatgaaaacctgctgaagctgaaggaggccctgaagaccagcaagaaccgggagaacagcctgacagacaacctgaatgacctgaacaatgagctgcagaagaagcagaaggcctacaacaagatcctgcgggagaaggaggagattgaccaggagaatgatgagctgaagaggcagatcaagaggctgaccagcggcctgcagggcaagcccctgacagacaacaagcagagcctcatcgaggagctgcagaggaaggtgaagaagctggagaaccagctggagggcaaggtggaggaggtggacctgaagcccatgaaggagaagaatgccaaggaggagctgatccgctgggaggagggcaagaagtggcaggccaagattgagggcatccggaacaagctgaaggagaaggagggggaggtgttcaccctgaccaagcagctgaacaccctgaaggacctgtttgccaaggctgacaaggagaagctgaccctgcagaggaagctgaagaccaccggcatgacagtggaccaggtgctgggcatccgggccctggagagcgagaaggagctggaggagctgaagaagaggaacctggacctggagaatgacatcctgtacatgagggcccaccaggccctgccccgggacagcgtggtggaggacctgcacctgcagaaccgctacctgcaggagaagctgcacgccctggagaagcagttcagcaaggacacctacagcaagcccagcatctctggaattgaaagtgatgaccactgccagcgggagcaggagctgcagaaggagaacctgaagctgagcagtgaaaatattgagctgaagttccagctggagcaggccaacaaggacctgccccggctgaagaaccaggtgcgggacctgaaggagatgtgtgagttcctgaagaaggagaaggccgaggtgcagaggaagctgggccacgtgcggggcagcggccgcagcggcaagaccatccctgagctggagaagaccatcggcctgatgaagaaggtggtggagaaggtgcagagagaaaatgagcagctgaagaaggccagcggcatcctgaccagcgagaagatggccaacatcgagcaggagaatgagaagctgaaggccgagctggagaagctgaaggcccacctgggccaccagctgtccatgcactatgagagcaagaccaagggcacagagaagatcatcgcagaaaatgaaaggctgaggaaggagctgaagaaggagacagatgctgctgagaagctgagaattgccaagaacaacctggagatcctgaatgagaagatgacagtgcagctggaggagaccgggaagaggctgcagtttgctgagagccggggcccccagctggagggcgctgacagcaagtcctggaagagcatcgtggtgaccaggatgtatgagaccaagctgaaggagctggagacagacatcgccaagaagaaccagagcatcacagacctgaagcagctggtgaaggaggccacagagcgggagcagaaggtgaacaagtacaatgaagacctggagcagcagatcaagatcctgaagcacgtgcctgagggcgctgagacagagcagggcctgaagcgggagctgcaggtgctgcggctggccaaccaccagctggacaaggagaaggccgagctgatccaccagatcgaggccaacaaggaccagagcggggctgagagcaccatcccagatgctgaccagctgaaggagaagatcaaggacctggagacccagctgaagatgtctgacctggagaagcagcacctgaaggaggagatcaagaagctgaagaaggagctggagaactttgaccccagcttctttgaggagattgaggacctgaagtacaactacaaggaggaggtgaagaagaacatcctgctggaggagaaggtgaagaagctgtctgagcagctgggcgtggagctgaccagccctgtggccgccagcgaggagtttgaagatgaggaggagagccctgtgaacttccccatctactag

SEQ ID NO: 147078 - DNA, 2415 bp, Artificial Sequence
  Description of Artificial Sequence: Synthetic coding sequence
atgccacccaacatcaactggaaggagatcatgaaggtggaccctgatgacctgccccggcaggaggagctggccgacaacctgctgatcagcctgagcaaggtggaggtgaatgagctgaagtctgagaagcaggagaatgtcatccacctgttccgcatcacccagagcctgatgaagatgaaggcccaggaggtggagctggccctggaggaggtggagaaggccggggaggagcaggccaagtttgagaaccagctgaagaccaaggtgatgaagctggagaatgagctggagatggcccagcagagcgctgggggccgggacacccgcttcctgagaaatgagatctgccagctggagaagcagctggagcagaaggaccgggagctggaggacatggagaaggagctggagaaggagaagaaggtgaatgagcagctggccctgagaaatgaggaggccgagaatgaaaacagcaagctgcggcgggagaacaagaggctgaagaagaagaatgagcagctgtgccaggacatcatcgactaccagaagcagattgacagccagaaggagaccctgctgagcagaagaggagaggacagcgactaccgcagccagctgagcaagaagaactatgagctgatccagtacctggatgagatccagaccctgacagaggccaatgagaagattgaggtgcagaaccaggagatgaggaagaacctggaggagagcgtgcaggagatggagaagatgacagatgagtacaacaggatgaaggccatcgtgcaccagacagacaacgtgattgaccagctgaagaaggaaaatgaccactaccagctgcaggtgcaggagctgacagacctgctgaagagcaagaatgaggaggatgaccccatcatggtggccgtgaatgccaaggtggaggagtggaagctgatcctgagcagcaaggatgatgagatcatcgagtaccagcagatgctgcacaacctgcgggagaagctgaagaatgcccagctggatgctgacaagagcaatgtgatggccctgcagcagggcatccaggagcgggacagccagatcaagatgctgacagagcaggtggagcagtacaccaaggagatggagaagaacacctgcatcatcgaggacctgaagaatgagctgcagaggaacaagggggccagcaccctgagccagcagacccacatgaagatccagagcaccctggacatcctgaaggagaagaccaaggaggccgagaggacagctgagctggccgaggctgatgcccgggagaaggacaaggagctggtggaggccctgaagaggctgaaggactatgaaagtggagtgtatggcctggaggatgctgtggtggagatcaagaactgcaagaaccagatcaagatccgggaccgggagattgagatcctgaccaaggagatcaacaagctggagctgaagatcagtgacttcctggatgaaaatgaggccctgcgggagcgggtgggcctggagcccaagaccatgattgacctgacagagttcaggaacagcaagcacctgaagcagcagcagtacagagctgagaaccagatcctgctgaaggagattgagagcctggaggaggagcggctggacctgaagaagaagatccggcagatggcccaggagcggggcaagaggtctgccaccagcggcctgaccacagaggacctgaacctgacagagaacatcagccagggcgaccgcatcagcgagaggaagctggacctgctgagcctgaagaacatgtctgaggcccagagcaagaatgagttcctgagccgggagctgattgagaaggagcgggacctggagaggagcaggacagtcatcgccaagttccagaacaagctgaaggagctggtggaggagaacaagcagctggaggagggcatgaaggagatcctgcaggccatcaaggagatgcagaaggaccctgatgtgaagggcggggagaccagcctcatcatccccagcctggagcggctggtgaatgccatcgagagcaagaatgctgagggcatctttgatgccagcctgcacctgaaggcccaggtggaccagctgactggaagaaatgaggagctgcggcaggagctgcgggagagcaggaaggaggccatcaactacagccagcagctggccaaggccaacctgaagattgaccacctggagaaggagaccagcctgctgcggcagagcgagggcagcaatgtggtgttcaagggcatcgacctgcctgatggcatcgcccccagcagcgccagcatcatcaacagccagaatgagtacctgatccacctgctgcaggagctggagaacaaggagaaggtgaaggagttccgccgcttctcctag

SEQ ID NO: 147079 - DNA, 1650 bp, Artificial Sequence
  Description of Artificial Sequence: Synthetic coding sequence
aagatggcccagcagagcgctgggggccgggacacccgcttcctgagaaatgagatctgccagctggagaagcagctggagcagaaggaccgggagctggaggacatggagaaggagctggagaaggagaagaaggtgaatgagcagctggccctgagaaatgaggaggccgagaatgaaaacagcaagctgcggcgggagaacaagaggctgaagaagaagaatgagcagctgtgccaggacatcatcgactaccagaagcagattgacagccagaaggagaccctgctgagcagaagaggagaggacagcgactaccgcagccagctgagcaagaagaactatgagctgatccagtacctggatgagatccagaccctgacagaggccaatgagaagattgaggtgcagaaccaggagatgaggaagaacctggaggagagcgtgcaggagatggagaagatgacagatgagtacaacaggatgaaggccatcgtgcaccagacagacaacgtgattgaccagctgaagaaggaaaatgaccactaccagctgcaggtgcaggagctgacagacctgctgaagagcaagaatgaggaggatgaccccatcatggtggccgtgaatgccaaggtggaggagtggaagctgatcctgagcagcaaggatgatgagatcatcgagtaccagcagatgctgcacaacctgcgggagaagctgaagaatgcccagctggatgctgacaagagcaatgtgatggccctgcagcagggcatccaggagcgggacagccagatcaagatgctgacagagcaggtggagcagtacaccaaggagatggagaagaacacctgcatcatcgaggacctgaagaatgagctgcagaggaacaagggggccagcaccctgagccagcagacccacatgaagatccagagcaccctggacatcctgaaggagaagaccaaggaggccgagaggacagctgagctggccgaggctgatgcccgggagaaggacaaggagctggtggaggccctgaagaggctgaaggactatgaaagtggagtgtatggcctggaggatgctgtggtggagatcaagaactgcaagaaccagatcaagatccgggaccgggagattgagatcctgaccaaggagatcaacaagctggagctgaagatcagtgacttcctggatgaaaatgaggccctgcgggagcgggtgggcctggagcccaagaccatgattgacctgacagagttcaggaacagcaagcacctgaagcagcagcagtacagagctgagaaccagatcctgctgaaggagattgagagcctggaggaggagcggctggacctgaagaagaagatccggcagatggcccaggagcggggcaagaggtctgccaccagcggcctgaccacagaggacctgaacctgacagagaacatcagccagggcgaccgcatcagcgagaggaagctggacctgctgagcctgaagaacatgtctgaggcccagagcaagaatgagttcctgagccgggagctgattgagaaggagcgggacctggagaggagcaggacagtcatcgccaagttccagaacaagtgctaccgcatcaaggagtgcagaagaaacctgtag

SEQ ID NO: 147080 - DNA, 4620 bp, Artificial Sequence; identical to SEQ ID NO: 147077
  Description of Artificial Sequence: Synthetic coding sequence

SEQ ID NO: 147081 - DNA, 7440 bp, Artificial Sequence
  Description of Artificial Sequence: Synthetic coding sequence
atgccacccaacatcaactggaaggagatcatgaaggtggaccctgatgacctgccccggcaggaggagctggccgacaacctgctgatcagcctgagcaaggtggaggtgaatgagctgaagtctgagaagcaggagaatgtcatccacctgttccgcatcacccagagcctgatgaagatgaaggcccaggaggtggagctggccctggaggaggtggagaaggccggggaggagcaggccaagtttgagaaccagctgaagaccaaggtgatgaagctggagaatgagctggagatggcccagcagagcgctgggggccgggacacccgcttcctgagaaatgagatctgccagctggagaagcagctggagcagaaggaccgggagctggaggacatggagaaggagctggagaaggagaagaaggtgaatgagcagctggccctgagaaatgaggaggccgagaatgaaaacagcaagctgcggcgggagaacaagaggctgaagaagaagaatgagcagctgtgccaggacatcatcgactaccagaagcagattgacagccagaaggagaccctgctgagcagaagaggagaggacagcgactaccgcagccagctgagcaagaagaactatgagctgatccagtacctggatgagatccagaccctgacagaggccaatgagaagattgaggtgcagaaccaggagatgaggaagaacctggaggagagcgtgcaggagatggagaagatgacagatgagtacaacaggatgaaggccatcgtgcaccagacagacaacgtgattgaccagctgaagaaggaaaatgaccactaccagctgcaggtgcaggagctgacagacctgctgaagagcaagaatgaggaggatgaccccatcatggtggccgtgaatgccaaggtggaggagtggaagctgatcctgagcagcaaggatgatgagatcatcgagtaccagcagatgctgcacaacctgcgggagaagctgaagaatgcccagctggatgctgacaagagcaatgtgatggccctgcagcagggcatccaggagcgggacagccagatcaagatgctgacagagcaggtggagcagtacaccaaggagatggagaagaacacctgcatcatcgaggacctgaagaatgagctgcagaggaacaagggggccagcaccctgagccagcagacccacatgaagatccagagcaccctggacatcctgaaggagaagaccaaggaggccgagaggacagctgagctggccgaggctgatgcccgggagaaggacaaggagctggtggaggccctgaagaggctgaaggactatgaaagtggagtgtatggcctggaggatgctgtggtggagatcaagaactgcaagaaccagatcaagatccgggaccgggagattgagatcctgaccaaggagatcaacaagctggagctgaagatcagtgacttcctggatgaaaatgaggccctgcgggagcgggtgggcctggagcccaagaccatgattgacctgacagagttcaggaacagcaagcacctgaagcagcagcagtacagagctgagaaccagatcctgctgaaggagattgagagcctggaggaggagcggctggacctgaagaagaagatccggcagatggcccaggagcggggcaagaggtctgccaccagcggcctgaccacagaggacctgaacctgacagagaacatcagccagggcgaccgcatcagcgagaggaagctggacctgctgagcctgaagaacatgtctgaggcccagagcaagaatgagttcctgagccgggagctgattgagaaggagcgggacctggagaggagcaggacagtcatcgccaagttccagaacaagctgaaggagctggtggaggagaacaagcagctggaggagggcatgaaggagatcctgcaggccatcaaggagatgcagaaggaccctgatgtgaagggcggggagaccagcctcatcatccccagcctggagcggctggtgaatgccatcgagagcaagaatgctgagggcatctttgatgccagcctgcacctgaaggcccaggtggaccagctgactggaagaaatgaggagctgcggcaggagctgcgggagagcaggaaggaggccatcaactacagccagcagctggccaaggccaacctgaagattgaccacctggagaaggagaccagcctgctgcggcagagcgagggcagcaatgtggtgttcaagggcatcgacctgcctgatggcatcgcccccagcagcgccagcatcatcaacagccagaatgagtacctgatccacctgctgcaggagctggagaacaaggagaagaagctgaagaacctggaggacagcctggaggactacaacaggaagtttgctgtgatccgccaccagcagagcctgctgtacaaggagtacctgtctgagaaggagacctggaagacagagagcaagaccatcaaggaggagaagaggaagctggaggaccaggtgcagcaggatgccatcaaggtgaaggagtacaacaacctgctgaatgccctgcagatggacagtgatgagatgaagaagatcctggccgagaacagcaggaagatcaccgtgctgcaggtgaatgagaagagcctcatccggcagtacaccaccctggtggagctggagcggcagctgaggaaagaaaatgagaagcagaagaatgagctgctgtccatggaggccgaggtgtgtgagaagattggctgcctgcagcgcttcaaggagatggccatcttcaagattgctgccctgcagaaggtggtggacaacagcgtgtccctgtctgagctggagctggccaacaagcagtacaatgagctgacagccaagtacagagacatcctgcagaaggacaacatgctggtgcagaggaccagcaacctggagcacctggagtgtgagaacatcagcctgaaggagcaggtggagagcatcaacaaggagctggagatcaccaaggagaagctgcacaccatcgagcaggcctgggagcaggagaccaagctgggcaatgaaagctccatggacaaggccaagaagagcatcaccaacagcgacatcgtgtccatcagcaagaagatcaccatgctggagatgaaggagctgaatgaaaggcagagagctgagcactgccagaagatgtatgagcacctgcggaccagcctgaagcagatggaggagaggaactttgagctggagaccaagtttgctgagctgaccaagatcaacctggatgcccagaaggtggagcagatgctgagagatgagctggccgacagcgtgtccaaggctgtgtctgatgctgaccggcagaggatcctggagctggagaagaatgagatggagctgaaggtggaggtgtccaagctgcgggagatcagtgacatcgcccggcggcaggtggagatcctgaatgcccagcagcagagccgggacaaggaggtggagagcctgaggatgcagctgctggactaccaggcccagagtgatgagaagagcctcatcgccaagctgcaccagcacaacgtgtccctgcagctgtctgaggccacagccctgggcaagctggagagcatcaccagcaagctgcagaagatggaggcctacaacctgcggctggagcagaagctggatgagaaggagcaggccctgtactatgcccggctggagggcaggaacagagccaagcacctgcggcagaccatccagagcctgcggcggcagttcagcggggccctgcccctggcccagcaggagaagttcagcaagaccatgatccagctgcagaatgacaagctgaagatcatgcaggagatgaagaacagccagcaggagcacaggaacatggagaacaagaccctggagatggagctgaagctgaagggcctggaggagctgatcagcaccctgaaggacaccaagggggcccagaaggtgatcaactggcacatgaagattgaggagctgcggctgcaggagctgaagctgaaccgggagctggtgaaggacaaggaggagatcaagtacctgaacaacatcatcagtgaatatgaaagaaccatcagcagcctggaggaggagatcgtgcagcagaacaagttccacgaggagcggcagatggcctgggaccagcgggaggtggacctggagcggcagctggacatctttgaccggcagcagaatgagatcctgaatgctgcccagaagtttgaggaggccaccggcagcatcccagaccccagcctgcccctgcccaaccagctggagatcgccctgaggaagatcaaggagaacatccgcatcatcctggagacccgggccacctgcaagagcctggaggagaagctgaaggagaaggagagcgccctgcggctggccgagcagaacatcctgagccgggacaaggtgatcaatgagctgcggctgcggctgcctgccacagctgagcgggagaagctgattgctgagctgggcaggaaggagatggagcccaagagccaccacaccctgaagatcgcccaccagaccatcgccaacatgcaggcccggctgaaccagaaggaggaggtgctgaagaagtaccagaggctgctggagaaggcccgggaggagcagcgggagatcgtgaagaagcatgaggaggacctgcacatcctgcaccaccggctggagctgcaggccgacagcagcctgaacaagttcaagcagacagcctgggacctgatgaagcagagccccacccctgtgcccaccaacaagcacttcatccggctggccgagatggagcagacagtggccgagcaggatgacagcctgagcagcctgctggtgaagctgaagaaggtgtcccaggacctggagcggcagcgggagatcacagagctgaaggtgaaggagtttgagaacatcaagctgcagctgcaggagaaccatgaagatgaggtgaagaaggtgaaggccgaggtggaggacctgaagtacctgctggaccagagccagaaggagagccagtgcctgaagtctgagctgcaggcccagaaggaggccaacagccgggcccccaccaccaccatgaggaacctggtggagcggctgaagagccagctggccctgaaggagaagcagcagaaggccctgagccgggccctgctggagctgcgggcagagatgacagctgctgctgaggagcgcatcatcagcgccaccagccagaaggaggcccacctgaatgtgcagcagatcgtggacagacacacccgggagctgaagacccaggtggaggacctgaatgaaaacctgctgaagctgaaggaggccctgaagaccagcaagaaccgggagaacagcctgacagacaacctgaatgacctgaacaatgagctgcagaagaagcagaaggcctacaacaagatcctgcgggagaaggaggagattgaccaggagaatgatgagctgaagaggcagatcaagaggctgaccagcggcctgcagggcaagcccctgacagacaacaagcagagcctcatcgaggagctgcagaggaaggtgaagaagctggagaaccagctggagggcaaggtggaggaggtggacctgaagcccatgaaggagaagaatgccaaggaggagctgatccgctgggaggagggcaagaagtggcaggccaagattgagggcatccggaacaagctgaaggagaaggagggggaggtgttcaccctgaccaagcagctgaacaccctgaaggacctgtttgccaaggctgacaaggagaagctgaccctgcagaggaagctgaagaccaccggcatgacagtggaccaggtgctgggcatccgggccctggagagcgagaaggagctggaggagctgaagaagaggaacctggacctggagaatgacatcctgtacatgagggcccaccaggccctgccccgggacagcgtggtggaggacctgcacctgcagaaccgctacctgcaggagaagctgcacgccctggagaagcagttcagcaaggacacctacagcaagcccagcatctctggaattgaaagtgatgaccactgccagcgggagcaggagctgcagaaggagaacctgaagctgagcagtgaaaatattgagctgaagttccagctggagcaggccaacaaggacctgccccggctgaagaaccaggtgcgggacctgaaggagatgtgtgagttcctgaagaaggagaaggccgaggtgcagaggaagctgggccacgtgcggggcagcggccgcagcggcaagaccatccctgagctggagaagaccatcggcctgatgaagaaggtggtggagaaggtgcagagagaaaatgagcagctgaagaaggccagcggcatcctgaccagcgagaagatggccaacatcgagcaggagaatgagaagctgaaggccgagctggagaagctgaaggcccacctgggccaccagctgtccatgcactatgagagcaagaccaagggcacagagaagatcatcgcagaaaatgaaaggctgaggaaggagctgaagaaggagacagatgctgctgagaagctgagaattgccaagaacaacctggagatcctgaatgagaagatgacagtgcagctggaggagaccgggaagaggctgcagtttgctgagagccggggcccccagctggagggcgctgacagcaagtcctggaagagcatcgtggtgaccaggatgtatgagaccaagctgaaggagctggagacagacatcgccaagaagaaccagagcatcacagacctgaagcagctggtgaaggaggccacagagcgggagcagaaggtgaacaagtacaatgaagacctggagcagcagatcaagatcctgaagcacgtgcctgagggcgctgagacagagcagggcctgaagcgggagctgcaggtgctgcggctggccaaccaccagctggacaaggagaaggccgagctgatccaccagatcgaggccaacaaggaccagagcggggctgagagcaccatcccagatgctgaccagctgaaggagaagatcaaggacctggagacccagctgaagatgtctgacctggagaagcagcacctgaaggaggagatcaagaagctgaagaaggagctggagaactttgaccccagcttctttgaggagattgaggacctgaagtacaactacaaggaggaggtgaagaagaacatcctgctggaggagaaggtgaagaagctgtctgagcagctgggcgtggagctgaccagccctgtggccgccagcgaggagtttgaagatgaggaggagagccctgtgaacttccccatctactag

SEQ ID NO: 147082 - DNA, 1512 bp, Artificial Sequence
  Description of Artificial Sequence: Synthetic coding sequence
atggaggagcacggcgtgacccagacagagcacatggccaccatcgaggcccatgctgtggcccagcaggtgcagcaggtgcacgtggccacctacacagagcacagcatgctgtctgcagatgaggacagccccagcagccctgaggacaccagctatgatgacagcgacatcctgaacagcacagctgctgatgaggtgacagcccacctggccgccgccggccctgtgggcatggctgctgctgctgctgtggccaccgggaagaagaggaagaggcctcatgtgtttgagagcaaccccagcatcaggaagaggcagcagacccggctgctgaggaagctgcgggccaccctggatgagtacaccaccagggtgggccagcaggccatcgtgctgtgcatcagccccagcaagcccaaccctgtgttcaaggtgtttggagctgcccccctggagaatgtggtgaggaagtacaagtccatgatcctggaggacctggagagcgccctggccgagcacgccccagccccccaggaggtgaacagcgagctgccccccctgaccattgatggcatccctgtgtctgtggacaagatgacccaggcccagctgcgggccttcatccctgagatgctgaagtacagcacaggccggggcaagccaggctggggcaaggagagctgcaagcccatctggtggccagaggacatcccctgggccaacgtgcggagtgatgtgaggacagaggagcagaagcagagggtgtcctggacccaggccctgcggaccatcgtgaagaactgctacaagcagcacggccgggaggacctgctgtatgcctttgaggaccagcagacccagacccaggccacagccacccacagcatcgcccacctggtgcccagccagacagtggtgcagaccttcagcaacccagatggcaccgtgtccctcatccaggtgggcaccggggccaccgtggccaccctggctgatgccagcgagctgcccaccaccgtgacagtggcccaggtgaactacagcgctgtggctgatggagaggtggagcagaactgggccaccctgcagggcggggagatgaccatccagaccacccaggccagcgaggccacccaggccgtggccagcctggccgaggccgctgtggccgccagccaggagatgcagcagggcgccaccgtgaccatggccctgaacagcgaggccgccgcccatgctgtggccaccctggccgaggccaccctgcagggcggcggccagatcgtgctgagcggggagacagctgctgctgtgggcgccctgactggagtgcaggatgccaacggcctggtgcagatccctgtgtccatgtaccagacagtggtgaccagcctggcccagggcaatggacctgtgcaggtggccatggcccctgtgaccacccgcatcagtgacagcgctgtgaccatggatggccaggccgtggaggtggtgaccctggagcagtag

SEQ ID NO: 147083 - DNA, 906 bp, Artificial Sequence
  Description of Artificial Sequence: Synthetic coding sequence
atgagcctgcggcggcacatcggcaaccctgagtacctgatgaagaggatcccccagaacccccgctaccagcacatcaagagccggctggacaccggcaacagcatgaccaagtacacagagaagctggaggagatcaagaagaactaccgctacaagaaggatgagctgttcaagaggctgaaggtgaccacctttgcccagctgatcatccaggtggccagcctgagtgaccagaccctggaggtgacagctgaggagatccagaggctggaggacaatgacagcgctgccagtgaccctgatgctgagaccacagcccggaccaacgggaagggcaaccctggagagcagagccccagccctgagcagttcatcaacaatgctggggccggggacagcagccgcagcaccctgcagagcgtcatcagcggcgtgggggagctggacctggacaagggccctgtgaagaaggccgagccccacaccaaggacaagccctacccagactgccccttcctgctgctggatgtgcgggaccgggacagctaccagcagtgccacatcgtgggcgcctacagctaccccatcgccaccctgagcaggaccatgaacccctacagcaatgacatcctggagtacaagaatgcccacggcaagatcatcatcctgtatgatgatgatgagcggctggccagccaggccgccaccaccatgtgtgagcggggctttgaaaatctcttcatgctgagcggcggccgcctgaaccaggccaacagcagcggccgggagagcaaggtgcctggggcccggagcgcccagaacctgcccggcggcggccctgccagccacagcaaccccaggagcctgagcagcggccacctgcagggcaagccctggaagtag

SEQ ID NO: 147084 - DNA, 165 bp, Artificial Sequence
  Description of Artificial Sequence: Synthetic coding sequence
atgagcctgcggcggcacatcggcaaccctgagtacctgatgaagaggatcccccagaacccccgctaccagcacatcaagagccggctggacaccggggcctgtgtgtacctgaccagcagccctgccctgcctgactgtgccatgaatggcctgtgcttctag

SEQ ID NO: 147085 - DNA, 858 bp, Artificial Sequence
  Description of Artificial Sequence: Synthetic coding sequence
atgagcctgcggcggcacatcggcaaccctgagtacctgatgaagaggatcccccagaacccccgctaccagcacatcaagagccggctggacacagactaccgctacaagaaggatgagctgttcaagaggctgaaggtgaccacctttgcccagctgatcatccaggtggccagcctgagtgaccagaccctggaggtgacagctgaggagatccagaggctggaggacaatgacagcgctgccagtgaccctgatgctgagaccacagcccggaccaacgggaagggcaaccctggagagcagagccccagccctgagcagttcatcaacaatgctggggccggggacagcagccgcagcaccctgcagagcgtcatcagcggcgtgggggagctggacctggacaagggccctgtgaagaaggccgagccccacaccaaggacaagccctacccagactgccccttcctgctgctggatgtgcgggaccgggacagctaccagcagtgccacatcgtgggcgcctacagctaccccatcgccaccctgagcaggaccatgaacccctacagcaatgacatcctggagtacaagaatgcccacggcaagatcatcatcctgtatgatgatgatgagcggctggccagccaggccgccaccaccatgtgtgagcggggctttgaaaatctcttcatgctgagcggcggccgcctgaaccaggccaacagcagcggccgggagagcaaggtgcctggggcccggagcgcccagaacctgcccggcggcggccctgccagccacagcaaccccaggagcctgagcagcggccacctgcagggcaagccctggaagtag

SEQ ID NO: 147086 - DNA, 1200 bp, Artificial Sequence
  Description of Artificial Sequence: Synthetic coding sequence
atgagcagccgcagcaccaaggacctgatcaagagcaagtggggcagcaagcccagcaacagcaagtctgagaccaccctggagaagctgaagggggagatcgcccacctgaagacctctgtggatgagatcaccagcggcaagggcaagctgacagacaaggagcggcaccggctgctggagaagatccgggtgctggaggccgagaaggagaagaatgcctaccagctgacagagaaggacaaggagatccagaggctgcgggaccagctgaaggcccgctacagcaccaccaccctgctggagcagctggaggagaccacccgggagggggagcggcgggagcaggtgctgaaggccctgtctgaggagaaggatgtgctgaagcagcagctgtctgctgccaccagcagaattgctgagctggagagcaagaccaacaccctgcggctgagccagacagtggcccccaactgcttcaacagcagcatcaacaacatccacgagatggagatccagctgaaggatgccctggagaagaaccagcagtggctggtgtatgaccagcagcgggaggtgtatgtgaagggcctgctggccaagatctttgagctggagaagaagacagaaacagctgcccacagcctgccccagcagaccaagaagccagagagcgagggctacctgcaggaggagaagcagaagtgctacaatgacctgctggccagcgccaagaaggacctggaggtggagcggcagaccatcacccagctgagctttgagctgtctgagttccggaggaaatatgaggagacccagaaggaggtgcacaacctgaaccagctgctgtacagccagaggagagcagatgtgcagcacctggaggatgacagacacaagacagagaagatccagaagctgcgggaggagaatgacatcgcccggggcaagctggaggaggagaagaagaggtctgaggagctgctgagccaggtgcagttcctgtacaccagcctgctgaagcagcaggaggagcagaccagggtggccctgctggagcagcagatgcaggcctgcaccctggactttgaaaatgagaagctggaccggcagcacgtgcagcaccagctgcacgtgatcctgaaggagctgaggaaggccaggaacaacacagtgggcatcctggacaccaagagctag

SEQ ID NO: 147087 - DNA, 1395 bp, Artificial Sequence
  Description of Artificial Sequence: Synthetic coding sequence
atgagcagccgcagcaccaaggacctgatcaagagcaagtggggcagcaagcccagcaacagcaagtctgagaccaccctggagaagctgaagggggagatcgcccacctgaagacctctgtggatgagatcaccagcggcaagggcaagctgacagacaaggagcggcaccggctgctggagaagatccgggtgctggaggccgagaaggagaagaatgcctaccagctgacagagaaggacaaggagatccagaggctgcgggaccagctgaaggcccgctacagcaccaccaccctgctggagcagctggaggagaccacccgggagggggagcggcgggagcaggtgctgaaggccctgtctgaggagaaggatgtgctgaagcagcagctgtctgctgccaccagcagaattgctgagctggagagcaagaccaacaccctgcggctgagccagacagtggcccccaactgcttcaacagcagcatcaacaacatccacgagatggagatccagctgaaggatgccctggagaagaaccagcagtggctggtgtatgaccagcagcgggaggtgtatgtgaagggcctgctggccaagatctttgagctggagaagaagacagaaacagctgcccacagcctgccccagcagaccaagaagccagagagcgagggctacctgcaggaggagaagcagaagtgctacaatgacctgctggccagcgccaagaaggacctggaggtggagcggcagaccatcacccagctgagctttgagctgtctgagttccggaggaaatatgaggagacccagaaggaggtgcacaacctgaaccagctgctgtacagccagaggagagcagatgtgcagcacctggaggatgacagacacaagacagagaagatccagaagctgcgggaggagaatgacatcgcccggggcaagctggaggaggagaagaagaggtctgaggagctgctgagccaggtgcagttcctgtacaccagcctgctgaagcagcaggaggagcagaccagggtggccctgctggagcagcagatgcaggcctgcaccctggactttgaaaatgagaagctggaccggcagcacgtgcagcaccagctgcacgtgatcctgaaggagctgaggaaggccaggaaccagatcacccagctggagagcctgaagcagctgcatgaatttgccatcacagagcccctggtgaccttccagggcgagacagaaaatcgggagaaggtggccgccagccccaagagccccacagctgccctgaatgaaagcctggtggagtgccccaagtgcaacatccagtacccagccacagagcaccgggacctgctggtgcacgtggagtactgcagcaagtag

SEQ ID NO: 147088 - DNA, 627 bp, Artificial Sequence
  Description of Artificial Sequence: Synthetic coding sequence
tgaagcagcatcaacaacatccacgagatggagatccagctgaaggatgccctggagaagaaccagcagtggctggtgtatgaccagcagcgggaggtgtatgtgaagggcctgctggccaagatctttgagctggagaagaagacagaaacagctgcccacagcctgccccagcagaccaagaagccagagagcgagggctacctgcaggaggagaagcagaagtgctacaatgacctgctggccagcgccaagaaggacctggaggtggagcggcagaccatcacccagctgagctttgagctgtctgagttccggaggaaatatgaggagacccagaaggaggtgcacaacctgaaccagctgctgtacagccagaggagagcagatgtgcagcacctggaggatgacagacacaagacagagaagatccagaagctgcgggaggagaatgacatcgcccggggcaagctggaggaggagaagaagaggtctgaggagctgctgagccaggtgcagttcctgtacaccagcctgctgaagcagcaggaggagcagaccagggtggccctgctggagcagcaggtgctgatccgggtggccagcaagttcaacagcgcctgctag

SEQ ID NO: 147089 - DNA, 1425 bp, Artificial Sequence
  Description of Artificial Sequence: Synthetic coding sequence
atggctgctgcctctgtgtctgctgccagcggcagccacctgagcaacagctttgctgagcccagccgcagcaatggctccatggtgcgccacagcagcagcccctacgtggtgtaccccagcgacaagcccttcctgaacagcgacctgcggcgcagccccagcaagcccaccctggcctacccagagagcaacagccgggccatcttcagcgccctgaagaacctgcaggacaagatccggcggctggagctggagcgcatccaggccgaggagagcgtgaagaccctgagccgggagaccatcgagtacaagaaggtgctggatgagcagatccaggagcgggagaacagcaagaatgaggagagcaagcacaaccaggagctgaccagccagctgctggccgctgagaacaagtgcaacctgctggagaagcagctggagtacatgaggaacatgatcaagcatgctgagatggagaggacctctgtgctggagaagcaggtgtccctggagcgggagcggcagcacgaccagacccacgtgcagagccagctggagaagctggacctgctggagcaggagtacaacaagctgaccaccatgcaggccctggccgagaagaagatgcaggagctggaggccaagctgcacgaggaggagcaggagaggaagaggatgcaggccaaggctgctgagctgcagacaggcctggagaccaacagactcatctttgaggacaaggccaccccctgtgtgcccaatgcccggcgcatcaagaagaagaagagcaagcccccagagaagagcaccagccccagccatgctgtggtggccaacgtgcagctggtgctgcacctgatgaagcagcacagcaaggccctgtgcaatgacagagtcatcaacagcatccccctggccaagcaggtgagcagccggggcggcaagagcaagaagctgtctgtgaccccacccagcagcaatggcatcaatgaggagctgtctgaggtgctgcagaccctgcaggatgaatttggccagatgagctttgaccaccagcagctggccaagctgatccaggagagccccaccgtggagctgaaggacaagctggagtgtgagctggaggccctggtgggccgcatggaggccaaggccaaccagatcaccaaggtgaggaagtaccaggcccagctggagaagcagaagctggagaagcagaagaaggagctgaaggccaccaagaagaccctggatgaggagaggaacagcagcagccgcagcggcatcaccggcaccaccaacaagaaggacttcatgaagctgcggcctggagagaagaggaggaagaacctgcagctgctgaaggacatgcagagcatccagaacagcctgcagagcagcagcctgtgctgggactactag

SEQ ID NO: 147090 - DNA, 1503 bp, Artificial Sequence
  Description of Artificial Sequence: Synthetic coding sequence
atggctgctgcctctgtgtctgctgccagcggcagccacctgagcaacagctttgctgagcccagccgcagcaatggctccatggtgcgccacagcagcagcccctacgtggtgtaccccagcgacaagcccttcctgaacagcgacctgcggcgcagccccagcaagcccaccctggcctacccagagagcaacagccgggccatcttcagcgccctgaagaacctgcaggacaagatccggcggctggagctggagcgcatccaggccgaggagagcgtgaagaccctgagccgggagaccatcgagtacaagaaggtgctggatgagcagatccaggagcgggagaacagcaagaatgaggagagcaagcacaaccaggagctgaccagccagctgctggccgctgagaacaagtgcaacctgctggagaagcagctggagtacatgaggaacatgatcaagcatgctgagatggagaggacctctgtgctggagaagcaggtgtccctggagcgggagcggcagcacgaccagacccacgtgcagagccagctggagaagctggacctgctggagcaggagtacaacaagctgaccaccatgcaggccctggccgagaagaagatgcaggagctggaggccaagctgcacgaggaggagcaggagaggaagaggatgcaggccaaggctgctgagctgcagacaggcctggagaccaacagactcatctttgaggacaaggccaccccctgtgtgcccaatgcccggcgcatcaagaagaagaagagcaagcccccagagaagaagagcagcaggaactactttggagcccagccccactaccgcctgtgcctgggggacatgccctttgtggccggcaagagcaccagccccagccatgctgtggtggccaacgtgcagctggtgctgcacctgatgaagcagcacagcaaggccctgtgcaatgacagagtcatcaacagcatccccctggccaagcaggtgagcagccggggcggcaagagcaagaagctgtctgtgaccccacccagcagcaatggcatcaatgaggagctgtctgaggtgctgcagaccctgcaggatgaatttggccagatgagctttgaccaccagcagctggccaagctgatccaggagagccccaccgtggagctgaaggacaagctggagtgtgagctggaggccctggtgggccgcatggaggccaaggccaaccagatcaccaaggtgaggaagtaccaggcccagctggagaagcagaagctggagaagcagaagaaggagctgaaggccaccaagaagaccctggatgaggagaggaacagcagcagccgcagcggcatcaccggcaccaccaacaagaaggacttcatgaagctgcggcctggagagaagaggaggaagaacctgcagctgctgaaggacatgcagagcatccagaacagcctgcagagcagcagcctgtgctgggactactag

SEQ ID NO: 147091 - DNA, 813 bp, Artificial Sequence
  Description of Artificial Sequence: Synthetic coding sequence
atggctgctgcctctgtgtctgctgccagcggcagccacctgagcaacagctttgctgagcccagccgcagcaatggctccatggtgcgccacagcagcagcccctacgtggtgtaccccagcgacaagcccttcctgaacagcgacctgcggcgcagccccagcaagcccaccctggcctacccagagagcaacagccgggccatcttcagcgccctgaagaacctgcaggacaagatccggcggctggagctggagcgcatccaggccgaggagagcgtgaagaccctgagccgggagaccatcgagtacaagaaggtgctggatgagcagatccaggagcgggagaacagcaagaatgaggagagcaagcacaaccaggagctgaccagccagctgctggccgctgagaacaagtgcaacctgctggagaagcagctggagtacatgaggaacatgatcaagcatgctgagatggagaggacctctgtgctggagaagcaggtgtccctggagcgggagcggcagcacgaccagacccacgtgcagagccagctggagaagctggacctgctggagcaggagtacaacaagctgaccaccatgcaggccctggccgagaagaagatgcaggagctggaggccaagctgcacgaggaggagcaggagaggaagaggatgcaggccaaggctgctgagctgcagacaggcctggagaccaacagactcatctttgaggacaaggccaccccctgtgtgcccaatgcccggcgcatcaagaagaagaagagcaagcccccagagaaggtgtag

SEQ ID NO: 147092 - DNA, 1476 bp, Artificial Sequence
  Description of Artificial Sequence: Synthetic coding sequence
atgctgaccagaattgacaacagctttgctgagcccagccgcagcaatggctccatggtgcgccacagcagcagcccctacgtggtgtaccccagcgacaagcccttcctgaacagcgacctgcggcgcagccccagcaagcccaccctggcctacccagagagcaacagccgggccatcttcagcgccctgaagaacctgcaggacaagatccggcggctggagctggagcgcatccaggccgaggagagcgtgaagaccctgagccgggagaccatcgagtacaagaaggtgctggatgagcagatccaggagcgggagaacagcaagaatgaggagagcaagcacaaccaggagctgaccagccagctgctggccgctgagaacaagtgcaacctgctggagaagcagctggagtacatgaggaacatgatcaagcacgccgagatggagaggacctctgtgctggagaagcaggtgtccctggagcgggagcggcagcacgaccagacccacgtgcagagccagctggagaagctggacctgctggagcaggagtacaacaagctgaccaccatgcaggccctggccgagaagaagatgcaggagctggaggccaagctgcacgaggaggagcaggagaggaagaggatgcaggccaaggctgctgagctgcagacaggcctggagaccaacagactcatctttgaggacaaggccaccccctgtgtgcccaatgcccggcgcatcaagaagaagaagagcaagcccccagagaagaagagcagcaggaactactttggagcccagccccactaccgcctgtgcctgggggacatgccctttgtggccggcaagagcaccagccccagccatgctgtggtggccaacgtgcagctggtgctgcacctgatgaagcagcacagcaaggccctgtgcaatgacagagtcatcaacagcatccccctggccaagcaggtgagcagcagaggaggcaagagcaagaagctgtctgtgaccccacccagcagcaatggcatcaatgaggagctgtctgaggtgctgcagaccctgcaggatgaatttggccagatgagctttgaccaccagcagctggccaagctgatccaggagagccccaccgtggagctgaaggacaagctggagtgtgagctggaggccctggtgggccgcatggaggccaaggccaaccagatcaccaaggtgaggaagtaccaggcccagctggagaagcagaagctggagaagcagaagaaggagctgaaggccaccaagaagaccctggatgaggagaggaacagcagcagccgcagcggcatcaccggcaccaccaacaagaaggacttcatgaagctgcggcctggagagaagaggaggaagaacctgcagctgctgaaggacatgcagagcatccagaacagcctgcagagcagcagcctgtgctgggactactag

SEQ ID NO: 147093 - DNA, 1794 bp, Artificial Sequence
  Description of Artificial Sequence: Synthetic coding sequence
atgtttcctgtggcccccaagccccaggacagcagccagcccagcgaccggctgatgacagagaagcagcaggaggaggccgagtgggagagcatcaacgtgctgctgatgatgcacggcctgaagcccctgagcctggtgaagaggacagacctgaaggacctgatcatctttgacaagcagagcagccagaggatgaggcagaacctgaagctgctggtggaggagaccagctgccagcagaacatgatccaggagctgattgagaccaaccagcagctgagaaatgagctgcagctggagcagagcagagctgccaaccaggagcagagggccaatgacctggagcagatcatggagagcgtgaagagcaagatcggggagctggaggatgagagcctgagccgggcctgccaccagcagaacaagatcaaggacctgcagaaggagcagaagaccctgcaggtgaagtgccagcactacaagaagaagaggacagagcaggaggagaccatcgccagcctgcagatggaggtgtgccgcctgaagaaggaggaggaggaccgcatcgtgacccagaacagagtgtttgcctacctgtgcaagagggtgccccacacagtgctggaccggcagctgctgtgcctgattgactactatgagagcaagatcaggaagatccacacccagaggcagtacaaggaggatgagagccagagcgaggaggagaatgactacagaaacctggatgccagccccacctacaagggcctgctgatgagcctgcagaaccagctgaaggagagcaagagcaagattgatgccctgagcagcgagaagctgaacctgcagaaggacctggagacccggcccacccagcacgagctgcggctgtacaagcagcaggtgaagaagctggagaaggccctgaagaagaatgtgaagctgcaggagctgatcaaccacaagaaggccgaggacacagagaagaaggatgagcccagcaagtacaaccagcagcaggccctgattgaccagcgctacttccaggtgctgtgcagcatcaacagcatcatccacaacccccgggcccctgtgatcatctacaagcagaccaagggcggcgtgcagaacttcaacaaggacctggtgcaggactgtggctttgagcacctggtgcctgtgattgagatgtgggccgaccagctgaccagcctgaaggacctgtacaagagcctgaagaccctgtctgctgagctggtgccctggctgaacctgaagaagcaggatgaaaatgaaggcatcaaggtggaggacctgctcttcatcgtggacaccatgctggaggaggtggagaacaaggagaaggacagcaacatgccccacttccagaccctgcaggccatcgtgagccacttccagaagctgtttgatgtgcccagcctgaatggagtgtaccccaggatgaatgaggtgtacacccggctgggggagatgaacaatgctgtgaggaacctgcaggagctgctggagctggacagcagcagcagcctgtgtgtgctggtgtccacagtgggcaagctgtgccgcctcatcaatgaagatgtgaatgagcaggtgatgcaggtgctgggccctgaggacctgcagagcatcatctacaagctggaggagcacgaggagttcttccctgccttccaggccttcaccaatgacctgctggagatcctggagattgatgacctggatgccatcgtgcctgctgtgaagaagctgaaggtgctgagctactag

SEQ ID NO: 147094 - DNA, 639 bp, Artificial Sequence
  Description of Artificial Sequence: Synthetic coding sequence
atgtttcctgtggcccccaagccccaggacagcagccagcccagcgaccggctgatgacagagaagcagcaggaggaggccgagtgggagagcatcaacgtgctgctgatgatgcacggcctgaagcccctgagcctggtgaagaggacagacctgaaggacctgatcatctttgacaagcagagcagccagaggatgaggcagaacctgaagctgctggtggaggagaccagctgccagcagaacatgatccaggagctgattgagaccaaccagcagctgagaaatgagctgcagctggagcagagcagagctgccaaccaggagcagagggccaatgacctggagcagatcatggagagcgtgaagagcaagatcggggagctggaggatgagagcctgagccgggcctgccaccagcagaacaagatcaaggacctgcagaaggagcagaagaccctgcaggtgaagtgccagcactacaagaagaagaggacagagcaggaggagaccatcgccagcctgcagatggaggtgtgccgcctgaagaaggaggaggaggaccgcatcgtgacccagaacagagtgtttgcctacctgtgcaagagggtgccccacacagtgctggaccggcagtag

SEQ ID NO: 147095 - DNA, 351 bp, Artificial Sequence
  Description of Artificial Sequence: Synthetic coding sequence
atgtttcctgtggcccccaagccccaggacagcagccagcccagcgaccggctgatgacagagaagcagcaggaggaggccgagtgggagagcatcaacgtgctgctgatgatgcacggcctgaagcccctgagcctggtgaagaggacagacctgaaggacctgatcatctttgacaagcagagcagccagaggatgaggcagaacctgaagctgctggtggaggagaccagctgccagcagaacatgatccaggagctgattgagaccaaccagcagctgagaaatgagctgcagctggagcagagcagagctgccaaccaggagcagagggccaatgacctggagtag

SEQ ID NO: 147096 - DNA, 1665 bp, Artificial Sequence
  Description of Artificial Sequence: Synthetic coding sequence
atgtttcctgtggcccccaagccccaggacagcagccagcccagcgaccggctgatgacagagaagcagcaggaggaggccgagtgggagagcatcaacgtgctgctgatgatgcacggcctgaagcccctgagcctggtgaagaggacagacctgaaggacctgatcatctttgacaagcagagcagccagaggatgaggcagaacctgaagctgctggtggaggagaccagctgccagcagaacatgatccaggagctgattgagaccaaccagcagctgagaaatgagctgcagctggagcagagcagagctgccaaccaggagcagagggccaatgacctggagcagatcatggagagcgtgaagagcaagatcggggagctggaggatgagagcctgagccgggcctgccaccagcagaacaagatcaaggacctgcagaaggagcagaagaccctgcaggtgaagtgccagcactacaagaagaagaggacagagcaggaggagaccatcgccagcctgcagatggaggtgtgccgcctgaagaaggaggaggaggaccgcatcgtgacccagaacagagtgtttgcctacctgtgcaagagggtgccccacacagtgctggaccggcagctgctgtgcctgattgactactatgagagcaagatcaggaagatccacacccagaggcagtacaaggaggatgagagccagagcgaggaggagaatgactacagaaacctggatgccagccccacctacaagggcctgctgatgagcctgcagaaccagctgaaggagagcaagagcaagattgatgccctgagcagcgagaagctgaacctgcagaaggacctggagacccggcccacccagcacgagctgcggctgtacaagcagcaggtgaagaagctggagaaggccctgaagaagaatgtgaagctgcaggagctgatcaaccacaagaaggccgaggacacagagaagaaggatgagcccagcaagtacaaccagcagcaggccctgattgaccagcgctacttccaggtgctgtgcagcatcaacagcatcatccacaacccccgggcccctgtgatcatctacaagcagaccaagggcggcgtgcagaacttcaacaaggacctggtgcaggactgtggctttgagcacctggtgcctgtgattgagatgtgggccgaccagctgaccagcctgaaggacctgtacaagagcctgaagaccctgtctgctgagctggtgccctggctgaacctgaagaagcaggatgaaaatgaaggcatcaaggtggaggacctgctcttcatcgtggacaccatgctggaggaggtggagaacaaggagaaggacagcaacatgccccacttccagaccctgcaggccatcgtgagccacttccagaagctgtttgatgtgcccagcctgaatggagtgtaccccaggatgaatgaggtgtacacccggctgggggagatgaacaatgctgtgaggaacctgcaggagctgctggagctggacagcagcagcagcctgtgtgtgctggtgtccacagtgggcaagctgtgccgcctcatcaatgaagatgtgaatgagcaggtgatgcaggtgctgggccctgaggacctgcagcgctacctgttctag

SEQ ID NO: 147097 - DNA, 1794 bp, Artificial Sequence; identical to SEQ ID NO: 147093
  Description of Artificial Sequence: Synthetic coding sequence

SEQ ID NO: 147098 - DNA, 72 bp, Artificial Sequence
  Description of Artificial Sequence: Synthetic coding sequence
atgtttcctgtggcccccaagccccaggacagcagccagcccagcgaccggctgatgacagagaagcagtag

SEQ ID NO: 147099 - DNA, 1734 bp, Artificial Sequence
  Description of Artificial Sequence: Synthetic coding sequence
atgacagagcaggaggaggccgagtgggagagcatcaacgtgctgctgatgatgcacggcctgaagcccctgagcctggtgaagaggacagacctgaaggacctgatcatctttgacaagcagagcagccagaggatgaggcagaacctgaagctgctggtggaggagaccagctgccagcagaacatgatccaggagctgattgagaccaaccagcagctgagaaatgagctgcagctggagcagagcagagctgccaaccaggagcagagggccaatgacctggagcagatcatggagagcgtgaagagcaagatcggggagctggaggatgagagcctgagccgggcctgccaccagcagaacaagatcaaggacctgcagaaggagcagaagaccctgcaggtgaagtgccagcactacaagaagaagaggacagagcaggaggagaccatcgccagcctgcagatggaggtgtgccgcctgaagaaggaggaggaggaccgcatcgtgacccagaacagagtgtttgcctacctgtgcaagagggtgccccacacagtgctggaccggcagctgctgtgcctgattgactactatgagagcaagatcaggaagatccacacccagaggcagtacaaggaggatgagagccagagcgaggaggagaatgactacagaaacctggatgccagccccacctacaagggcctgctgatgagcctgcagaaccagctgaaggagagcaagagcaagattgatgccctgagcagcgagaagctgaacctgcagaaggacctggagacccggcccacccagcacgagctgcggctgtacaagcagcaggtgaagaagctggagaaggccctgaagaagaatgtgaagctgcaggagctgatcaaccacaagaaggccgaggacacagagaagaaggatgagcccagcaagtacaaccagcagcaggccctgattgaccagcgctacttccaggtgctgtgcagcatcaacagcatcatccacaacccccgggcccctgtgatcatctacaagcagaccaagggcggcgtgcagaacttcaacaaggacctggtgcaggactgtggctttgagcacctggtgcctgtgattgagatgtgggccgaccagctgaccagcctgaaggacctgtacaagagcctgaagaccctgtctgctgagctggtgccctggctgaacctgaagaagcaggatgaaaatgaaggcatcaaggtggaggacctgctcttcatcgtggacaccatgctggaggaggtggagaacaaggagaaggacagcaacatgccccacttccagaccctgcaggccatcgtgagccacttccagaagctgtttgatgtgcccagcctgaatggagtgtaccccaggatgaatgaggtgtacacccggctgggggagatgaacaatgctgtgaggaacctgcaggagctgctggagctggacagcagcagcagcctgtgtgtgctggtgtccacagtgggcaagctgtgccgcctcatcaatgaagatgtgaatgagcaggtgatgcaggtgctgggccctgaggacctgcagagcatcatctacaagctggaggagcacgaggagttcttccctgccttccaggccttcaccaatgacctgctggagatcctggagattgatgacctggatgccatcgtgcctgctgtgaagaagctgaaggtgctgagctactag

SEQ ID NO: 147100 - DNA, 3666 bp, Artificial Sequence
  Description of Artificial Sequence: Synthetic coding sequence
atgctgttccccctgcaggtggccgctgtgaccagctctgtgagagatgaccccctggagcactgtgtgagccccaggacccgggcccggagccctgagatctgcaagatggctgacaacctggatgagttcatcgaggagcagaaggcccggctggccgaggacaaggccgagctggagagtgaccccccctacatggagatgaagggcaagctgagcgccaagctgtctgagaacagcaagatcctgatctccatggccaaggagaacatcccccccaacagccagcagacccggggcagcctgggcatcgactatggcctgagcctgcccctgggggaggactatgaaaggaagaagcacaagctgaaggaggagctgcggcaggactaccgccgctacctgacccaggagcggctgaagctggagaggaacaaggagtacaaccagttcctgcggggcaaggaggagagcagcgagaagttccggcaggtggagaagagcacagagcccaagagccagaggaacaagaagcccatcggccaggtgaagccagacctgaccagccagatccagaccagctgtgagaacagcgagggccccaggaaggatgtgctgaccccatctgaggcctatgaggagctgctgaaccagaggcggctggaggaggaccgctaccggcagctggatgatgaaattgagctgaggaacagacgcatcatcaagaaggccaatgaggaggtgggcatcagcaacctgaagcaccagagatttgccagcaaggccggcatcccagaccggcgcttccaccgcttcaatgaagatagagtgtttgaccggcgctaccacaggccagaccaggaccctgaggtgtctgaggagatggatgagcgcttccgctatgaaagtgactttgaccggcggctgagccgggtgtacaccaatgacaggatgcacaggaacaagaggggcaacatgccacccatggagcatgatggagatgtgattgagcagagcaacatccgcatcagcagcgctgagaacaagagcgccccagacaatgagaccagcaagagcgccaaccaggacacctgcagcccctttgctggcatgctgtttggaggagaggaccgggagctgatccagaggaggaaggagaagtaccgcctggagctgctggagcagatggccgagcagcagaggaacaagaggcgggagaaggacctggagctgcgggtggccgccagcggggcccaggaccctgagaagagcccagaccggctgaagcagttctctgtggcccccaggcactttgaggagatgatccccccagagcggcccagaattgccttccagacccccctgccccccctgagcgcccccagcgtgccccccatccccagcgtgcaccctgtgcccagccagaatgaagacctgcggagcggcctgagcagcgccctgggggagatggtgagccccagaattgcccccctgcccccaccacccctgctgccccccctggccaccaactaccgcaccccctatgatgatgcctactacttctacggcagcaggaacacctttgaccccagcctggcctactacggcagcggcatgatgggcgtgcagcctgctgcctacgtgtctgcccctgtgacccaccagctggcccagcctgtggtgaacacagtgggccagaatgagctgaagatcaccagtgaccaggtgatcaacagcggcctcatctttgaggacaagcccaagcccagcaagcagagcctgcagagctaccaggaggccctgcagcagcagatccgggagcgggaggagaggaggaagaaggagcgggaggagaaggaggagtatgaggccaagctggaggccgagatgaggacctacaacccctggggcaagggcggcggcggggcccccctgagagatgccaagggcaacctgatcacagacctgaacaggatgcaccggcagaacattgatgcctaccacaacccagatgcccggacctatgaggacaagagagctgtggtgtccctggaccccaacctggccaccagcaatgctgagaacctggaggatgctgccaacaagagcagcggccacatgcagacccagagcagcccctttgcccggggaaatgtgtttggagagcccccaacagagctgcagatcaagcagcaggagctgtacaagaacttcctgcgcttccagatcgaggagaagaagcagcgggaggaggccgagcgggagcggctgagaattgctgaggagaaggaggagcggcggctggccgagcagagggcccgcatccagcaggagtatgaggaggagcaggagaagaagcgggagaaggaggaggagcagaggctgaagaatgaggagcacatccggctggccgaggagcggcagaaggaggccgagaggaagaagaaggaggaggaggagaagtacaacctgcagctgcagcactactgtgagcgggacaacctgattggagaggagaccaagcacatgaggcagcccagccccatcgtgcctgccctgcagaacaagatcgccagcaagctgcagaggcctcccagcgtggacagcatcatccgctccttcatccacgagagctccatgagccgggcccagagcccccctgtgcctgccaggaagaaccagctgcgggcagaggaggagaagaagaatgtcatcatggagctgtctgagatgaggaagcagctgcggtctgaggagcggcggctgcaggagcggctgctgcacatggacagtgatgatgagatccccatcaggaagaaggagaggaaccccatggacatctttgacatggcccggcaccggctgcaggcccctgtgcggcggcagagccccaagggcctggatgctgccaccttccagaatgtgcatgacttcaatgagctgaaggaccgggacagcgagaccagggtggacctgaagttcatgtacctggaccccccccgggaccaccacaccctggagatccagcagcaggccctgctgcgggagcagcagaagaggctgaaccgcatcaagatgcaggagggcgccaaggtggacctggatgccatccccagcgccaaggtgcgggagcagaggatgcccagagatgacaccagtgacttcctgaagaacagcctgctggagagtgacagcgccttcatcggggcctatggagagacctacccagccattgaagatgatgtgctgcccccacccagccagctgcccagcgcccgggagaggagaagaaacaagtggaagggcctggacatcgacagcagccggcccaacgtggccccagatggcctgagcctgaagagcatcagctctgtgaatgtggatgagctgcgggtgagaaatgaggagaggatgaggcggctgaatgagttccacaacaagcccatcaacacagatgatgagagcagcctggtggaccctgatgacatcatgaagcacatcggagatgatggcagcaacagcgtggccacagagccctggctgcggcccggcaccagcgagaccctgaagcgcttcatggccgagcagctgaaccaggagcagcagcagatccctgggaagccaggcaccttcacctggcagggcctgagcacagcccacggctag

SEQ ID NO: 147101 - DNA, 3771 bp, Artificial Sequence
  Description of Artificial Sequence: Synthetic coding sequence
atgctgttccccctgcaggtggccgctgtgaccagctctgtgagagatgaccccctggagcactgtgtgagccccaggacccgggcccggagccctgagatctgcaagatggctgacaacctggatgagttcatcgaggagcagaaggcccggctggccgaggacaaggccgagctggagagtgaccccccctacatggagatgaagggcaagctgagcgccaagctgtctgagaacagcaagatcctgatctccatggccaaggagaacatcccccccaacagccagcagacccggggcagcctgggcatcgactatggcctgagcctgcccctgggggaggactatgaaaggaagaagcacaagctgaaggaggagctgcggcaggactaccgccgctacctgacccagaaggtgttttctggcaccagcaagaagaacttcctgagcaccagcgagacagaccccagcaccctgggcgtgtccctgcccatcggggagcggctgagcgccaaggagcggctgaagctggagaggaacaaggagtacaaccagttcctgcggggcaaggaggagagcagcgagaagttccggcaggtggagaagagcacagagcccaagagccagaggaacaagaagcccatcggccaggtgaagccagacctgaccagccagatccagaccagctgtgaaaattctgagggccccaggaaggatgtgctgacccccagcgaggcctatgaggagctgctgaaccagaggcggctggaggaggaccgctaccggcagctggatgatgaaattgagctgaggaacagacgcatcatcaagaaggccaatgaggaggtgggcatcagcaacctgaagcaccagagatttgccagcaaggccggcatcccagaccggcgcttccaccgcttcaatgaagatagagtgtttgaccggcgctaccacaggccagaccaggaccctgaggtgtctgaggagatggatgagcgcttccgctatgaaagtgactttgaccggcggctgagccgggtgtacaccaatgacaggatgcacaggaacaagaggggcaacatgccacccatggagcatgatggagatgtgattgagcagagcaacatccgcatcagcagcgctgagaacaagagcgccccagacaatgagaccagcaagagcgccaaccaggacacctgcagcccctttgctggcatgctgtttggaggagaagatcgggagctgatccagaggaggaaggagaagtaccgcctggagctgctggagcagatggccgagcagcagaggaacaagagaagagagaaggacctggagctgcgggtggccgccagcggggcccaggaccctgagaagagcccagaccggctgaagcagttctctgtggcccccaggcactttgaggagatgatccccccagagcggccccgcatcgccttccagacccccctgccccccctgagcgcccccagcgtgccccccatccccagcgtgcaccctgtgcccagccagaatgaagacctgcggagcggcctgagcagcgccctgggggagatggtgagcccccgcatcgcccccctgcccccaccacccctgctgccccccctggccaccaactaccgcaccccctatgatgatgcctactacttctacggcagcaggaacacctttgaccccagcctggcctactacggcagcggcatgatgggcgtgcagcctgctgcctacgtgtctgcccctgtgacccaccagctggcccagcctgtggtgaacacagtgggccagaatgagctgaagatcaccagtgaccaggtgatcaacagcggcctcatctttgaggacaagcccaagcccagcaagcagagcctgcagagctaccaggaggccctgcagcagcagatccgggagcgggaggagaggaggaagaaggagcgggaggagaaggaggagtatgaggccaagctggaggccgagatgaggacctacaacccctggggcaaaggaggcggcggggcccccctgagagatgccaagggcaacctgatcacagacctgaacaggatgcaccggcagaacattgatgcctaccacaacccagatgcccggacctatgaggacaagagagctgtggtgtccctggaccccaacctggccaccagcaatgctgagaacctggaggatgctgccaacaagagcagcggccacatgcagacccagagcagcccctttgcccggggaaatgtgtttggagagcccccaacagagctgcagatcaagcagcaggagctgtacaagaacttcctgcgcttccagatcgaggagaagaagcagcgggaggaggccgagcgggagcggctgagaattgctgaggagaaggaggagcggcggctggccgagcagagggcccgcatccagcaggagtatgaggaggagcaggagaagaagcgggagaaggaggaggagcagaggctgaagaatgaggagcacatccggctggccgaggagcggcagaaggaggccgagaggaagaagaaggaggaggaggagaagtacaacctgcagctgcagcactactgtgagcgggacaacctgattggagaggagaccaagcacatgaggcagcccagccccatcgtgcctgccctgcagaacaagatcgccagcaagctgcagaggcctccttctgtggacagcatcatccgctccttcatccacgagagctccatgagccgggcccagagcccccctgtgcctgccaggaagaaccagctgcgggcagaggaggagaagaagaatgtcatcatggagctgtctgagatgaggaagcagctgcggtctgaggagcggcggctgcaggagcggctgctgcacatggacagtgatgatgagatccccatcaggaagaaggagaggaaccccatggacatctttgacatggcccggcaccggctgcaggcccctgtgcggcggcagagccccaagggcctggatgctgccaccttccagaatgtgcatgacttcaatgagctgaaggaccgggacagcgagaccagggtggacctgaagttcatgtacctggaccccccccgggaccaccacaccctggagatccagcagcaggccctgctgcgggagcagcagaagaggctgaaccgcatcaagatgcaggagggcgccaaggtggacctggatgccatccccagcgccaaggtgcgggagcagaggatgcccagagatgacaccagtgacttcctgaagaacagcctgctggagagtgacagcgccttcatcggggcctacggggagacctacccagccattgaagatgatgtgctgcccccacccagccagctgcccagcgcccgggagaggagaagaaacaagtggaagggcctggacatcgacagcagccggcccaacgtggccccagatggcctgagcctgaagagcatcagctctgtgaatgtggatgagctgcgggtgagaaatgaggagaggatgaggcggctgaatgagttccacaacaagcccatcaacacagatgatgagagcagcctggtggaccctgatgacatcatgaagcacatcggagatgatggcagcaacagcgtggccacagagccctggctgcggcccggcaccagcgagaccctgaagcgcttcatggccgagcagctgaaccaggagcagcagcagatccctgggaagccaggcaccttcacctggcagggcctgagcacagcccatggatag

SEQ ID NO: 147102 - DNA, 2631 bp, Artificial Sequence
  Description of Artificial Sequence: Synthetic coding sequence
atggatgagcgcttccgctatgaaagtgactttgaccggcggctgagccgggtgtacaccaatgacaggatgcacaggaacaagaggggcaacatgccacccatggagcatgatggagatgtgattgagcagagcaacatccgcatcagcagcgctgagaacaagagcgccccagacaatgagaccagcaagagcgccaaccaggacacctgcagcccctttgctggcatgctgtttggaggagaggaccgggagctgatccagaggaggaaggagaagtaccgcctggagctgctggagcagatggccgagcagcagaggaacaagaggcgggagaaggacctggagctgcgggtggccgccagcggggcccaggaccctgagaagagcccagaccggctgaagcagttctctgtggcccccaggcactttgaggagatgatccccccagagcggcccagaattgccttccagacccccctgccccccctgagcgcccccagcgtgccccccatccccagcgtgcaccctgtgcccagccagaatgaagacctgcggagcggcctgagcagcgccctgggggagatggtgagccccagaattgcccccctgcccccaccacccctgctgccccccctggccaccaactaccgcaccccctatgatgatgcctactacttctacggcagcaggaacacctttgaccccagcctggcctactacggcagcggcatgatgggcgtgcagcctgctgcctacgtgtctgcccctgtgacccaccagctggcccagcctgtggtgaacacagtgggccagaatgagctgaagatcaccagtgaccaggtgatcaacagcggcctcatctttgaggacaagcccaagcccagcaagcagagcctgcagagctaccaggaggccctgcagcagcagatccgggagcgggaggagaggaggaagaaggagcgggaggagaaggaggagtatgaggccaagctggaggccgagatgaggacctacaacccctggggcaagggcggcggcggggcccccctgagagatgccaagggcaacctgatcagccacatgcagacccagagcagcccctttgcccggggaaatgtgtttggagagcccccaacagagctgcagatcaagcagcaggagctgtacaagaacttcctgcgcttccagatcgaggagaagaagcagcgggaggaggccgagcgggagcggctgagaattgctgaggagaaggaggagcggcggctggccgagcagagggcccgcatccagcaggagtatgaggaggagcaggagaagaagcgggagaaggaggaggagcagaggctgaagaatgaggagcacatccggctggccgaggagcggcagaaggaggccgagaggaagaagaaggaggaggaggagaagtacaacctgcagctgcagcactactgtgagcgggacaacctgattggagaggagaccaagcacatgaggcagcccagccccatcgtgcctgccctgcagaacaagatcgccagcaagctgcagaggcctccttctgtggacagcatcatccgctccttcatccacgagagctccatgagccgggcccagagcccccctgtgcctgccaggaagaaccagctgcgggcagaggaggagaagaagaatgtcatcatggagctgtctgagatgaggaagcagctgcggtctgaggagcggcggctgcaggagcggctgctgcacatggacagtgatgatgagatccccatcaggaagaaggagaggaaccccatggacatctttgacatggcccggcaccggctgcaggcccctgtgcggcggcagagccccaagggcctggatgctgccaccttccagaatgtgcatgacttcaatgagctgaaggaccgggacagcgagaccagggtggacctgaagttcatgtacctggaccccccccgggaccaccacaccctggagatccagcagcaggccctgctgcgggagcagcagaagaggctgaaccgcatcaagatgcaggagggcgccaaggtggacctggatgccatccccagcgccaaggtgcgggagcagaggatgcccagagatgacaccagtgacttcctgaagaacagcctgctggagagtgacagcgccttcatcggggcctacggggagacctacccagccattgaagatgatgtgctgcccccacccagccagctgcccagcgcccgggagaggagaagaaacaagtggaagggcctggacatcgacagcagccggcccaacgtggccccagatggcctgagcctgaagagcatcagctctgtgaatgtggatgagctgcgggtgagaaatgaggagaggatgaggcggctgaatgagttccacaacaagcccatcaacacagatgatgagagcagcctggtggaccctgatgacatcatgaagcacatcggagatgatggcagcaacagcgtggccacagagccctggctgcggcccggcaccagcgagaccctgaagcgcttcatggccgagcagctgaaccaggagcagcagcagatccctgggaagccaggcaccttcacctggcagggcctgagcacagcccatggatag

SEQ ID NO: 147103 - DNA, 2631 bp, Artificial Sequence; identical to SEQ ID NO: 147102
  Description of Artificial Sequence: Synthetic coding sequence

SEQ ID NO: 147104 - DNA, 1677 bp, Artificial Sequence
  Description of Artificial Sequence: Synthetic coding sequence
atgccctggaggagaagaagaaacagagtgtctgccctggagggcggccgggaggaggaggcccctcctgaggccgctgctgtgcccccagccctgctgaccagcccccagcagacagaagctgctgctgagcgcatcctgctgcggggcatctttgagatcggccgggacagctgtgatgtggtgctgtctgagcgggccctgcgctggaggcccatccagcctgagaggcctgctggggacagcaaatatgacctgctgtgcaaggaggagttcatcgagctgaaggacatcttctctgtgaagctgaagaggcgctgcagcgtgaagcagcagaggagcggcaccctgctgggcatcaccctcttcatctgcctgaagaaggagcagaacaagctgaagaacagcaccctggacctgatcaacctgtctgaggaccactgtgacatctggttccggcagttcaagaagatcctggccggcttccccaaccggcccaagagcctgaagatcctgctgaacccccagagccacaagaaggaggccacccaggtgtactatgagaaggtggagcccctgctgaagctggccggcatcaagacagatgtgaccatcatggagtatgagggccacgccctgagcctgctgaaggaatgtgagctgcagggctttgatggcggccacaggaagcccctgtttgccatccactggagcgtgcagaggctcttcaccggcatgcagaccctggagcccagcgtggtgtgtgtgggcggagatggcagcgccagcgaggtggcccacgccctgctgctgcgggcccagaagaatgccggcatggagacagaccgcatcctgacccctgtgcgggcccagctgcccctgggcctcatcccagctggcagcaccaacgtgctggcccacagcctgcacggcgtgccccacgtgatcacagccaccctgcacatcatcatgggccacgtgcagctggtggatgtgtgcaccttcagcacagctgggaagctgctgcgcttcggcttcagcgccatgtttggatttggaggccgcaccctggccctggccgagaagtaccgctggatgagccccaaccagaggcgggactttgctgtggtgaaggccctggccaagctgaaggccgaggactgtgagatctccttcctgcccttcaacagcagtgatgatgtgcaggagcggcgggcccagggcagccccaagagtgactgcaatgaccagtggcagatgatccagggccagttcctgaatgtgtccatcatggccatcccctgcctgtgcagcgtggccccccggggcctggcccccaacacccggctgaacaacggctccatggccctgatcatcgccaggaacaccagcaggcctgagttcatcaagcacctgaagagatatgcctctgtgaagaaccagttcaacttcccctttgtggagacctacacagtggaggaggtgaaggtgcaccccaggaacaacacaggaggctacaaccctgaggaggaggaggatgaaacagccagcgagaactgcttcccctggaatgtggatggagacctgatggaggtggccagcgaggtgcacatccggctgcaccccaggctcatcagcctgtatggaggctccatggaggagatgatccccaagtag

SEQ ID NO: 147105 - DNA, 1260 bp, Artificial Sequence
  Description of Artificial Sequence: Synthetic coding sequence
atgccctggaggagaagaagaaacagagtgtctgccctggagggcggccgggaggaggaggcccctcctgaggccgctgctgtgcccccagccctgctgaccagcccccagcagacagaagctgctgctgagcgcatcctgctgcggggcatctttgagatcggccgggacagctgtgatgtggtgctgtctgagcgggccctgcgctggaggcccatccagcctgagaggcctgctggggacagcaaatatgacctgctgtgcaaggaggagttcatcgagctgaaggacatcttctctgtgaagctgaagaggcgctgcagcgtgaagcagcagaggagcggcaccctgctgggcatcaccctcttcatctgcctgaagaaggagcagaacaagctgaagaacagcaccctggacctgatcaacctgtctgaggaccactgtgacatctggttccggcagttcaagaagatcctggccggcagcaccaacgtgctggcccacagcctgcatggagtgccccacgtgatcacagccaccctgcacatcatcatgggccacgtgcagctggtggatgtgtgcaccttcagcacagctgggaagctgctgcgcttcggcttcagcgccatgtttggatttggaggccgcaccctggccctggccgagaagtaccgctggatgagccccaaccagaggcgggactttgctgtggtgaaggccctggccaagctgaaggccgaggactgtgagatctccttcctgcccttcaacagcagtgatgatgtgcaggagcggcgggcccagggcagccccaagagtgactgcaatgaccagtggcagatgatccagggccagttcctgaatgtgtccatcatggccatcccctgcctgtgcagcgtggccccccggggcctggcccccaacacccggctgaacaacggctccatggccctgatcatcgccaggaacaccagcaggcctgagttcatcaagcacctgaagagatatgcctctgtgaagaaccagttcaacttcccctttgtggagacctacacagtggaggaggtgaaggtgcaccccaggaacaacacaggaggctacaaccctgaggaggaggaggatgaaacagccagcgagaactgcttcccctggaatgtggatggagacctgatggaggtggccagcgaggtgcacatccggctgcaccccaggctcatcagcctgtatggaggctccatggaggagatgatccccaagtag

SEQ ID NO: 147106 - DNA, 1392 bp, Artificial Sequence
  Description of Artificial Sequence: Synthetic coding sequence
atgccctggaggagaagaagaaacagagtgtctgccctggagggcggccgggaggaggaggcccctcctgaggccgctgctgtgcccccagccctgctgaccagcccccagcagacagaagctgctgctgagcgcatcctgctgcggggcatctttgagatcggccgggacagctgtgatgtggtgctgtctgagcgggccctgcgctggaggcccatccagcctgagaggcctgctggggacagcaaatatgacctgctgtgcaaggaggagttcatcgagctgaaggacatcttctctgtgaagctgaagaggcgctgcagcgtgaagcagcagaggagcggcaccctgctgggcatcaccctcttcatctgcctgaagaaggagcagaacaagctgaagaacagcaccctggacctgatcaacctgtctgaggaccactgtgacatctggttccggcagttcaagaagatcctggccggcttccccaaccggcccaagagcctgaagatcctgctgaacccccagagccacaagaaggaggccacccaggtgtactatgagaaggtggagcccctgctgaagctggccggcatcaagacagatgtgaccaggagcaccaacgtgctggcccacagcctgcatggagtgccccacgtgatcacagccaccctgcacatcatcatgggccacgtgcagctggtggatgtgtgcaccttcagcacagctgggaagctgctgcgcttcggcttcagcgccatgtttggatttggaggccgcaccctggccctggccgagaagtaccgctggatgagccccaaccagaggcgggactttgctgtggtgaaggccctggccaagctgaaggccgaggactgtgagatctccttcctgcccttcaacagcagtgatgatgtgcaggagcggcgggcccagggcagccccaagagtgactgcaatgaccagtggcagatgatccagggccagttcctgaatgtgtccatcatggccatcccctgcctgtgcagcgtggccccccggggcctggcccccaacacccggctgaacaacggctccatggccctgatcatcgccaggaacaccagcaggcctgagttcatcaagcacctgaagagatatgcctctgtgaagaaccagttcaacttcccctttgtggagacctacacagtggaggaggtgaaggtgcaccccaggaacaacacaggaggctacaaccctgaggaggaggaggatgaaacagccagcgagaactgcttcccctggaatgtggatggagacctgatggaggtggccagcgaggtgcacatccggctgcaccccaggctcatcagcctgtatggaggctccatggaggagatgatccccaagtag

SEQ ID NO: 147107 - DNA, 1599 bp, Artificial Sequence
  Description of Artificial Sequence: Synthetic coding sequence
atgccctggaggagaagaagaaacagagtgtctgccctggagggcggccgggaggaggaggcccctcctgaggccgctgctgtgcccccagccctgctgaccagcccccagcagacagaagctgctgctgagcgcatcctgctgcggggcatctttgagatcggccgggacagctgtgatgtggtgctgtctgagcgggccctgcgctggaggcccatccagcctgagaggcctgctggggacagcaaatatgacctgctgtgcaaggaggagttcatcgagctgaaggacatcttctctgtgaagctgaagaggcgctgcagcgtgaagcagcagaggagcggcaccctgctgggcatcaccctcttcatctgcctgaagaaggagcagaacaagctgaagaacagcaccctggacctgatcaacctgtctgaggaccactgtgacatctggttccggcagttcaagaagatcctggccggcttccccaaccggcccaagagcctgaagatcctgctgaacccccagagccacaagaaggaggccacccaggtgtactatgagaaggtggagcccctgctgaagctggccggcatcaagacagatgtgaccatcatggagtatgagggccacgccctgagcctgctgaaggaatgtgagctgcagggctttgatggagtggtgtgtgtgggcggagatggcagcgccagcgaggtggcccacgccctgctgctgcgggcccagaagaatgccggcatggagacagaccgcatcctgacccctgtgcgggcccagctgcccctgggcctcatcccagctggcagcaccaacgtgctggcccacagcctgcacggcgtgccccacgtgatcacagccaccctgcacatcatcatgggccacgtgcagctggtggatgtgtgcaccttcagcacagctgggaagctgctgcgcttcggcttcagcgccatgtttggatttggaggccgcaccctggccctggccgagaagtaccgctggatgagccccaaccagaggcgggactttgctgtggtgaaggccctggccaagctgaaggccgaggactgtgagatctccttcctgcccttcaacagcagtgatgatgtgcaggagcggcgggcccagggcagccccaagagtgactgcaatgaccagtggcagatgatccagggccagttcctgaatgtgtccatcatggccatcccctgcctgtgcagcgtggccccccggggcctggcccccaacacccggctgaacaacggctccatggccctgatcatcgccaggaacaccagcaggcctgagttcatcaagcacctgaagagatatgcctctgtgaagaaccagttcaacttcccctttgtggagacctacacagtggaggaggtgaaggtgcaccccaggaacaacacaggaggctacaaccctgaggaggaggaggatgaaacagccagcgagaactgcttcccctggaatgtggatggagacctgatggaggtggccagcgaggtgcacatccggctgcaccccaggctcatcagcctgtatggaggctccatggaggagatgatccccaagtag

SEQ ID NO: 147108 - DNA, 1545 bp, Artificial Sequence
  Description of Artificial Sequence: Synthetic coding sequence
atgccctggaggagaagaagaaacagagtgtctgccctggagggcggccgggaggaggaggcccctcctgaggccgctgctgtgcccccagccctgctgaccagcccccagcagacagaagctgctgctgagcgcatcctgctgcggggcatctttgagatcggccgggacagctgtgatgtggtgctgtctgagcgggccctgcgctggaggcccatccagcctgagaggcctgctggggacagcaaatatgacctgctgtgcaaggaggagttcatcgagctgaaggacatcttctctgtgaagctgaagaggcgctgcagcgtgaagcagcagaggagcggcaccctgctgggcatcaccctcttcatctgcctgaagaaggagcagaacaagctgaagaacagcaccctggacctgatcaacctgtctgaggaccactgtgacatctggttccggcagttcaagaagatcctggccgtgatggagtatgagggccacgccctgagcctgctgaaggaatgtgagctgcagggctttgatggcggccacaggaagcccctgtttgccatccactggagcgtgcagaggctcttcaccggcatgcagaccctggagcccagcgtggtgtgtgtgggcggagatggcagcgccagcgaggtggcccacgccctgctgctgcgggcccagaagaatgccggcatggagacagaccgcatcctgacccctgtgcgggcccagctgcccctgggcctcatcccagctggcagcaccaacgtgctggcccacagcctgcacggcgtgccccacgtgatcacagccaccctgcacatcatcatgggccacgtgcagctggtggatgtgtgcaccttcagcacagctgggaagctgctgcgcttcggcttcagcgccatgtttggatttggaggccgcaccctggccctggccgagaagtaccgctggatgagccccaaccagaggcgggactttgctgtggtgaaggccctggccaagctgaaggccgaggactgtgagatctccttcctgcccttcaacagcagtgatgatgtgcaggagcggcgggcccagggcagccccaagagtgactgcaatgaccagtggcagatgatccagggccagttcctgaatgtgtccatcatggccatcccctgcctgtgcagcgtggccccccggggcctggcccccaacacccggctgaacaacggctccatggccctgatcatcgccaggaacaccagcaggcctgagttcatcaagcacctgaagagatatgcctctgtgaagaaccagttcaacttcccctttgtggagacctacacagtggaggaggtgaaggtgcaccccaggaacaacacaggaggctacaaccctgaggaggaggaggatgaaacagccagcgagaactgcttcccctggaatgtggatggagacctgatggaggtggccagcgaggtgcacatccggctgcaccccaggctcatcagcctgtatggaggctccatggaggagatgatccccaagtag

SEQ ID NO: 147109 - DNA, 804 bp, Artificial Sequence
  Description of Artificial Sequence: Synthetic coding sequence
atgcacctgctgctcttccagctgctggtgctgctgcccctgggcaagaccaccaggcaccaggacggccggcagaaccagagcagcctgagccctgtgctgctgcccaggaaccagcgggagctgcccaccggcaaccacgaggaggccgaggagaagccagacctgtttgtggccgtgccccacctggtggccaccagccctgctggggagggccagaggcagcgggagaagatgctgagcagatttggccgcttctggaagaagccagagcgggagatgcaccccagccgggacagcgacagcgagcccttccccccaggcacccagagcctcatccagcccattgatggcatgaagatggagaagagccccctgcgggaggaggccaagaagttctggcaccacttcatgttcaggaagaccccagccagccagggcgtcatcctgcccatcaagagccatgaggtgcactgggagacctgcaggacagtgcccttcagccagaccatcacccatgagggctgtgagaaggtggtggtgcagaacaacctgtgctttggaaaatgtggctctgtgcacttccctggggccgcccagcacagccacaccagctgcagccactgcctgcctgccaagttcaccaccatgcacctgcccctgaactgcacagagctgagcagcgtcatcaaggtggtgatgctggtggaggagtgccagtgcaaggtgaagacagaacatgaagatggccacatcctgcatgctggcagccaggacagcttcatccctggggtgtctgcctag

SEQ ID NO: 147110 - DNA, 789 bp, Artificial Sequence
  Description of Artificial Sequence: Synthetic coding sequence
atggcctggctggaggatgtggacttcctggaggatgtgcccctgctggaggacatccccctgctggaggatgtgcccctgctggaggatgtgcccctgctggaggacaccagccggctggaggacatcaacctgatggaggacatggccctgctggaggatgtggacctgctggaggacacagacttcctggaggacctggacttcagcgaggccatggacctgcgggaggacaaggacttcctggaggacatggacagcctggaggacatggccctgctggaggatgtggacctgctggaggacacagacttcctggaggaccctgacttcctggaggccatcgacctgcgggaggacaaggacttcctggaggacatggacagcctggaggacctggaggccatcggccgctgtggcttcagcggcagacatggcttcttcggcagaagacgcttcagcggccggcccaagctgagcggccgcctgggcctgctgggccggcggggcttcagcggccgcctgggcggctactggaagacctggatcttctggaagacctggatcttctggaagacctggatcttcaggaagacctacatcggctggaagacctggatcttcagcggccgctgtggcctgaccggccggcccggctttggaggaagaagacgcttcttctggaagaccctgacagactggaagacctggatctccttctggaagaccctgattgactggaagacctggatctccttctggaagaccctgattgactggaagatctag

SEQ ID NO: 147111 - DNA, 1365 bp, Artificial Sequence
  Description of Artificial Sequence: Synthetic coding sequence
atgctggccgagaacctggtggaggagtttgagatgaaggaggatgagccctggtatgaccaccaggacctgcagcaggacctgcagctggccgctgagctgggcaagaccctgctggacaggaacacagagctggaggacagcgtgcagcagatgtacaccaccaaccaggagcagctgcaggagattgagtacctgaccaagcaggtggagctgctgcggcagatgaatgagcagcacgccaaggtgtatgagcagctggatgtgacagcccgggagctggaggagaccaaccagaagctggtggccgacagcaaggccagccagcagaagatcctgagcctgacagagaccatcgagtgcctgcagaccaacatcgaccacctgcagagccaggtggaggagctgaagagcagcggccagggcagaagaagccctggaaaatgtgaccaggagaagccagcccccagctttgcctgcctgaaggagctgtatgacctgcggcagcactttgtgtatgaccacgtgtttgctgagaagatcaccagcctgcagggccagcccagcccagatgaggaggagaatgagcacctgaagaagacagtgaccatgctgcaggcccagctgagcctggagcggcagaagagggtgaccatggaggaggagtatggcctggtgctgaaggaaaattctgagctggagcagcagctgggcgccaccggggcctaccgggcccgggccctggagctggaggccgaggtggccgagatgaggcagatgctgcagagcgagcacccctttgtgaatggagtggagaagctggtgcctgacagcctgtatgtgcccttcaaggagcccagccagagcctgctggaggagatgttcctgactgtgcctgagagccacaggaagcccctgaagaggagcagcagcgagaccatcctgagcagcctggccggcagtgacatcgtgaagggccacgaggagacctgcatcagaagagccaaggctgtgaagcagaggggcatcagcctgctgcacgaggtggacacccagtacagcgccctgaaggtgaagtatgaggagctgctgaagaagtgccaggaggagcaggacagcctgagccacaaggctgtgcagaccagcagagctgctgccaaggacctgactggagtgaatgcccagagcgagcctgtggccagcggctgggagctggcctctgtgaaccctgagcctgtgagcagccccaccaccccacctgagtacaaggccctcttcaaggagatcttcagctgcatcaagaagaccaagcaggagattgatgagcagaggaccaagtaccgcagcctgagcagccacagctag

SEQ ID NO: 147112 - DNA, 618 bp, Artificial Sequence
  Description of Artificial Sequence: Synthetic coding sequence
atgctgggcgccaagccccactggctgcccggccccctgcacagccctggcctgcccctggtgctggtgctgctggccctgggcgccggctgggcccaggagggcagcgagcctgtgctgctggagggggagtgcctggtggtgtgtgagcccggccgggctgctgctgggggccctggaggagctgccctgggggaggcccctcctggccgggtggcctttgctgctgtgcgcagccaccaccacgagcctgctggggagactggaaatggcaccagcggggccatctactttgaccaggtgctggtgaatgaaggaggcggctttgaccgggccagcggcagctttgtggcccctgtgcggggcgtgtacagcttccgcttccacgtggtgaaggtgtacaaccggcagacagtgcaggtgtccctgatgctgaacacctggcctgtgatcagcgcctttgccaatgaccctgatgtgacccgggaggccgccaccagctctgtgctgctgcccctggaccccggggacagagtgtccctgcggctgcggcggggcaacctgctgggcggctggaagtacagcagcttcagcggcttcctgatcttccccctgtag

SEQ ID NO: 147113 - DNA, 990 bp, Artificial Sequence
  Description of Artificial Sequence: Synthetic coding sequence
atgatcctgatgaagatgggcttctctggaattgtggtgcaccaggagagcgtgtgtgccacctacggcagcggcctgagcagcacctgcatcgtggatgtgggggaccagaagacctctgtgtgctgcgtggaggatggagtgagccacaggaacacccgcatcttctcctggaaccaggacatcagcggcctgcaggaccacgagttccagatccgccacccagacagccctgccctgctgtaccagttccggctgggagatgagaagctgcaggcccccatggccctcttctacccagccacctttggaattgtgggccagaagatgaccaccctgcagcacaggagccagggcgaccctgaggacccccatgatgagcactacctgctggccacccagagcaagcaggagcagagcgccaaggccacagctgacaggaagagcgccagcaagcccatcggctttgaaggagacctgcggggccagagcagtgacctgcctgagcggctgcacagccaggaggtggacctgggcagcgcccagggagatggcctgatggctggaaatgacagcgaggaggccctgacagccctgatgagcaggaagacagccatcagcctgtttgagggcaaggccctgggcctggacaaggccatcctgcacagcattgactgctgcagcagtgatgacaccaagaagaagatgtacagcagcatcctggtggtgggcggcggcctgatgttccacaaggcccaggagttcctgcagcaccgcatcctgaacaagatgcctccttccttccgccgcatcattgaaaatgtggatgtgatcacccggcccaaggacatggacccccggctgattgcctggaagggcggcgctgtgctggcctgcctggacaccacccaggagctgtggatctaccagcgggagtggcagcgcttcggcgtgaggatgctgcgggagagagctgcctttgtgtggtag

SEQ ID NO: 147114 - DNA, 1131 bp, Artificial Sequence
  Description of Artificial Sequence: Synthetic coding sequence
atggaggagttccacggccgcaccctgcatgatgatgacagctgccaggtgattcctgtgctgccccaggtgatgatgatcctgatccctggccagaccctgcccctgcagctgttccacccccaggaggtgtccatggtgaggaacctgatccagaaggacaggacctttgctgtgctggcctacagcaatgtgcaggagcgggaggcccagtttggcaccacagctgagatctatgcctaccgggaggagcaggactttggaattgaaattgtgaaggtgaaggccatcggccggcagcgcttcaaggtgctggagctgcggacccagagtgatggcatccagcaggccaaggtgcagatcctgcctgaatgtgtgctgcccagcaccatgtctgctgtgcagctggagagcctgaacaagtgccagatcttccccagcaagcctgtgtcccgggaggaccagtgcagctacaagtggtggcagaagtaccagaagaggaagttccactgtgccaacctgacctcctggccccgctggctgtacagcctgtatgatgctgagaccctgatggaccgcatcaagaagcagctgcgggagtgggatgagaacctgaaggatgacagcctgcccagcaacttctcctacagagtggccgcctgcctgcccattgatgatgtgctgcgcatccagctgctgaagattggcagcgccatccagaggctgcgctgtgagctggacatcatgaacaagtgcaccagcctgtgctgcaagcagtgccaggagacagagatcaccaccaagaatgagatcttcagcctgagcctgtgtggccccatggccgcctacgtgaacccccacggctacgtgcatgagaccctgactgtgtacaaggcctgcaacctgaacctgattggccggcccagcacagagcacagctggttccctggctacgcctggacagtggcccagtgcaagatctgtgccagccacatcggctggaagttcaccgccaccaagaaggacatgagcccccagaagttctggggcctgaccaggtctgccctgctgcccaccatcccagacacagaagatgagatcagcccagacaaggtgatcctgtgcctgtag

SEQ ID NO: 147115 - DNA, 1326 bp, Artificial Sequence
  Description of Artificial Sequence: Synthetic coding sequence
atggccggggagggggaccagcaggatgctgcccacaacatgggcaaccacctgcccctgctgcctgagagcgaggaggaggatgagatggaggtggaggaccaggacagcaaggaggccaagaagcccaacatcatcaactttgacaccagcctgcccaccagccacacctacctgggcgctgacatggaggagttccacggccgcaccctgcatgatgatgacagctgccaggtgattcctgtgctgccccaggtgatgatgatcctgatccctggccagaccctgcccctgcagctgttccacccccaggaggtgtccatggtgaggaacctgatccagaaggacaggacctttgctgtgctggcctacagcaatgtgcaggagcgggaggcccagtttggcaccacagctgagatctatgcctaccgggaggagcaggactttggaattgaaattgtgaaggtgaaggccatcggccggcagcgcttcaaggtgctggagctgcggacccagagtgatggcatccagcaggccaaggtgcagatcctgcctgaatgtgtgctgcccagcaccatgtctgctgtgcagctggagagcctgaacaagtgccagatcttccccagcaagcctgtgtcccgggaggaccagtgcagctacaagtggtggcagaagtaccagaagaggaagttccactgtgccaacctgacctcctggccccgctggctgtacagcctgtatgatgctgagaccctgatggaccgcatcaagaagcagctgcgggagtgggatgagaacctgaaggatgacagcctgcccagcaaccccatcgacttctcctacagagtggccgcctgcctgcccattgatgatgtgctgcgcatccagctgctgaagattggcagcgccatccagaggctgcgctgtgagctggacatcatgaacaagtgcaccagcctgtgctgcaagcagtgccaggagacagagatcaccaccaagaatgagatcttcagcctgagcctgtgtggccccatggccgcctacgtgaacccccacggctacgtgcatgagaccctgactgtgtacaaggcctgcaacctgaacctgattggccggcccagcacagagcacagctggttccctggctacgcctggacagtggcccagtgcaagatctgtgccagccacatcggctggaagttcaccgccaccaagaaggacatgagcccccagaagttctggggcctgaccaggtctgccctgctgcccaccatcccagacacagaagatgagatcagcccagacaaggtgatcctgtgcctgtag

SEQ ID NO: 147116 - DNA, 1335 bp, Artificial Sequence
  Description of Artificial Sequence: Synthetic coding sequence
atggaggaggagggcaagaagggcaagaagccaggcatcgtgagccccttcaagagggtcttcctgaagggggagaagagccgggacaagaaggcccacgagaaggtgacagaaagaagacccctgcacacagtggtgctgagcctgcctgagcgggtggagccagaccggctgctgagtgactacatcgagaaggaggtgaagtacctgggccagctgaccagcatccctggctacctgaaccccagcagcaggacagagatcctgcacttcatcgacaatgccaagagggcccaccagctgcccggccacctgacccaggagcatgatgctgtgctgagcctgagcgcctacaacgtgaagctggcctggagagatggagaggacatcatcctgcgggtgcccatccatgacattgctgctgtgtcctatgtgagagatgatgctgcccacctggtggtgctgaagacagcccaggaccccggcatcagccccagccagagcctgtgtgccgagagcagccggggcctgtctgctggcagcctgtctgagagcgctgtgggccctgtggaggcctgctgcctggtgatcctggccgctgagagcaaggtggccgctgaggagctgtgctgcctgctgggccaggtgttccaggtggtgtacacagagagcaccatcgacttcctggaccgggccatctttgatggagccagcacccccacccaccacctgagcctgcacagtgatgacagcagcaccaaggtggacatcaaggagacctatgaggtggaggccagcaccttctgcttccctgagagcgtggatgtgggcggggccagcccccacagcaagaccatcagcgagagcgagctgagcgccagcgccacagagctgctgcaggactacatgctgaccctgcggaccaagctgagcagccaggagatccagcagtttgctgccctgctgcacgagtacagaaatggagccagcatccacgagttctgcatcaacctgcggcagctgtatggagacagcaggaagttcctgctgctgggcctgcggcccttcatccctgagaaggacagccagcactttgagaacttcctggagaccatcggcgtgaaggatggccggggcatcatcacagacagctttggccgccacagaagagccctgagcaccaccagcagcagcaccaccaatggaaacagagccaccggcagcagtgatgacagaagtgcccccagtgaaggagatgagtgggacaggatgatcagtgacatcagcagtgacatcgaggccctgggctgcagcatggaccaggacagcgcctag

SEQ ID NO: 147117 - DNA, 1398 bp, Artificial Sequence
  Description of Artificial Sequence: Synthetic coding sequence
atgcacagcagctgccggcagaggaggaaccagaacctgagcaaggagatcccccagacagagttccacacaggctacagcatggagaatgagcccggcatcgtgagccccttcaagagggtcttcctgaagggggagaagagccgggacaagaaggcccacgagaaggtgacagagcggcggcccctgcacacagtggtgctgagcctgcctgagcgggtggagccagaccggctgctgagtgactacatcgagaaggaggtgaagtacctgggccagctgaccagcatccctggctacctgaaccccagcagcaggacagagatcctgcacttcatcgacaatgccaagagggcccaccagctgcccggccacctgacccaggagcatgatgctgtgctgagcctgagcgcctacaacgtgaagctggcctggagagatggagaggacatcatcctgcgggtgcccatccatgacattgctgctgtgtcctatgtgagagatgatgctgcccacctggtggtgctgaagacagcccaggaccccggcatcagccccagccagagcctgtgtgccgagagcagccggggcctgtctgctggcagcctgtctgagagcgctgtgggccctgtggaggcctgctgcctggtgatcctggccgctgagagcaaggtggccgctgaggagctgtgctgcctgctgggccaggtgttccaggtggtgtacacagagagcaccatcgacttcctggaccgggccatctttgatggagccagcacccccacccaccacctgagcctgcacagtgatgacagcagcaccaaggtggacatcaaggagacctatgaggtggaggccagcaccttctgcttccctgagagcgtggatgtgggcggggccagcccccacagcaagaccatcagcgagagcgagctgagcgccagcgccacagagctgctgcaggactacatgctgaccctgcggaccaagctgagcagccaggagatccagcagtttgctgccctgctgcacgagtacagaaatggagccagcatccacgagttctgcatcaacctgcggcagctgtatggagacagcaggaagttcctgctgctgggcctgcggcccttcatccctgagaaggacagccagcactttgagaacttcctggagaccatcggcgtgaaggatggccggggcatcatcacagacagctttggccgccaccggcgggccctgagcaccaccagcagcagcaccaccaacggcaacagagccaccggcagcagtgatgacagaagtgcccccagtgaaggagatgagtgggacaggatgatcagtgacatcagcagtgacatcgaggccctgggctgcagcatggaccaggacagcgcctag

SEQ ID NO: 147118 - DNA, 1317 bp, Artificial Sequence
  Description of Artificial Sequence: Synthetic coding sequence
atggagaatgaacctggcatcgtgagccccttcaagagggtcttcctgaagggggagaagagccgggacaagaaggcccacgagaaggtgacagaaagaagacccctgcacacagtggtgctgagcctgcctgagcgggtggagccagaccggctgctgagtgactacatcgagaaggaggtgaagtacctgggccagctgaccagcatccctggctacctgaaccccagcagcaggacagagatcctgcacttcatcgacaatgccaagagggcccaccagctgcccggccacctgacccaggagcatgatgctgtgctgagcctgagcgcctacaacgtgaagctggcctggagagatggagaggacatcatcctgcgggtgcccatccatgacattgctgctgtgtcctatgtgagagatgatgctgcccacctggtggtgctgaagacagcccaggaccccggcatcagccccagccagagcctgtgtgccgagagcagccggggcctgtctgctggcagcctgtctgagagcgctgtgggccctgtggaggcctgctgcctggtgatcctggccgctgagagcaaggtggccgctgaggagctgtgctgcctgctgggccaggtgttccaggtggtgtacacagagagcaccatcgacttcctggaccgggccatctttgatggagccagcacccccacccaccacctgagcctgcacagtgatgacagcagcaccaaggtggacatcaaggagacctatgaggtggaggccagcaccttctgcttccctgagagcgtggatgtgggcggggccagcccccacagcaagaccatcagcgagagcgagctgagcgccagcgccacagagctgctgcaggactacatgctgaccctgcggaccaagctgagcagccaggagatccagcagtttgctgccctgctgcacgagtacagaaatggagccagcatccacgagttctgcatcaacctgcggcagctgtatggagacagcaggaagttcctgctgctgggcctgcggcccttcatccctgagaaggacagccagcactttgagaacttcctggagaccatcggcgtgaaggatggccggggcatcatcacagacagctttggccgccacagaagagccctgagcaccaccagcagcagcaccaccaatggaaacagagccaccggcagcagtgatgacagaagtgcccccagtgaaggagatgagtgggacaggatgatcagtgacatcagcagtgacatcgaggccctgggctgcagcatggaccaggacagcgcctag

SEQ ID NO: 147119 - DNA, 1161 bp, Artificial Sequence
  Description of Artificial Sequence: Synthetic coding sequence
atggaggaggagggcaagaagggcaagaagtacctgggccagctgaccagcatccctggctacctgaaccccagcagcaggacagagatcctgcacttcatcgacaatgccaagagggcccaccagctgcccggccacctgacccaggagcatgatgctgtgctgagcctgagcgcctacaacgtgaagctggcctggagagatggagaggacatcatcctgcgggtgcccatccatgacattgctgctgtgtcctatgtgagagatgatgctgcccacctggtggtgctgaagacagcccaggaccccggcatcagccccagccagagcctgtgtgccgagagcagccggggcctgtctgctggcagcctgtctgagagcgctgtgggccctgtggaggcctgctgcctggtgatcctggccgctgagagcaaggtggccgctgaggagctgtgctgcctgctgggccaggtgttccaggtggtgtacacagagagcaccatcgacttcctggaccgggccatctttgatggagccagcacccccacccaccacctgagcctgcacagtgatgacagcagcaccaaggtggacatcaaggagacctatgaggtggaggccagcaccttctgcttccctgagagcgtggatgtgggcggggccagcccccacagcaagaccatcagcgagagcgagctgagcgccagcgccacagagctgctgcaggactacatgctgaccctgcggaccaagctgagcagccaggagatccagcagtttgctgccctgctgcacgagtacagaaatggagccagcatccacgagttctgcatcaacctgcggcagctgtatggagacagcaggaagttcctgctgctgggcctgcggcccttcatccctgagaaggacagccagcactttgagaacttcctggagaccatcggcgtgaaggatggccggggcatcatcacagacagctttggccgccacagaagagccctgagcaccaccagcagcagcaccaccaatggaaacagagccaccggcagcagtgatgacagaagtgcccccagtgaaggagatgagtgggacaggatgatcagtgacatcagcagtgacatcgaggccctgggctgcagcatggaccaggacagcgcctag

SEQ ID NO: 147120 - DNA, 216 bp, Artificial Sequence
  Description of Artificial Sequence: Synthetic coding sequence
atggaggaggagggcaagaagggcaagaagccaggcatcgtgagccccttcaagagggtcttcctgaagggggagaagagccgggacaagaaggcccacgagaaggtgacagaaagaagacccctgcacacagtggtgctgagcctgcctgagcgggtggagccagaccggctgctgagtgactacatcgagaaggaggtgaagggcagccactag

SEQ ID NO: 147121 - DNA, 1062 bp, Artificial Sequence
  Description of Artificial Sequence: Synthetic coding sequence
atggaggaggagggcaagaagggcaagaagccaggcatcgtgagccccttcaagagggtcttcctgaagggggagaagagccgggacaagaaggcccacgagaaggtgacagaaagaagacccctgcacacagtggtgctgagcctgcctgagcgggtggagccagaccggctgctgagtgactacatcgagaaggaggtgaagtacctgggccagctgaccagcatccctggctacctgaaccccagcagcaggacagagatcctgcacttcatcgacaatgccaagagggcccaccagctgcccggccacctgacccaggagcatgatgctgtgctgagcctgagcgcctacaacgtgaagctggcctggagagatggagaggacatcatcctgcgggtgcccatccatgacattgctgctgtgtcctatgtgagagatgatgctgcccacctggtggtgctgaagacagatgacagcagcaccaaggtggacatcaaggagacctatgaggtggaggccagcaccttctgcttccctgagagcgtggatgtgggcggggccagcccccacagcaagaccatcagcgagagcgagctgagcgccagcgccacagagctgctgcaggactacatgctgaccctgcggaccaagctgagcagccaggagatccagcagtttgctgccctgctgcacgagtacagaaatggagccagcatccacgagttctgcatcaacctgcggcagctgtatggagacagcaggaagttcctgctgctgggcctgcggcccttcatccctgagaaggacagccagcactttgagaacttcctggagaccatcggcgtgaaggatggccggggcatcatcacagacagctttggccgccaccggcgggccctgagcaccaccagcagcagcaccaccaacggcaacagagccaccggcagcagtgatgacagaagtgcccccagtgaaggagatgagtgggacaggatgatcagtgacatcagcagtgacatcgaggccctgggctgcagcatggaccaggacagcgcctag

SEQ ID NO: 147122 - DNA, 1224 bp, Artificial Sequence
  Description of Artificial Sequence: Synthetic coding sequence
atgagaagaaacctgcggctgggccccagcagtggagcagatgcccagggccagggcgcccccaggcctggcctggccgcccccaggatgctgctgcccccagccagccaggccagccggggcagcggcagcacaggctgcagcctgatggcccaggaggtggacacagcccagggcgctgagatgagaagaggagctggggccgcccggggccgggcctcctggtgctgggccctggccctgctgtggctggccgtggtgcccggctggagccgggtgtctggcatccccagcagaagacactggcctgtgccctacaagagatttgacttccggcccaagccagacccctactgccaggccaagtacaccttctgccccaccggcagccccatccctgtgatggagggagatgatgacatcgaggtgttccggctgcaggcccctgtgtgggagttcaagtatggagacctgctgggccacctgaagatcatgcatgatgccatcggcttccgcagcaccctgaccgggaagaactacaccatggagtggtatgagctgttccagctgggcaactgcaccttcccccacctgcggcctgagatggatgcccccttctggtgcaaccagggcgccgcctgcttctttgagggcattgatgatgtgcactggaaggaaaatggcaccctggtgcaggtggccaccatcagcggcaacatgttcaaccagatggccaagtgggtgaagcaggacaatgagaccggcatctactatgagacctggaatgtgaaggccagccctgagaagggagctgagacctggtttgacagctatgactgcagcaagtttgtgctgcggaccttcaacaagctggccgagtttggagctgagttcaagaacatcgagaccaactacacccgcatcttcctgtacagcggggagcccacctacctgggcaatgagacctctgtgtttggccccaccggcaacaagaccctgggcctggccatcaagcgcttctactaccccttcaagccccacctgcccaccaaggagttcctgctgagcctgctgcagatctttgatgctgtgattgtgcacaagcagttctacctgttctacaactttgagtactggttcctgcccatgaagttccccttcatcaagatcacctatgaggagatccccctgcccatccggaacaagaccctgagcggcctgtag

SEQ ID NO: 147123 - DNA, 822 bp, Artificial Sequence
  Description of Artificial Sequence: Synthetic coding sequence
atggagggagatgatgacatcgaggtgttccggctgcaggcccctgtgtgggagttcaagtatggagacctgctgggccacctgaagatcatgcatgatgccatcggcttccgcagcaccctgaccgggaagaactacaccatggagtggtatgagctgttccagctgggcaactgcaccttcccccacctgcggcctgagatggatgcccccttctggtgcaaccagggcgccgcctgcttctttgagggcattgatgatgtgcactggaaggaaaatggcaccctggtgcaggtggccaccatcagcggcaacatgttcaaccagatggccaagtgggtgaagcaggacaatgagaccggcatctactatgagacctggaatgtgaaggccagccctgagaagggagctgagacctggtttgacagctatgactgcagcaagtttgtgctgcggaccttcaacaagctggccgagtttggagctgagttcaagaacatcgagaccaactacacccgcatcttcctgtacagcggggagcccacctacctgggcaatgagacctctgtgtttggccccaccggcaacaagaccctgggcctggccatcaagcgcttctactaccccttcaagccccacctgcccaccaaggagttcctgctgagcctgctgcagatctttgatgctgtgattgtgcacaagcagttctacctgttctacaactttgagtactggttcctgcccatgaagttccccttcatcaagatcacctatgaggagatccccctgcccatccggaacaagaccctgagcggcctgtag

SEQ ID NO: 147124 - DNA, 1077 bp, Artificial Sequence
  Description of Artificial Sequence: Synthetic coding sequence
atggcccaggaggtggacacagcccagggcgctgagatgagaagaggagctggagctgcccggggccgggcctcctggtgctgggccctggccctgctgtggctggccgtggtgcccggctggagccgggtgtctggcatccccagccgccgccactggcctgtgccctacaagagatttgacttccggcccaagccagacccctactgccaggccaagtacaccttctgccccaccggcagccccatccctgtgatggagggagatgatgacatcgaggtgttccggctgcaggcccctgtgtgggagttcaagtacggggacctgctgggccacctgaagatcatgcatgatgccatcggcttccgcagcaccctgaccgggaagaactacaccatggagtggtatgagctgttccagctgggcaactgcaccttcccccacctgcggcctgagatggatgcccccttctggtgcaaccagggcgccgcctgcttctttgagggcattgatgatgtgcactggaaggaaaatggcaccctggtgcaggtggccaccatcagcggcaacatgttcaaccagatggccaagtgggtgaagcaggacaatgaaacaggcatctactatgagacctggaatgtgaaggccagccctgagaagggagctgagacctggtttgacagctatgactgcagcaagtttgtgctgcggaccttcaacaagctggccgagtttggagctgagttcaagaacatcgagaccaactacacccgcatcttcctgtacagcggggagcccacctacctgggcaatgagacctctgtgtttggccccactggaaacaagaccctgggcctggccatcaagcgcttctactaccccttcaagccccacctgcccaccaaggagttcctgctgagcctgctgcagatctttgatgctgtgattgtgcacaagcagttctacctgttctacaactttgagtactggttcctgcccatgaagttccccttcatcaagatcacctatgaggagatccccctgcccatccggaacaagaccctgagcggcctgtag

SEQ ID NO: 147125 - DNA, 936 bp, Artificial Sequence
  Description of Artificial Sequence: Synthetic coding sequence
atggaggccacccggcggcggcagcacctgggcgccactggaggccctggggcccagctgggcgccagcttcctgcaggcccggcacggctctgtgtctgcagatgaagctgccaggacagcccccttccacctggacctgtggttctacttcaccctgcagaactgggtgctggactttggccggcccatcgccatgctggtgttccccctggagtggttccccctgaacaagcccagcgtgggggactacttccacatggcctacaacgtcatcacccccttcctgctgctgaagctgattgaaagaagccccaggaccctgcccaggagcatcacctacgtgtccatcatcatcttcatcatgggcgccagcatccacctggtgggggacagcgtgaaccaccggctgctcttcagcggctaccagcaccacctgtctgtgcgggagaaccccatcatcaagaacctgaagccagagaccctgattgacagctttgagctgctgtactactatgatgagtacctgggccactgcatgtggtacatccccttcttcctgatcctcttcatgtacttcagcggctgcttcaccgccagcaaggccgagagcctcatccctggccctgccctgctgctggtggcccccagcggcctgtactactggtacctggtgacagagggccagatcttcatcctcttcatcttcaccttctttgccatgctggccctggtgctgcaccagaagaggaagaggctcttcctggacagcaatggcctcttcctgttcagcagctttgccctgaccctgctgctggtggccctgtgggtggcctggctgtggaatgaccctgtgctgaggaagaagtacccaggagtcatctacgtgcctgagccctgggccttctacaccctgcacgtgagcagccgccactag

SEQ ID NO: 147126 - DNA, 549 bp, Artificial Sequence
  Description of Artificial Sequence: Synthetic coding sequence
atgaggctgcctgcccggctgcccagcaccagcaccagcggcagcaccagccactgcaggacaggcttctggaccctgggcgtgcccctgccctgctggtacagcctgagcagcggcttccacagcaccagccctgtgctgggcaccaccagcacctggcccaccaccagcagccggcccttcagctgcagcagcggctgcttcaccgccagcaaggccgagagcctcatccctggccctgccctgctgctggtggcccccagcggcctgtactactggtacctggtgacagagggccagatcttcatcctcttcatcttcaccttctttgccatgctggccctggtgctgcaccagaagaggaagaggctcttcctggacagcaatggcctcttcctgttcagcagctttgccctgaccctgctgctggtggccctgtgggtggcctggctgtggaatgaccctgtgctgaggaagaagtacccaggagtcatctacgtgcctgagccctgggccttctacaccctgcacgtgagcagccgccactag

SEQ ID NO: 147127 - DNA, 1032 bp, Artificial Sequence
  Description of Artificial Sequence: Synthetic coding sequence
atggctgctgtggccggcaaggagcggcgggcccggggccggcccaggcctgagaccctgggcgccatcccccggcgggagggcggggaggccggcctgagccgggccttcaagcccctggcccaggcccccctgagctgtgagaccagcctgaggaagctgaagttcaagggcaagaagcacggctctgtgtctgcagatgaagctgccaggacagcccccttccacctggacctgtggttctacttcaccctgcagaactgggtgctggactttggccggcccatcgccatgctggtgttccccctggagtggttccccctgaacaagcccagcgtgggggactacttccacatggcctacaacgtcatcacccccttcctgctgctgaagctgattgaaagaagccccaggaccctgcccaggagcatcacctacgtgtccatcatcatcttcatcatgggcgccagcatccacctggtgggggacagcgtgaaccaccggctgctcttcagcggctaccagcaccacctgtctgtgcgggagaaccccatcatcaagaacctgaagccagagaccctgattgacagctttgagctgctgtactactatgatgagtacctgggccactgcatgtggtacatccccttcttcctgatcctcttcatgtacttcagcggctgcttcaccgccagcaaggccgagagcctcatccctggccctgccctgctgctggtggcccccagcggcctgtactactggtacctggtgacagagggccagatcttcatcctcttcatcttcaccttctttgccatgctggccctggtgctgcaccagaagaggaagaggctcttcctggacagcaatggcctcttcctgttcagcagctttgccctgaccctgctgctggtggccctgtgggtggcctggctgtggaatgaccctgtgctgaggaagaagtacccaggagtcatctacgtgcctgagccctgggccttctacaccctgcacgtgagcagccgccactag

SEQ ID NO: 147128 - DNA, 861 bp, Artificial Sequence
  Description of Artificial Sequence: Synthetic coding sequence
atgaacccagccagtgatggcggcaccagcgagagcatctttgacctggactatgcctcctggggcatccgcagcaccctgatggtggccggctttgtgttctacctgggcgtgtttgtggtgtgccaccagctgagcagcagcctgaatgccacctaccgcagcctggtggcccgggagaaggtgttctgggacctggccgccaccagggctgtgtttggagtgcagagcacagctgctggcctgtgggccctgctgggggaccctgtgctgcatgctgacaaggcccggggccagcagaactggtgctggttccacatcaccacagccaccggcttcttctgctttgaaaatgtggccgtgcacctgagcaacctgatcttccgcacctttgacctcttcctggtgatccaccacctgtttgccttcctgggcttcctgggctgcctggtgaacctgcaggccggccactacctggccatgaccaccctgctgctggagatgagcacccccttcacctgtgtgtcctggatgctgctgaaggccggctggagcgagagcctcttctggaagctgaaccagtggctgatgatccacatgttccactgcaggatggtgctgacctaccacatgtggtgggtgtgcttctggcactgggatggcctggtgagcagcctgtacctgccccacctgaccctcttcctggtgggcctggccctgctgaccctcatcatcaacccctactggacccacaagaagacccagcagctgctgaaccctgtggactggaactttgcccagcctgaggccaagagcaggcctgagggcaatggccagctgctgaggaagaagaggccctag

SEQ ID NO: 147129 - DNA, 1065 bp, Artificial Sequence
  Description of Artificial Sequence: Synthetic coding sequence
atgtaccgggagtgggtggtggtgaatgtgttcatgatgctgtatgtgcagctggtgcagggcagcagcaatgagcacggccctgtgaagaggagcagccagagcaccctggagaggtctgagcagcagatccgggccgccagcagcctggaggagctgctgcgcatcacccacagcgaggactggaagctgtggcgctgccgcctgcggctgaagagcttcacctccatggacagccgcagcgccagccacaggagcaccaggtttgctgccaccttctatgacatcgagaccctgaaggtgattgatgaggagtggcagaggacccagtgcagcccccgggagacctgtgtggaggtggccagcgagctgggcaagagcaccaacaccttcttcaagccaccctgtgtgaatgtgttccgctgtggcggctgctgcaatgaggagagcctcatctgcatgaacaccagcaccagctacatcagcaagcagctgtttgagatctctgtgcccctgacctctgtgcctgagctggtgcctgtgaaggtggccaaccacacaggctgcaagtgcctgcccacagcccccaggcacccctacagcatcatccgccgcagcatccagatccctgaggaggaccgctgcagccacagcaagaagctgtgccccatcgacatgctgtgggacagcaacaagtgcaagtgtgtgctgcaggaggagaaccccctggccggcacagaggaccacagccacctgcaggagcccgccctgtgtggcccccacatgatgtttgatgaggacagatgtgaatgtgtgtgcaagaccccctgccccaaggacctgatccagcaccccaagaactgcagctgctttgagtgcaaggagagcctggagacctgctgccagaagcacaagctgttccacccagacacctgcagctgtgaagatcgctgccccttccacacccggccctgtgccagcggcaagacagcctgtgccaagcactgccgcttccccaaggagaagagagctgcccagggcccccacagcaggaagaacccctag

SEQ ID NO: 147130 - DNA, 504 bp, Artificial Sequence
  Description of Artificial Sequence: Synthetic coding sequence
atggagagatttgtggtgacagcccccccagccaggaacagaagcaagacagccctgtatgtgacccccctggacagagtgacagaatttggaggagagctgcatgaagatggcggcaagctgttctgcaccagctgcaatgtggtgctgaaccacgtgaggaagagcgccatcagtgaccacctgaagagcaagacccacaccaagaggaaggccgagtttgaggagcagaatgtgaggaagaagcagaggcccctgacagccagcctgcagtgcaacagcacagcccagacagagaaggtgtctgtcatccaggactttgtgaagatgtgcctggaggccaacatccccctggagaaggctgaccaccctgctgtgcgggccttcctgagcagacatgtgaagaatggaggcagcatccccaagagtgaccagctgcggcgggcctacctgcctgatggctatgaaaatgaaaaccagctgctgaacagccaggactgctag

SEQ ID NO: 147131 - DNA, 504 bp, Artificial Sequence; identical to SEQ ID NO: 147130
  Description of Artificial Sequence: Synthetic coding sequence

SEQ ID NO: 147132 - DNA, 504 bp, Artificial Sequence; identical to SEQ ID NO: 147130
  Description of Artificial Sequence: Synthetic coding sequence

SEQ ID NO: 147133 - DNA, 321 bp, Artificial Sequence
  Description of Artificial Sequence: Synthetic coding sequence
atggagagatttgtggtgacagcccccccagccaggaacagaagcaagacagccctgtatgtgacccccctggacagagtgacagaatttggaggagagctgcatgaagatggcggcaagctgttctgcaccagctgcaatgtggtgctgaaccacgtgaggaagagcgccatcagtgaccacctgaagagcaagacccacaccaagaggaaggccgagtttgaggagcagaatgtgaggaagaagcagaggcccctgacagccagcctgcagtgcaacagcacagcccagacagagaaggtgtctgtcatccaggactag

SEQ ID NO: 147134 - DNA, 504 bp, Artificial Sequence; identical to SEQ ID NO: 147130
  Description of Artificial Sequence: Synthetic coding sequence

SEQ ID NO: 147135 - DNA, 1608 bp, Artificial Sequence
  Description of Artificial Sequence: Synthetic coding sequence
atggccagcctgagcctggcccctgtgaacatcttcaaggccggggctgatgaggagagagctgagacagcccggctgaccagcttcatcggggccatcgccatcggggacctggtgaagagcaccctgggccccaagggcatggacaagatcctgctgagcagcggcagagatgccagcctgatggtgaccaatgatggagccaccatcctgaagaacatcggcgtggacaacccagctgccaaggtgctggtggacatgagccgggtgcaggatgatgaggtgggagatggcaccacctctgtgacagtgctggccgctgagctgctgcgggaggccgagagcctgattgccaagaagatccacccccagaccatcatcgccggctggagggaggccaccaaggccgcccgggaggccctgctgagcagcgctgtggaccacggcagtgatgaggtgaagttccggcaggacctgatgaacattgctggcaccaccctgagcagcaagctgctgacccaccacaaggaccacttcaccaagctggccgtggaggccgtgctgcggctgaagggcagcggcaacctggaggccatccacatcatcaagaagctgggcggcagcctggccgacagctacctggatgagggcttcctgctggacaagaagattggagtgaaccagcccaagagaattgaaaatgccaagatcctgattgccaacacaggcatggacacagacaagatcaagatcttcggcagccgggtgcgggtggacagcacagccaaggtggccgagattgaacatgctgagaaggagaagatgaaggagaaggtggagcgcatcctgaagcacggcatcaactgcttcatcaaccggcagctgatctacaactacccagagcagctgtttggagctgctggggtgatggccatcgagcacgccgactttgctggggtggagcggctggccctggtgactggaggagaaattgccagcacctttgaccaccctgagctggtgaagctgggcagctgcaagctgattgaggaggtgatgattggagaggacaagctgatccacttctctggagtggccctgggggaggcctgcaccatcgtgctgcggggggccacccagcagatcctggatgaggccgagaggagcctgcatgatgccctgtgtgtgctggcccagacagtgaaggacagcaggacagtgtatggaggcggctgcagcgagatgctgatggcccatgctgtgacccagctggccaacagaacacctgggaaggaggccgtggccatggagagctatgccaaggccctgaggatgctgcccaccatcatcgctgacaatgccggctatgacagcgctgacctggtggcccagctgcgggccgcccacagcgagggcaacaccacagctggcctggacatgagggagggcaccatcggggacatggccatcctgggcatcacagagagcttccaggtgaagaggcaggtgctgctgtctgctgctgaggccgctgaggtgatcctgcgggtggacaacatcatcaaggccgcccccaggaagagggtgcctgaccaccacccctgctag

SEQ ID NO: 147136 - DNA, 1467 bp, Artificial Sequence
  Description of Artificial Sequence: Synthetic coding sequence
atggacaagatcctgctgagcagcggcagagatgccagcctgatggtgaccaatgatggagccaccatcctgaagaacattggagtggacaacccagctgccaaggtgctggtggacatgagccgggtgcaggatgatgaggtgggagatggcaccacctctgtgacagtgctggccgctgagctgctgcgggaggccgagagcctcatcgccaagaagatccacccccagaccatcatcgccggctggagggaggccaccaaggccgcccgggaggccctgctgagcagcgctgtggaccacggcagtgatgaggtgaagttccggcaggacctgatgaacattgctggcaccaccctgagcagcaagctgctgacccaccacaaggaccacttcaccaagctggccgtggaggccgtgctgcggctgaagggcagcggcaacctggaggccatccacatcatcaagaagctgggcggcagcctggccgacagctacctggatgagggcttcctgctggacaagaagattggagtgaaccagcccaagagaattgaaaatgccaagatcctgattgccaacacaggcatggacacagacaagatcaagatcttcggcagccgggtgcgggtggacagcacagccaaggtggccgagattgagcacgccgagaaggagaagatgaaggagaaggtggagcgcatcctgaagcacggcatcaactgcttcatcaaccggcagctgatctacaactacccagagcagctgtttggagctgctggggtgatggccattgaacatgctgactttgctggggtggagcggctggccctggtgactggaggagagatcgccagcacctttgaccaccctgagctggtgaagctgggcagctgcaagctgattgaggaggtgatgattggagaggacaagctgatccacttcagcggcgtggccctgggggaggcctgcaccatcgtgctgcggggggccacccagcagatcctggatgaagctgagaggagcctgcatgatgccctgtgtgtgctggcccagacagtgaaggacagcaggacagtgtatggaggcggctgcagcgagatgctgatggcccatgctgtgacccagctggccaacagaacacctgggaaggaggccgtggccatggagagctatgccaaggccctgaggatgctgcccaccatcatcgctgacaatgccggctatgattctgctgacctggtggcccagctgcgggccgcccacagcgagggcaacaccacagctggcctggacatgagggagggcaccatcggggacatggccatcctgggcatcacagagagcttccaggtgaagaggcaggtgctgctgtctgctgctgaggccgctgaggtgatcctgcgggtggacaacatcatcaaggccgcccccaggaagagggtgcctgaccaccacccctgctag

SEQ ID NO: 147137 - DNA, 1638 bp, Artificial Sequence
  Description of Artificial Sequence: Synthetic coding sequence
atgatgggccacaggcctgtgctggtgctgagccagaacaccaagcgggagagcggcaggaaggtgcagagcggcaacatcaatgctgccaagaccatcgctgacatcatccgcacctgcctgggccccaagtccatgatgaagatgctgctggaccccatgggcggcatcgtgatgaccaatgatggaaatgccatcctgcgggagatccaggtgcagcaccctgctgccaagtccatgattgagatcagcaggacccaggatgaggaggtgggagatggcaccaccagcgtcatcatcctggccggggagatgctgtctgtggccgagcacttcctggagcagcagatgcaccccaccgtggtgatcagcgcctacaggaaggccctggatgacatgatcagcaccctgaagaagatcagcatccctgtggacatcagtgacagcgacatgatgctgaacatcatcaacagcagcatcaccaccaaggccatcagccgctggagcagcctggcctgcaacatcgccctggatgctgtgaagatggtgcagtttgaagaaaatggaaggaaggagattgacatcaagaagtatgcccgggtggagaagatccctgggggcatcatcgaggacagctgtgtgctgcggggcgtgatgatcaacaaggatgtgacccaccccaggatgaggcgctacatcaagaacccccgcatcgtgctgctggacagcagcctggagtacaagaagggggagagccagacagacatcgagatcacccgggaggaggacttcacccgcatcctgcagatggaggaggagtacatccagcagctgtgtgaggacatcatccagctgaagccagatgtggtgatcacagagaagggcatcagtgacctggcccagcactacctgatgagggccaacatcacagccatcagaagagtgaggaagacagacaacaacagaattgcccgggcctgtggggccagaattgtgtccaggcctgaggagctgcgggaggatgatgtgggcactggagctggcctgctggagatcaagaagattggagatgagtacttcaccttcatcacagactgcaaggaccccaaggcctgcaccatcctgctgcggggggccagcaaggagatcctgtctgaggtggagaggaacctgcaggatgccatgcaggtgtgcagaaatgtgctgctggacccccagctggtgcctgggggcggggccagcgagatggctgtggcccacgccctgacagagaagagcaaggccatgactggagtggagcagtggccctacagagctgtggcccaggccctggaggtgatccccaggaccctcatccagaactgtggggccagcaccatccggctgctgaccagcctgcgggccaagcacacccaggagaactgtgagacctggggcgtgaatggagagaccggcaccctggtggacatgaaggagctgggcatctgggagcccctggccgtgaagctgcagacctacaagacagctgtggagacagctgtgctgctgctgagaattgatgacatcgtgtctggccacaagaagaagggagatgaccagagccggcagggcggggccccagatgctggccaggagtag

SEQ ID NO: 147138 - DNA, 1524 bp, Artificial Sequence
  Description of Artificial Sequence: Synthetic coding sequence
atgatgggccacaggcctgtgctggtgctgagccagaacaccaagcgggagagcggcaggaaggtgcagagcggcaacatcaatgctgccaagatccaggtgcagcaccctgctgccaagtccatgattgagatcagcaggacccaggatgaggaggtgggagatggcaccaccagcgtcatcatcctggccggggagatgctgtctgtggccgagcacttcctggagcagcagatgcaccccaccgtggtgatcagcgcctacaggaaggccctggatgacatgatcagcaccctgaagaagatcagcatccctgtggacatcagtgacagcgacatgatgctgaacatcatcaacagcagcatcaccaccaaggccatcagccgctggagcagcctggcctgcaacatcgccctggatgctgtgaagatggtgcagtttgaagaaaatggaaggaaggagattgacatcaagaagtatgcccgggtggagaagatccctgggggcatcatcgaggacagctgtgtgctgcggggcgtgatgatcaacaaggatgtgacccaccccaggatgaggcgctacatcaagaacccccgcatcgtgctgctggacagcagcctggagtacaagaagggggagagccagacagacatcgagatcacccgggaggaggacttcacccgcatcctgcagatggaggaggagtacatccagcagctgtgtgaggacatcatccagctgaagccagatgtggtgatcacagagaagggcatcagtgacctggcccagcactacctgatgagggccaacatcacagccatcagaagagtgaggaagacagacaacaacagaattgcccgggcctgtggggccagaattgtgtccaggcctgaggagctgcgggaggatgatgtgggcactggagctggcctgctggagatcaagaagattggagatgagtacttcaccttcatcacagactgcaaggaccccaaggcctgcaccatcctgctgcggggggccagcaaggagatcctgtctgaggtggagaggaacctgcaggatgccatgcaggtgtgcagaaatgtgctgctggacccccagctggtgcctgggggcggggccagcgagatggctgtggcccacgccctgacagagaagagcaaggccatgactggagtggagcagtggccctacagagctgtggcccaggccctggaggtgatccccaggaccctcatccagaactgtggggccagcaccatccggctgctgaccagcctgcgggccaagcacacccaggagaactgtgagacctggggcgtgaatggagagaccggcaccctggtggacatgaaggagctgggcatctgggagcccctggccgtgaagctgcagacctacaagacagctgtggagacagctgtgctgctgctgagaattgatgacatcgtgtctggccacaagaagaagggagatgaccagagccggcagggcggggccccagatgctggccaggagtag

SEQ ID NO: 147139 - DNA, 1503 bp, Artificial Sequence
  Description of Artificial Sequence: Synthetic coding sequence
atgatgaagatgctgctggaccccatgggcggcatcgtgatgaccaatgatggaaatgccatcctgcgggagatccaggtgcagcaccctgctgccaagtccatgattgagatcagcaggacccaggatgaggaggtgggagatggcaccaccagcgtcatcatcctggccggggagatgctgtctgtggccgagcacttcctggagcagcagatgcaccccaccgtggtgatcagcgcctacaggaaggccctggatgacatgatcagcaccctgaagaagatcagcatccctgtggacatcagtgacagcgacatgatgctgaacatcatcaacagcagcatcaccaccaaggccatcagccgctggagcagcctggcctgcaacatcgccctggatgctgtgaagatggtgcagtttgaggagaatggaaggaaggagattgacatcaagaagtatgcccgggtggagaagatccctgggggcatcatcgaggacagctgtgtgctgcggggcgtgatgatcaacaaggatgtgacccaccccaggatgaggcgctacatcaagaaccccagaattgtgctgctggacagcagcctggagtacaagaagggggagagccagacagacatcgagatcacccgggaggaggacttcacccgcatcctgcagatggaggaggagtacatccagcagctgtgtgaggacatcatccagctgaagccagatgtggtgatcacagagaagggcatcagtgacctggcccagcactacctgatgagggccaacatcacagccatccggcgggtgaggaagacagacaacaaccgcatcgcccgggcctgtggggcccgcatcgtgtccaggcctgaggagctgagagaagatgatgtgggcaccggggccggcctgctggagatcaagaagattggagatgagtacttcaccttcatcacagactgcaaggaccccaaggcctgcaccatcctgctgcggggggccagcaaggagatcctgtctgaggtggagaggaacctgcaggatgccatgcaggtgtgcagaaatgtgctgctggacccccagctggtgcctgggggcggggccagcgagatggctgtggcccacgccctgacagagaagagcaaggccatgactggagtggagcagtggccctacagagctgtggcccaggccctggaggtgatccccaggaccctcatccagaactgtggggccagcaccatccggctgctgaccagcctgcgggccaagcacacccaggagaactgtgagacctggggcgtgaatggagaaacaggcaccctggtggacatgaaggagctgggcatctgggagcccctggccgtgaagctgcagacctacaagacagctgtggagacagctgtgctgctgctgagaattgatgacatcgtgtctggccacaagaagaagggagatgaccagagccggcagggcggggccccagatgctggccaggagtag

SEQ ID NO: 147140 - DNA, 831 bp, Artificial Sequence
  Description of Artificial Sequence: Synthetic coding sequence
atgtatgaaggagacctggagggccagagcatgaactggaccagcgaggagggccgcggggacatcatccgcagcggcaccaacatcgaccgggcctggcagtgccagaacaccaagcgggagagcggcaggaaggtgcagagcggcaacatcaatgctgccaagaccatcgctgacatcatccgcacctgcctgggccccaagtccatgatgaagatgctgctggaccccatgggcggcatcgtgatgaccaatgatggaaatgccatcctgcgggagatccaggtgcagcaccctgctgccaagtccatgattgagatcagcaggacccaggatgaggaggtgggagatggcaccaccagcgtcatcatcctggccggggagatgctgtctgtggccgagcacttcctggagcagcagatgcaccccaccgtggtgatcagcgcctacaggaaggccctggatgacatgatcagcaccctgaagaagatcagcatccctgtggacatcagtgacagcgacatgatgctgaacatcatcaacagcagcatcaccaccaaggccatcagccgctggagcagcctggcctgcaacatcgccctggatgctgtgaagatggtgcagtttgaagaaaatggaaggaaggagattgacatcaagaagtatgcccgggtggagaagatccctgggggcatcatcgaggacagctgtgtgctgcggggcgtgatgatcaacaaggatgtgacccaccccaggatgaggcgctacatcaagaacccccgcatcgtgctgctggacagcagcctggagtacaagaagggggagagctag

SEQ ID NO: 147141 - DNA, 486 bp, Artificial Sequence
  Description of Artificial Sequence: Synthetic coding sequence
atgatgggccacaggcctgtgctggtgctgagccagaacaccaagcgggagagcggcaggaaggtgcagagcggcaacatcaatgctgccaagaccatcgctgacatcatccgcacctgcctgggccccaagtccatgatgaagatgctgctggaccccatgggcggcatcgtgatgaccaatgatggaaatgccatcctgcgggagatccaggtgcagcaccctgctgccaagtccatgattgagatcagcaggacccaggatgaggaggtgggagatggcaccaccagcgtcatcatcctggagagccacagcgtgaccatgctggagtgtggcggggccatcctggcccactgcaacctgtgcctgcctgctggggagatgctgtctgtggccgagcacttcctggagcagcagatgcaccccaccgtggtgatcagcgcctacaggaaggccctggatgacatgatcagcaccctgaagtag

SEQ ID NO: 147142 - DNA, 567 bp, Artificial Sequence
  Description of Artificial Sequence: Synthetic coding sequence
atgtatgaaggagacctggagggccagagcatgaactggaccagcgaggagggccgcggggacatcatccgcagcggcaccaacatcgaccgggcctggcagtgccagaacaccaagcgggagagcggcaggaaggtgcagagcggcaacatcaatgctgccaagatccaggtgcagcaccctgctgccaagtccatgattgagatcagcaggacccaggatgaggaggtgggagatggcaccaccagcgtcatcatcctggccggggagatgctgtctgtggccgagcacttcctggagcagcagatgcaccccaccgtggtgatcagcgcctacaggaaggccctggatgacatgatcagcaccctgaagaagatcagcatccctgtggacatcagtgacagcgacatgatgctgaacatcatcaacagcagcatcaccaccaaggccatcagccgctggagcagcctggcctgcaacatcgccctggatgctgtgaagatggtgcagtttgaagaaaatggaaggaaggagattgacatcaagaagtatgcccgggtggagtag

SEQ ID NO: 147143 - DNA, 1503 bp, Artificial Sequence; identical to SEQ ID NO: 147139
  Description of Artificial Sequence: Synthetic coding sequence

SEQ ID NO: 147144 - DNA, 1620 bp, Artificial Sequence
  Description of Artificial Sequence: Synthetic coding sequence
atgccagaaaatgtggcccccaggtctggggccacagctggagctgctgggggccggggcaaaggagcctaccaggaccgggacaagccagcccagatccgcttcagcaacatctctgctgccaaggctgtggctgatgccatccgcaccagcctgggccccaagggcatggacaagatgatccaggatggaaaaggagatgtgaccatcaccaatgatggagccaccatcctgaagcagatgcaggtgctgcaccctgctgccaggatgctggtggagctgagcaaggcccaggacatcgaggccggagatggcaccacctctgtggtgatcatcgccggcagcctgctggacagctgcaccaagctgctgcagaagggcatccaccccaccatcatcagcgagagcttccagaaggccctggagaagggcatcgagatcctgacagacatgagcaggcctgtggagctgagtgaccgggagaccctgctgaacagcgccaccaccagcctgaacagcaaggtggtgtcccagtacagcagcctgctgagccccatgtctgtgaatgctgtgatgaaggtgattgatcctgccacagccacctctgtggacctgcgggacatcaagatcgtgaagaagctgggcggcaccattgatgactgtgagctggtggagggcctggtgctgacccagaaggtgagcaacagcggcatcaccagggtggagaaggccaagattggcctcatccagttctgcctgagcgcccccaagacagacatggacaaccagatcgtggtgtctgactatgcccagatggacagagtgctgcgggaggagcgggcctacatcctgaacctggtgaagcagatcaagaagacaggctgcaatgtgctgctgatccagaagagcatcctgagagatgccctgagtgacctggccctgcacttcctgaacaagatgaagatcatggtgatcaaggacatcgagagagaagatattgagttcatctgcaagaccatcggcaccaagcctgtggcccacatcgaccagttcaccgctgacatgctgggcagcgctgagctggccgaggaggtgaacctgaatggcagcggcaagctgctgaagatcaccggctgtgccagccctgggaagacagtgaccatcgtggtgcggggcagcaacaagctggtgattgaggaggccgagaggagcatccatgatgccctgtgtgtgatccgctgcctggtgaagaagagggccctgattgctgggggcggggcccctgagattgagctggccctgcggctgacagagtacagcaggaccctgagcggcatggagagctactgtgtgcgggcctttgctgatgccatggaggtgatccccagcaccctggctgaaaatgccggcctgaaccccatcagcacagtgacagagctgaggaacagacatgcccagggcgagaagacagctggcatcaacgtgaggaaaggaggcatcagcaacatcctggaggagctggtggtgcagcccctgctggtgtctgtgtctgccctgaccctggccacagaaacagtgcgcagcatcctgaagattgatgatgtggtgaacaccaggtag

SEQ ID NO: 147145 - DNA, 1452 bp, Artificial Sequence
  Description of Artificial Sequence: Synthetic coding sequence
atggacaagatgatccaggatggaaaaggagatgtgaccatcaccaatgatggagccaccatcctgaagcagatgcaggtgctgcaccctgctgccaggatgctggtggagctgagcaaggcccaggacatcgaggccggagatggcaccacctctgtggtgatcatcgccggcagcctgctggacagctgcaccaagctgctgcagaagggcatccaccccaccatcatcagcgagagcttccagaaggccctggagaagggcatcgagatcctgacagacatgagcaggcctgtggagctgagtgaccgggagaccctgctgaacagcgccaccaccagcctgaacagcaaggtggtgtcccagtacagcagcctgctgagccccatgtctgtgaatgctgtgatgaaggtgattgatcctgccacagccacctctgtggacctgcgggacatcaagatcgtgaagaagctgggcggcaccattgatgactgtgagctggtggagggcctggtgctgacccagaaggtgagcaacagcggcatcaccagggtggagaaggccaagattggcctcatccagttctgcctgagcgcccccaagacagacatggacaaccagatcgtggtgtctgactatgcccagatggacagagtgctgcgggaggagcgggcctacatcctgaacctggtgaagcagatcaagaagacaggctgcaatgtgctgctgatccagaagagcatcctgagagatgccctgagtgacctggccctgcacttcctgaacaagatgaagatcatggtgatcaaggacatcgagagagaagatattgagttcatctgcaagaccatcggcaccaagcctgtggcccacatcgaccagttcaccgctgacatgctgggcagcgctgagctggccgaggaggtgaacctgaatggcagcggcaagctgctgaagatcaccggctgtgccagccctgggaagacagtgaccatcgtggtgcggggcagcaacaagctggtgattgaggaggccgagaggagcatccatgatgccctgtgtgtgatccgctgcctggtgaagaagagggccctgattgctgggggcggggcccctgagattgagctggccctgcggctgacagagtacagcaggaccctgagcggcatggagagctactgtgtgcgggcctttgctgatgccatggaggtgatccccagcaccctggctgaaaatgccggcctgaaccccatcagcacagtgacagagctgaggaacagacatgcccagggcgagaagacagctggcatcaacgtgaggaaaggaggcatcagcaacatcctggaggagctggtggtgcagcccctgctggtgtctgtgtctgccctgaccctggccacagaaacagtgcgcagcatcctgaagattgatgatgtggtgaacaccaggtag

SEQ ID NO: 147146 - DNA, 1530 bp, Artificial Sequence
  Description of Artificial Sequence: Synthetic coding sequence
atgccagaaaatgtggcccccaggtctggggccacagctggagctgctgggggccggggcaaaggagcctaccaggaccgggacaagccagcccagatccgcttcagcaacatctctgctgccaaggctgtggctgatgccatccgcaccagcctgggccccaagggcatggacaagatgctggtggagctgagcaaggcccaggacatcgaggccggagatggcaccacctctgtggtgatcatcgccggcagcctgctggacagctgcaccaagctgctgcagaagggcatccaccccaccatcatcagcgagagcttccagaaggccctggagaagggcatcgagatcctgacagacatgagcaggcctgtggagctgagtgaccgggagaccctgctgaacagcgccaccaccagcctgaacagcaaggtggtgtcccagtacagcagcctgctgagccccatgtctgtgaatgctgtgatgaaggtgattgatcctgccacagccacctctgtggacctgcgggacatcaagatcgtgaagaagctgggcggcaccattgatgactgtgagctggtggagggcctggtgctgacccagaaggtgagcaacagcggcatcaccagggtggagaaggccaagattggcctcatccagttctgcctgagcgcccccaagacagacatggacaaccagatcgtggtgtctgactatgcccagatggacagagtgctgcgggaggagcgggcctacatcctgaacctggtgaagcagatcaagaagacaggctgcaatgtgctgctgatccagaagagcatcctgagagatgccctgagtgacctggccctgcacttcctgaacaagatgaagatcatggtgatcaaggacatcgagagagaagatattgagttcatctgcaagaccatcggcaccaagcctgtggcccacatcgaccagttcaccgctgacatgctgggcagcgctgagctggccgaggaggtgaacctgaatggcagcggcaagctgctgaagatcaccggctgtgccagccctgggaagacagtgaccatcgtggtgcggggcagcaacaagctggtgattgaggaggccgagaggagcatccatgatgccctgtgtgtgatccgctgcctggtgaagaagagggccctgattgctgggggcggggcccctgagattgagctggccctgcggctgacagagtacagcaggaccctgagcggcatggagagctactgtgtgcgggcctttgctgatgccatggaggtgatccccagcaccctggctgaaaatgccggcctgaaccccatcagcacagtgacagagctgaggaacagacatgcccagggcgagaagacagctggcatcaacgtgaggaaaggaggcatcagcaacatcctggaggagctggtggtgcagcccctgctggtgtctgtgtctgccctgaccctggccacagaaacagtgcgcagcatcctgaagattgatgatgtggtgaacaccaggtag

SEQ ID NO: 147147 - DNA, 1170 bp, Artificial Sequence
  Description of Artificial Sequence: Synthetic coding sequence
atgagcaggcctgtggagctgagtgaccgggagaccctgctgaacagcgccaccaccagcctgaacagcaaggtggtgtcccagtacagcagcctgctgagccccatgtctgtgaatgctgtgatgaaggtgattgatcctgccacagccacctctgtggacctgcgggacatcaagatcgtgaagaagctgggcggcaccattgatgactgtgagctggtggagggcctggtgctgacccagaaggtgagcaacagcggcatcaccagggtggagaaggccaagattggcctcatccagttctgcctgagcgcccccaagacagacatggacaaccagatcgtggtgtctgactatgcccagatggacagagtgctgcgggaggagcgggcctacatcctgaacctggtgaagcagatcaagaagacaggctgcaatgtgctgctgatccagaagagcatcctgagagatgccctgagtgacctggccctgcacttcctgaacaagatgaagatcatggtgatcaaggacatcgagagagaagatattgagttcatctgcaagaccatcggcaccaagcctgtggcccacatcgaccagttcaccgctgacatgctgggcagcgctgagctggccgaggaggtgaacctgaatggcagcggcaagctgctgaagatcaccggctgtgccagccctgggaagacagtgaccatcgtggtgcggggcagcaacaagctggtgattgaggaggccgagaggagcatccatgatgccctgtgtgtgatccgctgcctggtgaagaagagggccctgattgctgggggcggggcccctgagattgagctggccctgcggctgacagagtacagcaggaccctgagcggcatggagagctactgtgtgcgggcctttgctgatgccatggaggtgatccccagcaccctggctgaaaatgccggcctgaaccccatcagcacagtgacagagctgaggaacagacatgcccagggcgagaagacagctggcatcaacgtgaggaaaggaggcatcagcaacatcctggaggagctggtggtgcagcccctgctggtgtctgtgtctgccctgaccctggccacagaaacagtgcgcagcatcctgaagattgatgatgtggtgaacaccaggtag

SEQ ID NO: 147148 - DNA, 1626 bp, Artificial Sequence
  Description of Artificial Sequence: Synthetic coding sequence
atggcctccatgggcaccctggcctttgatgaatatggccggcccttcctgatcatcaaggaccaggacaggaagagccggctgatgggcctggaggccctgaagagccacatcatggccgccaaggctgtggccaacaccatgaggaccagcctgggccccaacggcctggacaagatgatggtggacaaggatggagatgtgacagtgaccaatgatggagccaccatcctgtccatgatggatgtggaccaccagatcgccaagctgatggtggagctgagcaagagccaggatgatgaaattggagatggcaccactggagtggtggtgctggccggggccctgctggaggaggccgagcagctgctggaccggggcatccaccccatcagaattgctgatggctatgagcaggccgcccgggtggccatcgagcacctggacaagatcagtgacagcgtgctggtggacatcaaggacacagagcccctcatccagacagccaagaccaccctgggcagcaaggtggtgaacagctgccaccggcagatggccgagattgctgtgaatgctgtgctgactgtggccgacatggagaggagagatgtggactttgagctgatcaaggtggagggcaaggtgggcggccgcctggaggacaccaagctgatcaagggcgtgattgtggacaaggacttcagccacccccagatgcccaagaaggtggaggatgccaagatcgccatcctgacctgcccctttgagccccccaagcccaagaccaagcacaagctggatgtgacctctgtggaggactacaaggccctgcagaagtatgagaaggagaagtttgaggagatgatccagcagatcaaggagactggagccaacctggccatctgccagtggggctttgatgatgaggccaaccacctgctgctgcagaacaacctgcctgctgtgcgctgggtgggcggccctgagattgagctgattgccatcgccactggaggaagaattgtgccccgcttcagcgagctgacagctgagaagctgggctttgctggcctggtgcaggagatcagctttggcaccaccaaggacaagatgctggtgattgagcagtgcaagaacagcagagctgtgaccatcttcatccggggcggcaacaagatgatcatcgaggaggccaagaggagcctgcatgatgccctgtgtgtgatccggaacctgatccgggacaacagagtggtgtatggaggaggagctgctgagatcagctgtgccctggccgtgtcccaggaggccgacaagtgccccaccctggagcagtatgccatgagggcctttgctgatgccctggaggtgatccccatggccctgtctgagaacagcggcatgaaccccatccagaccatgacagaggtgcgggcccggcaggtgaaggagatgaacccagccctgggcatcgactgcctgcacaagggcaccaatgacatgaagcagcagcacgtgattgagaccctgattggcaagaagcagcagatcagcctggccacccagatggtgaggatgatcctgaagattgatgacatcaggaagccaggagagagcgaggagtag

SEQ ID NO: 147149 - DNA, 1545 bp, Artificial Sequence
  Description of Artificial Sequence: Synthetic coding sequence
atggcctccatgggcaccctggcctttgatgaatatggccggcccttcctgatcatcaaggaccaggacaggaagagccggctgatgggcctggaggccctgaagagccacatcatggccgccaaggctgtggccaacaccatgaggaccagcctgggccccaacggcctggacaagatgatggtggacaaggatggagatgtgacagtgaccaatgatgaaattggagatggcaccaccggggtggtggtgctggccggggccctgctggaggaggccgagcagctgctggaccggggcatccaccccatcagaattgctgatggctatgagcaggccgcccgggtggccatcgagcacctggacaagatcagtgacagcgtgctggtggacatcaaggacacagagcccctcatccagacagccaagaccaccctgggcagcaaggtggtgaacagctgccaccggcagatggccgagattgctgtgaatgctgtgctgactgtggccgacatggagaggagagatgtggactttgagctgatcaaggtggagggcaaggtgggcggccgcctggaggacaccaagctgatcaagggcgtcatcgtggacaaggacttcagccacccccagatgcccaagaaggtggaggatgccaagatcgccatcctgacctgcccctttgagccccccaagcccaagaccaagcacaagctggatgtgacctctgtggaggactacaaggccctgcagaagtatgagaaggagaagtttgaggagatgatccagcagatcaaggagaccggggccaacctggccatctgccagtggggctttgatgatgaggccaaccacctgctgctgcagaacaacctgcctgctgtgcgctgggtgggcggccctgagattgagctgattgccatcgccaccggcggccgcatcgtgccccgcttcagcgagctgacagctgagaagctgggctttgctggcctggtgcaggagatcagctttggcaccaccaaggacaagatgctggtgattgagcagtgcaagaacagcagagctgtgaccatcttcatccggggcggcaacaagatgatcatcgaggaggccaagaggagcctgcatgatgccctgtgtgtgatccggaacctgatccgggacaacagagtggtgtatggaggaggagctgctgagatcagctgtgccctggccgtgtcccaggaggccgacaagtgccccaccctggagcagtatgccatgagggcctttgctgatgccctggaggtgatccccatggccctgtctgaaaattctggcatgaaccccatccagaccatgacagaggtgcgggcccggcaggtgaaggagatgaacccagccctgggcatcgactgcctgcacaagggcaccaatgacatgaagcagcagcacgtgattgagaccctcatcggcaagaagcagcagatcagcctggccacccagatggtgaggatgatcctgaagattgatgacatcaggaagccaggagagagcgaggagtag

SEQ ID NO: 147150 - DNA, 1563 bp, Artificial Sequence
  Description of Artificial Sequence: Synthetic coding sequence
atgaacagcagcctgggccccaccatcgagaagctgtctgtgagccacatcatggccgccaaggctgtggccaacaccatgaggaccagcctgggccccaacggcctggacaagatgatggtggacaaggatggagatgtgacagtgaccaatgatggagccaccatcctgtccatgatggatgtggaccaccagatcgccaagctgatggtggagctgagcaagagccaggatgatgaaattggagatggcaccaccggggtggtggtgctggccggggccctgctggaggaggccgagcagctgctggaccggggcatccaccccatcagaattgctgatggctatgagcaggccgcccgggtggccatcgagcacctggacaagatcagtgacagcgtgctggtggacatcaaggacacagagcccctcatccagacagccaagaccaccctgggcagcaaggtggtgaacagctgccaccggcagatggccgagattgctgtgaatgctgtgctgactgtggccgacatggagaggagagatgtggactttgagctgatcaaggtggagggcaaggtgggcggccgcctggaggacaccaagctgatcaagggcgtcatcgtggacaaggacttcagccacccccagatgcccaagaaggtggaggatgccaagatcgccatcctgacctgcccctttgagccccccaagcccaagaccaagcacaagctggatgtgacctctgtggaggactacaaggccctgcagaagtatgagaaggagaagtttgaggagatgatccagcagatcaaggagaccggggccaacctggccatctgccagtggggctttgatgatgaggccaaccacctgctgctgcagaacaacctgcctgctgtgcgctgggtgggcggccctgagattgagctgattgccatcgccaccggcggccgcatcgtgccccgcttcagcgagctgacagctgagaagctgggctttgctggcctggtgcaggagatcagctttggcaccaccaaggacaagatgctggtgattgagcagtgcaagaacagcagagctgtgaccatcttcatccggggcggcaacaagatgatcatcgaggaggccaagaggagcctgcatgatgccctgtgtgtgatccggaacctgatccgggacaacagagtggtgtatggaggaggagctgctgagatcagctgtgccctggccgtgtcccaggaggccgacaagtgccccaccctggagcagtatgccatgagggcctttgctgatgccctggaggtgatccccatggccctgtctgaaaattctggcatgaaccccatccagaccatgacagaggtgcgggcccggcaggtgaaggagatgaacccagccctgggcatcgactgcctgcacaagggcaccaatgacatgaagcagcagcacgtgattgagaccctcatcggcaagaagcagcagatcagcctggccacccagatggtgaggatgatcctgaagattgatgacatcaggaagccaggagagagcgaggagtag

SEQ ID NO: 147151 - DNA, 1347 bp, Artificial Sequence
  Description of Artificial Sequence: Synthetic coding sequence
atggccgccaaggctgtggccaacaccatgaggaccagcctgggccccaacgtgctggccggggccctgctggaggaggccgagcagctgctggaccggggcatccaccccatcagaattgctgatggctatgagcaggccgcccgggtggccatcgagcacctggacaagatcagtgacagcgtgctggtggacatcaaggacacagagcccctcatccagacagccaagaccaccctgggcagcaaggtggtgaacagctgccaccggcagatggccgagattgctgtgaatgctgtgctgactgtggccgacatggagaggagagatgtggactttgagctgatcaaggtggagggcaaggtgggcggccgcctggaggacaccaagctgatcaagggcgtcatcgtggacaaggacttcagccacccccagatgcccaagaaggtggaggatgccaagatcgccatcctgacctgcccctttgagccccccaagcccaagaccaagcacaagctggatgtgacctctgtggaggactacaaggccctgcagaagtatgagaaggagaagtttgaggagatgatccagcagatcaaggagaccggggccaacctggccatctgccagtggggctttgatgatgaggccaaccacctgctgctgcagaacaacctgcctgctgtgcgctgggtgggcggccctgagattgagctgattgccatcgccaccggcggccgcatcgtgccccgcttcagcgagctgacagctgagaagctgggctttgctggcctggtgcaggagatcagctttggcaccaccaaggacaagatgctggtgattgagcagtgcaagaacagcagagctgtgaccatcttcatccggggcggcaacaagatgatcatcgaggaggccaagaggagcctgcatgatgccctgtgtgtgatccggaacctgatccgggacaacagagtggtgtatggaggaggagctgctgagatcagctgtgccctggccgtgtcccaggaggccgacaagtgccccaccctggagcagtatgccatgagggcctttgctgatgccctggaggtgatccccatggccctgtctgaaaattctggcatgaaccccatccagaccatgacagaggtgcgggcccggcaggtgaaggagatgaacccagccctgggcatcgactgcctgcacaagggcaccaatgacatgaagcagcagcacgtgattgagaccctcatcggcaagaagcagcagatcagcctggccacccagatggtgaggatgatcctgaagattgatgacatcaggaagccaggagagagcgaggagtag

SEQ ID NO: 147152 - DNA, 1461 bp, Artificial Sequence
  Description of Artificial Sequence: Synthetic coding sequence
atggcctccatgggcaccctggcctttgatgaatatggccggcccttcctgatcatcaaggaccaggacaggaagagccggctgatgggcctggaggccctgaagagccacatcatggccgccaaggctgtggccaacaccatgaggaccagcctgggccccaacgtgctggccggggccctgctggaggaggccgagcagctgctggaccggggcatccaccccatcagaattgctgatggctatgagcaggccgcccgggtggccatcgagcacctggacaagatcagtgacagcgtgctggtggacatcaaggacacagagcccctcatccagacagccaagaccaccctgggcagcaaggtggtgaacagctgccaccggcagatggccgagattgctgtgaatgctgtgctgactgtggccgacatggagaggagagatgtggactttgagctgatcaaggtggagggcaaggtgggcggccgcctggaggacaccaagctgatcaagggcgtcatcgtggacaaggacttcagccacccccagatgcccaagaaggtggaggatgccaagatcgccatcctgacctgcccctttgagccccccaagcccaagaccaagcacaagctggatgtgacctctgtggaggactacaaggccctgcagaagtatgagaaggagaagtttgaggagatgatccagcagatcaaggagaccggggccaacctggccatctgccagtggggctttgatgatgaggccaaccacctgctgctgcagaacaacctgcctgctgtgcgctgggtgggcggccctgagattgagctgattgccatcgccaccggcggccgcatcgtgccccgcttcagcgagctgacagctgagaagctgggctttgctggcctggtgcaggagatcagctttggcaccaccaaggacaagatgctggtgattgagcagtgcaagaacagcagagctgtgaccatcttcatccggggcggcaacaagatgatcatcgaggaggccaagaggagcctgcatgatgccctgtgtgtgatccggaacctgatccgggacaacagagtggtgtatggaggaggagctgctgagatcagctgtgccctggccgtgtcccaggaggccgacaagtgccccaccctggagcagtatgccatgagggcctttgctgatgccctggaggtgatccccatggccctgtctgaaaattctggcatgaaccccatccagaccatgacagaggtgcgggcccggcaggtgaaggagatgaacccagccctgggcatcgactgcctgcacaagggcaccaatgacatgaagcagcagcacgtgattgagaccctcatcggcaagaagcagcagatcagcctggccacccagatggtgaggatgatcctgaagattgatgacatcaggaagccaggagagagcgaggagtag

SEQ ID NO: 147153 - DNA, 1512 bp, Artificial Sequence
  Description of Artificial Sequence: Synthetic coding sequence
atggccgccaaggctgtggccaacaccatgaggaccagcctgggccccaacggcctggacaagatgatggtggacaaggatggagatgtgacagtgaccaatgatggagccaccatcctgtccatgatggatgtggaccaccagatcgccaagctgatggtggagctgagcaagagccaggatgatgaaattggagatggcaccactggagtggtggtgctggccggggccctgctggaggaggccgagcagctgctggaccggggcatccaccccatcagaattgctgatggctatgagcaggccgcccgggtggccatcgagcacctggacaagatcagtgacagcgtgctggtggacatcaaggacacagagcccctcatccagacagccaagaccaccctgggcagcaaggtggtgaacagctgccaccggcagatggccgagattgctgtgaatgctgtgctgactgtggccgacatggagaggagagatgtggactttgagctgatcaaggtggagggcaaggtgggcggccgcctggaggacaccaagctgatcaagggcgtgattgtggacaaggacttcagccacccccagatgcccaagaaggtggaggatgccaagatcgccatcctgacctgcccctttgagccccccaagcccaagaccaagcacaagctggatgtgacctctgtggaggactacaaggccctgcagaagtatgagaaggagaagtttgaggagatgatccagcagatcaaggagactggagccaacctggccatctgccagtggggctttgatgatgaggccaaccacctgctgctgcagaacaacctgcctgctgtgcgctgggtgggcggccctgagattgagctgattgccatcgccactggaggaagaattgtgccccgcttcagcgagctgacagctgagaagctgggctttgctggcctggtgcaggagatcagctttggcaccaccaaggacaagatgctggtgattgagcagtgcaagaacagcagagctgtgaccatcttcatccggggcggcaacaagatgatcatcgaggaggccaagaggagcctgcatgatgccctgtgtgtgatccggaacctgatccgggacaacagagtggtgtatggaggaggagctgctgagatcagctgtgccctggccgtgtcccaggaggccgacaagtgccccaccctggagcagtatgccatgagggcctttgctgatgccctggaggtgatccccatggccctgtctgagaacagcggcatgaaccccatccagaccatgacagaggtgcgggcccggcaggtgaaggagatgaacccagccctgggcatcgactgcctgcacaagggcaccaatgacatgaagcagcagcacgtgattgagaccctgattggcaagaagcagcagatcagcctggccacccagatggtgaggatgatcctgaagattgatgacatcaggaagccaggagagagcgaggagtag

SEQ ID NO: 147154 - DNA, 1593 bp, Artificial Sequence
  Description of Artificial Sequence: Synthetic coding sequence
atggccgccatcaaggctgtgaacagcaaggccgaggtggcccgggcccgggccgccctggccgtgaacatctgtgccgcccggggcctgcaggatgtgctgcggaccaacctgggccccaagggcaccatgaagatgctggtgtctggagctggggacatcaagctgaccaaggatggaaatgtgctgctggatgagatgcagatccagcaccccacagccagcctgattgccaaggtggccacagcccaggatgatgtgactggagatggcaccaccagcaatgtgctgatcattggagagctgctgaagcaggccgacctgtacatcagcgagggcctgcacccccgcatcatcgccgagggctttgaagctgccaagatcaaggccctggaggtgctggaggaggtgaaggtgaccaaggagatgaagaggaagatcctgctggatgtggcccggaccagcctgcagaccaaggtgcacgccgagctggctgatgtgctgacagaggtggtggtggacagcgtgctggccgtgcggcggcccggctaccccatcgacctcttcatggtggagatcatggagatgaagcacaagctgggcacagacaccaagctgatccagggcctggtgctggaccacggggcccggcacccagacatgaagaagagggtggaggatgccttcatcctgatctgcaatgtgtccctggagtatgagaagacagaggtgaacagcggcttcttctacaagacagctgaggagaaggagaagctggtgaaggccgagaggaagttcatcgaggacagagtgcagaagatcatcgacctgaaggacaaggtgtgtgcccagagcaacaagggctttgtggtgatcaaccagaagggcatcgaccccttcagcctggacagcctggccaagcacggcatcgtggccctgcggcgggccaagagaagaaacatggagcggctgagcctggcctgtggcggcatggctgtgaacagctttgaggacctgactgtggactgcctgggccatgctggcctggtgtatgagtacaccctgggggaggagaagttcaccttcattgaagaatgtgtgaacccctgcagcgtgaccctgctggtgaagggccccaacaagcacaccctgacccaggtgaaggatgccatcagagatggcctgcgggccatcaagaatgccattgaagatggctgcatggtgcctggagctggggccatcgaggtggccatggccgaggccctggtgacctacaagaacagcatcaagggccgggcccggctgggcgtgcaggcctttgctgatgccctgctgatcatccccaaggtgctggcccagaatgccggctatgacccccaggagaccctggtgaaggtgcaggccgagcacgtggagagcaagcagctggtgggcgtggacctgaacacaggagagcccatggtggccgcagatgctggggtgtgggacaactactgtgtgaagaagcagctgctgcacagctgcaccgtgattgccaccaacatcctgctggtggatgagatcatgagagctggcatgagcagcctgaagtag

SEQ ID NO: 147155 - DNA, 1482 bp, Artificial Sequence
  Description of Artificial Sequence: Synthetic coding sequence
atggccgccatcaaggctgtgaacagcaaggccgaggtggcccgggcccgggccgccctggccgtgaacatctgtgccgcccggggcctgcaggatgtgctgcggaccaacctgggccccaagggcaccatgaagatgctggtgtctggagctggggacatcaagctgaccaaggatggaaatgtgctgctggatgagatgcagatccagcaccccacagccagcctgattgccaaggtggccacagcccaggatgatgtgactggagatggcaccaccagcaatgtgctgatcattggagagctgctgaagcaggccgacctgtacatcagcgagggcctgcacccccgcatcatcgccgagggctttgaagctgccaagatcaaggccctggaggtgctggaggaggtgaaggtgaccaaggagatgaagaggaagatcctgctggatgtggcccggaccagcctgcagaccaaggtgcacgccgagctggctgatgtgctgacagaggtggtggtggacagcgtgctggccgtgcggcggcccggctaccccatcgacctcttcatggtggagatcatggagatgaagcacaagctgggcacagacaccaaggaggtgaacagcggcttcttctacaagacagctgaggagaaggagaagctggtgaaggccgagaggaagttcattgaagatagagtgcagaagatcatcgacctgaaggacaaggtgtgtgcccagagcaacaagggctttgtggtgatcaaccagaagggcatcgaccccttcagcctggacagcctggccaagcatggaattgtggccctgcggcgggccaagagaagaaacatggagcggctgagcctggcctgtggcggcatggctgtgaacagctttgaggacctgactgtggactgcctgggccacgccggcctggtgtatgagtacaccctgggggaggagaagttcaccttcatcgaggagtgtgtgaacccctgcagcgtgaccctgctggtgaagggccccaacaagcacaccctgacccaggtgaaggatgccatcagagatggcctgcgggccatcaagaatgccattgaagatggctgcatggtgcctggggccggggccatcgaggtggccatggccgaggccctggtgacctacaagaacagcatcaagggccgggcccggctgggcgtgcaggcctttgctgatgccctgctgatcatccccaaggtgctggcccagaatgccggctatgacccccaggagaccctggtgaaggtgcaggccgagcacgtggagagcaagcagctggtgggcgtggacctgaacacaggagagcccatggtggccgcagatgctggggtgtgggacaactactgtgtgaagaagcagctgctgcacagctgcaccgtcatcgccaccaacatcctgctggtggatgagatcatgagagctggcatgagcagcctgaagtag

SEQ ID NO: 147156 - DNA, 1458 bp, Artificial Sequence
  Description of Artificial Sequence: Synthetic coding sequence
atggccgccatcaaggctgtgaacagcaaggccgaggtggcccgggcccgggccgccctggccgtgaacatctgtgccgcccggggcctgcaggatgtgctgcggaccaacctgggccccaagggcaccatgaagatgctggtgtctggagctggggacatcaagctgaccaaggatggaaatgtgctgctggatgagatgggcctgcacccccgcatcatcgccgagggctttgaggccgccaagatcaaggccctggaggtgctggaggaggtgaaggtgaccaaggagatgaagaggaagatcctgctggatgtggcccggaccagcctgcagaccaaggtgcatgctgagctggctgatgtgctgacagaggtggtggtggacagcgtgctggccgtgagaagacctggctaccccatcgacctcttcatggtggagatcatggagatgaagcacaagctgggcacagacaccaagctgatccagggcctggtgctggaccatggagcccggcacccagacatgaagaagagggtggaggatgccttcatcctgatctgcaatgtgtccctggagtatgagaagacagaggtgaacagcggcttcttctacaagacagctgaggagaaggagaagctggtgaaggccgagaggaagttcattgaagatagagtgcagaagatcatcgacctgaaggacaaggtgtgtgcccagagcaacaagggctttgtggtgatcaaccagaagggcatcgaccccttcagcctggacagcctggccaagcatggaattgtggccctgcggcgggccaagagaagaaacatggagcggctgagcctggcctgtggcggcatggctgtgaacagctttgaggacctgactgtggactgcctgggccacgccggcctggtgtatgagtacaccctgggggaggagaagttcaccttcatcgaggagtgtgtgaacccctgcagcgtgaccctgctggtgaagggccccaacaagcacaccctgacccaggtgaaggatgccatcagagatggcctgcgggccatcaagaatgccattgaagatggctgcatggtgcctggggccggggccatcgaggtggccatggccgaggccctggtgacctacaagaacagcatcaagggccgggcccggctgggcgtgcaggcctttgctgatgccctgctgatcatccccaaggtgctggcccagaatgccggctatgacccccaggagaccctggtgaaggtgcaggccgagcacgtggagagcaagcagctggtgggcgtggacctgaacacaggagagcccatggtggccgcagatgctggggtgtgggacaactactgtgtgaagaagcagctgctgcacagctgcaccgtcatcgccaccaacatcctgctggtggatgagatcatgagagctggcatgagcagcctgaagtag

SEQ ID NO: 147157 - DNA, 966 bp, Artificial Sequence
  Description of Artificial Sequence: Synthetic coding sequence
atgaagccaggcttcagcccccggggcggcggctttggaggccggggcggctttggagaccggggcggccggggcggccggggcggctttggaggcggccggggccggggcggcggcttccggggccggggccggggcggcggcggcggcggcggcggcggcggcggcggcggccggggcggcggcggcttccacagcggcggcaacagaggccggggccggggcggcaagaggggcaaccagagcggcaagaatgtgatggtggagccccacagacatgaaggagtcttcatctgccggggcaaggaggatgccctggtgaccaagaacctggtgcctggagagagcgtgtatggagagaagagggtgtccatcagtgaaggagatgacaagattgagtaccgggcctggaaccccttccgcagcaagctggccgccgccatcctgggcggcgtggaccagatccacatcaagccaggggccaaggtgctgtacctgggcgccgccagcggcaccaccgtgagccacgtgtctgacatcgtgggcccagatggcctggtgtatgctgtggagttcagccacaggagcggccgggacctgatcaacctggccaagaagaggaccaacatcatccctgtgattgaagatgcccggcacccccacaagtacaggatgctgattgccatggtggatgtgatctttgctgatgtggcccagcctgaccagaccagaattgtggccctgaatgcccacaccttcctgagaaatggaggccacttcgtcatcagcatcaaggccaactgcatcgacagcacagccagcgctgaggccgtgtttgccagcgaggtgaagaagatgcagcaggagaacatgaagccccaggagcagctgaccctggagccctatgaaagagaccatgctgtggtggtgggcgtgtacagacctccacccaaggtgaagaactag

SEQ ID NO: 147158 - DNA, 723 bp, Artificial Sequence
  Description of Artificial Sequence: Synthetic coding sequence
atggatgtgcacggggaggccgccggggaggccggccaggagggcggggagggcctgcagggcggggccggccagagcgaggagggccccagcgctgagaagtgccgggtgtgcccctgtgtgtgccgggagcggcacccccaggaggagcggcgctgtgagctggccagtgatggagtgcccaggagaagaagtggcctgcagggcgctgacagctgtgactatgaaggaggagaccaggagtatggccctggggaccagagccctggccagggccctgagcaccacggccctgctgagggcctgctgagtgatggccaggtgcgggctgctggagctgagcccggccggccctacatcggagatggcggcctgcacgagctgggccaccacccagaccatgctgctggggccggcggccagccccaccacgccgacagaagaggagagtggccaggaggagctggccctgcccagcctgctgcccggggccgcctgtgccggggccgggagctgtgtgcccagcccggcggccctgctgtgacagaggtgggccgcctggaggagctggccgtgccccggcgctgtgccccacccctgcccagagatgtgctggagggcagctgccccctgcccacagccagctgcctgtgtgccgaccctgctggcctgcggcctgctgccaccctgcggctgagccctgcccggcctgcctggccctag

SEQ ID NO: 147159 - DNA, 591 bp, Artificial Sequence
  Description of Artificial Sequence: Synthetic coding sequence
atggatgacaccctcttccagctgaagttcaccgccaagcagctggagaagctggccaagaaggccgagaaggacagcaaggccgagcaggccaaggtgaagaaggccctgctgcagaagaatgtggagtgtgcccgggtgtatgcagaaaatgccatcaggaagaagaatgaaggagtgaactggctgaggatggccagccgggtggatgctgtggccagcaaggtgcagacagctgtgaccatgaagggcgtgaccaagaacatggcccaggtgaccaaggccctggacaaggccctgagcaccatggacctgcagaaggtgtcctctgtgatggacagatttgagcagcaggtgcagaacctggatgtgcacacctctgtgatggaggacagcatgagcagcgccaccaccctgaccaccccccaggagcaggtggacagcctcatcatgcagattgctgaggagaatggcctggaggtgctggaccagctgagccagctgcctgagggcgccagcgctgtgggggagagctctgtgcgcagccaggaggaccagctgagccggcggctggccgccctgagaaattag

SEQ ID NO: 147160 - DNA, 600 bp, Artificial Sequence
  Description of Artificial Sequence: Synthetic coding sequence
atgagcaacatggagaagcacctgttcaacctgaagtttgctgccaaggagctgagccgcagcgccaagaagtgtgacaaggaggagaaggccgagaaggccaagatcaagaaggccatccagaagggcaacatggaggtggcccgcatccacgcagaaaatgccatccggcagaagaaccaggccgtgaacttcctgaggatgtctgcccgggtggatgctgtggccgcccgggtgcagacagctgtgaccatgggcaaggtgaccaagtccatggccggcgtggtgaagtccatggatgccaccctgaagaccatgaacctggagaagatcagcgccctgatggacaagtttgagcaccagtttgagaccctggatgtgcagacccagcagatggaggacaccatgagcagcaccaccaccctgaccaccccccagaaccaggtggacatgctgctgcaggagatggctgatgaggccggcctggacctgaacatggagctgccccagggccagacaggctctgtgggcacctctgtggccagcgctgagcaggatgagctgagccagaggctggcccggctgcgggaccaggtgtag

SEQ ID NO: 147161 - DNA, 669 bp, Artificial Sequence
  Description of Artificial Sequence: Synthetic coding sequence
atggacctgctgtttggaagaaggaagaccccagaggagctgctgcggcagaaccagagggccctgaacagagccatgagggagctggaccgggagcggcagaagctggagacccaggagaagaagatcatcgctgacatcaagaagatggccaagcagggccagatggatgctgtgcgcatcatggccaaggacctggtgaggacccggcgctacgtgaggaagtttgtgctgatgagggccaacatccaggccgtgtccctgaagatccagaccctgaagagcaacaacagcatggcccaggccatgaagggcgtgaccaaggccatgggcaccatgaaccggcagctgaagctgccccagatccagaagatcatgatggagtttgagcggcaggccgagatcatggacatgaaggaggagatgatgaatgatgccattgatgatgccatgggagatgaagaagatgaggaggagagtgatgctgtggtgtcccaggtgctggatgagctgggcctgagcctgacagatgagctgagcaacctgcccagcactggaggcagcctgtctgtggccgccggcggcaagaaggccgaggccgccgccagcgccctggctgatgctgatgctgacctggaggagcggctgaagaacctgcggcgggactag

SEQ ID NO: 147162 - DNA, 669 bp, Artificial Sequence; identical to SEQ ID NO: 147161
  Description of Artificial Sequence: Synthetic coding sequence

SEQ ID NO: 147163 - DNA, 642 bp, Artificial Sequence
  Description of Artificial Sequence: Synthetic coding sequence
atggccagcctcttcaagaagaagacagtggatgatgtgatcaaggagcagaaccgggagctgcggggcacccagagggccatcatccgggacagagctgccctggagaagcaggagaagcagctggagctggagatcaagaagatggccaagattggcaacaaggaggcctgcaaggtgctggccaagcagctggtgcacctgaggaagcagaagaccaggacctttgctgtgagcagcaaggtgacctccatgagcacccagaccaaggtgatgaacagccagatgaagatggccggggccatgagcaccacagccaagaccatgcaggccgtgaacaagaagatggacccccagaagaccctgcagaccatgcagaacttccagaaggagaacatgaagatggagatgacagaggagatgatcaatgacaccctggatgacatctttgatggcagtgatgatgaggaggagagccaggacatcgtgaaccaggtgctggatgagatcggcatcgagatcagcggcaagatggccaaggcccccagcgctgcccggagcctgcccagcgccagcaccagcaaggccaccatcagtgatgaggagattgagcggcagctgaaggccctgggcgtggactag

SEQ ID NO: 147164 - DNA, 519 bp, Artificial Sequence
  Description of Artificial Sequence: Synthetic coding sequence
atggagctggagatcaagaagatggccaagattggcaacaaggaggcctgcaaggtgctggccaagcagctggtgcacctgaggaagcagaagaccaggacctttgctgtgagcagcaaggtgacctccatgagcacccagaccaaggtgatgaacagccagatgaagatggccggggccatgagcaccacagccaagaccatgcaggccgtgaacaagaagatggacccccagaagaccctgcagaccatgcagaacttccagaaggagaacatgaagatggagatgacagaggagatgatcaatgacaccctggatgacatctttgatggcagtgatgatgaggaggagagccaggacatcgtgaaccaggtgctggatgaaattggaattgagatcagcggcaagatggccaaggcccccagcgctgcccggagcctgcccagcgccagcaccagcaaggccaccatcagtgatgaggagattgaaaggcagctgaaggccctgggcgtggactag

SEQ ID NO: 147165 - DNA, 669 bp, Artificial Sequence
  Description of Artificial Sequence: Synthetic coding sequence
atgggcctgtttgggaagacccaggagaagccacccaaggagctggtgaatgagtggagcctgaagatcaggaaggagatgagggtggtggaccggcagatccgggacatccagcgggaggaggagaaggtgaagaggtctgtgaaggatgctgccaagaagggccagaaggatgtgtgcatcgtgctggccaaggagatgatccgcagcaggaaggctgtgtccaagctgtatgccagcaaggcccacatgaacagcgtgctgatgggcatgaagaaccagctggccgtgctgcgggtggccggcagcctgcagaagagcacagaggtgatgaaggccatgcagagcctggtgaagatccctgagatccaggccaccatgagggagctgagcaaggagatgatgaaggccggcatcatcgaggagatgctggaggacacctttgagagcatggatgaccaggaggagatggaggaggaggccgagatggagattgaccgcatcctgtttgagatcacagctggggccctgggcaaggcccccagcaaggtgacagatgccctgcctgagcctgagcccccaggggccatggccgcctctgaagatgaggaggaggaggaggaggccctggaggccatgcagagccggctggccaccctgcggagctag

SEQ ID NO: 147166 - DNA, 471 bp, Artificial Sequence
  Description of Artificial Sequence: Synthetic coding sequence
atgatccgcagcaggaaggctgtgtccaagctgtatgccagcaaggcccacatgaacagcgtgctgatgggcatgaagaaccagctggccgtgctgcgggtggccggcagcctgcagaagagcacagaggtgatgaaggccatgcagagcctggtgaagatccctgagatccaggccaccatgagggagctgagcaaggagatgatgaaggccggcatcatcgaggagatgctggaggacacctttgagagcatggatgaccaggaggagatggaggaggaggccgagatggagattgaccgcatcctgtttgagatcacagctggggccctgggcaaggcccccagcaaggtgacagatgccctgcctgagcctgagcccccaggggccatggccgcctctgaagatgaggaggaggaggaggaggccctggaggccatgcagagccggctggccaccctgcggagctag

SEQ ID NO: 147167 - DNA, 756 bp, Artificial Sequence
  Description of Artificial Sequence: Synthetic coding sequence
atggagggggagctgtacagcgccctgaaggaggaggaggccagcgagagcgtgagcagcaccaacttcagcggggagatgcacttctatgagctggtggaggacaccaaggatggcatctggctggtgcaggtgaatgagtggagcctgaagatcaggaaggagatgagggtggtggaccggcagatccgggacatccagcgggaggaggagaaggtgaagaggtctgtgaaggatgctgccaagaagggccagaaggatgtgtgcatcgtgctggccaaggagatgatccgcagcaggaaggctgtgtccaagctgtatgccagcaaggcccacatgaacagcgtgctgatgggcatgaagaaccagctggccgtgctgcgggtggccggcagcctgcagaagagcacagaggtgatgaaggccatgcagagcctggtgaagatccctgagatccaggccaccatgagggagctgagcaaggagatgatgaaggccggcatcatcgaggagatgctggaggacacctttgagagcatggatgaccaggaggagatggaggaggaggccgagatggagattgaccgcatcctgtttgagatcacagctggggccctgggcaaggcccccagcaaggtgacagatgccctgcctgagcctgagcccccaggggccatggccgcctctgaagatgaggaggaggaggaggaggccctggaggccatgcagagccggctggccaccctgcggagctag

SEQ ID NO: 147168 - DNA, 549 bp, Artificial Sequence
  Description of Artificial Sequence: Synthetic coding sequence
atgggcctgtttgggaagacccaggagaagccacccaaggagctggtgaatgagtggagcctgaagatcaggaaggagatgagggtggtggaccggcagatccgggacatccagcgggaggaggagaaggtgaagaggtctgtgaaggatgctgccaagaagggccagaaggatgtgtgcatcgtgctggccaaggagatgatccgcagcaggaaggccatgcagagcctggtgaagatccctgagatccaggccaccatgagggagctgagcaaggagatgatgaaggccggcatcatcgaggagatgctggaggacacctttgagagcatggatgaccaggaggagatggaggaggaggccgagatggagattgaccgcatcctgtttgagatcacagctggggccctgggcaaggcccccagcaaggtgacagatgccctgcctgagcctgagcccccaggggccatggccgcctctgaagatgaggaggaggaggaggaggccctggaggccatgcagagccggctggccaccctgcggagctag

SEQ ID NO: 147169 - DNA, 798 bp, Artificial Sequence
  Description of Artificial Sequence: Synthetic coding sequence
atgagcagaagaagaccagaagatggcctgggcaaggccggcccctgtgtgatgaggcaccacccccccaggagcaaggccgaggtgtggaggaccctgcggggcggcggcggccgcggggagctggccatgagcggcctgggccgcctgtttgggaagggcaagaaggagaagggccccaccccagaggaggccatccagaagctgaaggagacagagaagatcctgatcaagaagcaggagttcctggagcagaagatccagcaggagctgcagacagccaagaagtatggcaccaagaacaagagagctgccctgcaggccctgcggaggaagaagagatttgagcagcagctggcccagacagatggcaccctgagcaccctggagttccagcgggaggccattgaaaatgccaccaccaatgctgaggtgctgcggaccatggagctggccgcccagagcatgaagaaggcctaccaggacatggacatcgacaaggtggatgagctgatgacagacatcacagagcagcaggaggtggcccagcagatcagtgatgccatcagccggcccatgggctttggagatgatgtggatgaagatgagctgctggaggagctggaggagctggagcaggaggagctggcccaggagctgctgaatgtgggggacaaggaggaggagcccagcgtgaagctgcccagcgtgcccagcacccacctgcctgctggccctgcccccaaggtggatgaagatgaggaggccctgaagcagctggccgagtgggtgtcctag

SEQ ID NO: 147170 - DNA, 378 bp, Artificial Sequence
  Description of Artificial Sequence: Synthetic coding sequence
atggccggccccagcctggcctgctgcctgctgggcctgctggccctgaccagcgcctgctacatccagaactgccccctgggcggcaagagagctgccccagacctggatgtgaggaagtgcctgccctgtggccctgggggcaagggccgctgcttcggccccaacatctgctgtgccgaggagctgggctgctttgtgggcacagctgaggccctgcgctgccaggaggagaactacctgcccagcccctgccagagcggccagaaggcctgtggcagcggcggccgctgtgctgtgctgggcctgtgctgcagcccagatggctgccacgccgaccctgcctgtgatgctgaggccaccttcagccagaggtag

SEQ ID NO: 147171 - DNA, 831 bp, Artificial Sequence
  Description of Artificial Sequence: Synthetic coding sequence
atggcccctcctccagcccccctgctggcccccaggcctggagagacccggcccggctgcaggaagccaggcaccgtgtcctttgctgatgtggccgtgtacttcagccctgaggagtggggctgcctgcggcctgcccagagggccctgtacagagatgtgatgcaggagacctacggccacctgggcgccctgggcttccctggccccaagccagccctgatctcctggatggagcaggagagcgaggcctggagccctgctgcccaggaccctgagaagggggagcggctgggcggggccaggagaggagatgtgcccaacaggaaggaggaggagcctgaggaggtgccccgggccaagggccccaggaaggcccctgtgaaggagagccctgaggtgctggtggagaggaacccagaccctgccatctctgtggccccagcccgggcccagccccccaagaatgctgcctgggaccccaccactggagcccagcccccagcccccatccccagcatggatgcccaggccggccagaggagacatgtgtgcacagactgtggccgccgcttcacctaccccagcctgctggtgagccacaggaggatgcacagcggggagcggcccttcccctgcccagaatgtggcatgaggttcaagaggaagtttgctgtggaggcccaccagtggatccacaggagctgcagcggcggccggcggggcagaagacctggcatccgggctgtgccccgggcccctgtgcggggggaccgggacccccctgtgctcttccgccactacccagacatctttgaggagtgtggctag

SEQ ID NO: 147172 - DNA, 516 bp, Artificial Sequence
  Description of Artificial Sequence: Synthetic coding sequence
atgaaccggctgtttgggaaggccaagcccaaggcccccccacccagcctgacagactgcattggaacagtggacagcagagctgagagcattgacaagaagatcagccggctggatgctgagctggtgaagtacaaggaccagatcaagaagatgagggagggccctgccaagaacatggtgaagcagaaggccctgcgggtgctgaagcagaagaggatgtatgagcagcagagggacaacctggcccagcagagcttcaacatggagcaggccaactacaccatccagagcctgaaggacaccaagaccaccgtggatgccatgaagctgggcgtgaaggagatgaagaaggcctacaagcaggtgaagattgaccagatcgaggacctgcaggaccagctggaggacatgatggaggatgccaatgagatccaggaggccctgagccgctcctatggcaccccagagctggatgaagatgacctggaggccggctggagcagcggcggctag

SEQ ID NO: 147173 - DNA, 606 bp, Artificial Sequence
  Description of Artificial Sequence: Synthetic coding sequence
atgggcaacctgtttggaaggaagaagcagagccgggtgacagagcaggacaaggccatcctgcagctgaagcagcagagggacaagctgcggcagtaccagaagagaattgcccagcagctggagcgggagcgggccctggcccggcagctgctgagagatggcaggaaggagcgggccaagctgctgctgaagaagaagcgctaccaggagcagctgctggacagaacagagaaccagatcagcagcctggaggccatggtgcagagcattgagttcacccagatcgagatgaaggtgatggagggcctgcagtttggaaatgaatgtctgaacaagatgcaccaggtgatgagcattgaggaggtggagcgcatcctggatgagacccaggaggccgtggagtaccagaggcagattgatgagctgctggccggcagcttcacccaggaggatgaagatgccatcctggaggagctgagcgccatcacccaggagcagatcgagctgcctgaggtgcccagcgagcccctgcctgagaagatcccagaaaatgtgcctgtgaaggcccggccccggcaggccgagctggtggccgccagctag

SEQ ID NO: 147174 - DNA, 1362 bp, Artificial Sequence
  Description of Artificial Sequence: Synthetic coding sequence
atgtggagccctgagcgggaggccgaggccccagctggaggagaccctgctggcctgctgcccccagagtgggaggaggatgaggagaggatgtccttcctgttcagcgccttcaagaggagccgggaggtgaacagcacagactgggacagcaagatgggcttctgggcccccctggtgctgagccacagccggcggcagggcgtggtgcggctgcggctgcgggacctgcaggaggccttccagaggaagggctctgtgcccctgggcctggccaccgtgctgcaggacctgctgcggcggggggagctgcagcgggagagtgacttcatggcctctgtggacagctcctggatctcctggggcgtgggcgtcttcctgctgaagcccctgaagtggaccctgagcaacatgctgggggacaacaaggtgcctgctgaggaggtgctggtggccgtggagctgctgaaggagaaggccgaggaggtgtaccgcctgtaccagaacagccccctgagcagccaccctgtggtggccctgtctgagctgagcaccctgtgtgccaacagctgcccagatgagaggaccttctacctggtgctgctgcagctgcagaaggagaagagggtgacagtgctggagcagaatggagagaagatcgtgaagtttgcccggggcccccgggccaaggtgtcccctgtgaatgatgtggatgtgggcgtgtaccagctgatgcagagcgagcagctgctgagcaggaaggtggagagcctgagccaggaggccgagcgctgcaaggaggaggcccggcgggcctgcagagctgggaagaagcagctggccctgcggagcctgaaggccaagcagaggacagagaagagaattgaggccctgcacgccaagctggacacagtgcagggcatcctggaccgcatctatgccagccagacagaccagatggtgttcaatgcctaccaggccggcgtgggcgccctgaagctgtccatgaaggatgtgacagtggagaaggccgagagcctggtggaccagatccaggagctgtgtgacacccaggatgaggtgtcccagaccctggccggcggcgtgaccaacggcctggactttgattctgaggagctggagaaggagctggacatcctgctgcaggacaccaccaaggagcccctggacctgcctgacaaccccaggaacagacacttcaccaacagcgtgcccaacccccgcatcagtgatgctgagctggaggccgagctggagaagctgagcctgtctgagggcggcctggtgcccagcagcaagagccccaagaggcagctggagcccaccctgaagcccctgtag

SEQ ID NO: 147175 - DNA, 1362 bp, Artificial Sequence; identical to SEQ ID NO: 147174
  Description of Artificial Sequence: Synthetic coding sequence

SEQ ID NO: 147176 - DNA, 1992 bp, Artificial Sequence
  Description of Artificial Sequence: Synthetic coding sequence
atggagaggcctgaggagggcaagcagagccccccaccccagccctggggccgcctgctgcggctgggcgctgaggagggggagccccacgtgctgctgaggaagcgggagtggaccatcggcagaagaagaggctgtgacctgtccttccccagcaacaagctggtgtctggggaccactgcagaattgtggtggatgagaagagcggccaggtgaccctggaggacaccagcaccagcggcaccgtcatcaacaagctgaaggtggtgaagaagcagacctgccccctgcagacaggagatgtgatctacctggtgtacaggaagaatgaacctgagcacaacgtggcctacctgtatgagagcctgtctgagaagcagggcatgacccaggagagctttgaggccaacaaggaaaatgtgttccacggcaccaaggacaccagcggggccggggccggcagaggagctgacccccgggtgccccccagcagccctgccacccaggtgtgctttgaggagccccagcccagcaccagcaccagtgacctcttccccacagccagcgccagcagcacagagcccagccctgctggccgggagaggagcagcagctgtggcagcggcggcggcggcatcagccccaagggcagcggccccagcgtggccagtgatgaggtgtcctcctttgccagcgccctgcctgacaggaagacagccagcttcagcagcctggagccccaggaccaggaggacctggagcctgtgaagaagaagatgagaggagatggagacctggacctgaatggccagctgctggtggcccagcccaggagaaatgcccagacagtgcatgaagatgtgcgggctgctgctgggaagccagacaagatggaggagaccctgacctgcatcatctgccaggacctgctgcatgactgtgtgtccctgcagccctgcatgcacaccttctgtgccgcctgctacagcggctggatggagaggagcagcctgtgccccacctgccgctgccctgtggagcgcatctgcaagaaccacatcctgaacaacctggtggaggcctacctgatccagcaccctggcaacagccgctctgaggaggatgtgcagagcatggatgccaggaacaagatcacccaggacatgctgcagcccaaggtgagaagaagcttcagtgatgaggagggcagcagcgaggacctgctggagctgagtgatgtggacagcgagagcagtgacatcagccagccctacgtggtgtgccggcagtgcccagagtaccgccggcaggccgcccagcccccccactgcccagcccctgagggggagcccggggccccccaggccctgggagatgcccccagcacctctgtgtccctgaccaccgtgcaggactatgtgtgccccctgcagggcagccacgccctgtgcacctgctgcttccagcccatgccagaccggcgggcagagcgggagcaggacccccgggtggccccccagcagtgtgctgtgtgcctgcagcccttctgccacctgtactggggctgcaccaggacaggctgctacggctgcctggcccccttctgtgagctgaacctgggggacaagtgcctggatggagtgctgaacaacaacagctatgaaagtgacatcctgaagaactacctggccacccggggcctgacctggaagaacatgctgacagagagcctggtggccctgcagaggggcgtcttcctgctgagtgactacagagtgactggagacacagtgctgtgctactgctgcggcctgcgctccttccgggagctgacctaccagtaccggcagaacatcccagccagcgagctgcctgtggccgtgaccagcaggccagactgctactggggcaggaactgcaggacccaggtgaaggcccaccacgccatgaagttcaaccacatctgtgagcagacccgcttcaagaactag

SEQ ID NO: 147177 - DNA, 1872 bp, Artificial Sequence
  Description of Artificial Sequence: Synthetic coding sequence
atggagaggcctgaggagggcaagcagagccccccaccccagccctggggccgcctgctgcggctgggcgctgaggagggggagccccacgtgctgctgaggaagcgggagtggaccatcggcagaagaagaggctgtgacctgtccttccccagcaacaagctggtgtctggggaccactgcagaattgtggtggatgagaagagcggccaggtgaccctggaggacaccagcaccagcggcaccgtcatcaacaagctgaaggtggtgaagaagcagacctgccccctgcagacaggagatgtgatctacctggtgtacaggaagaatgaacctgagcacaacgtggcctacctgtatgagagcctgtctgagaagcagggcatgacccaggagagctttgagatggtgccctgctgcgtggcccaggccggcctgaagctgctgggcagcagtgacccccccaccctggccagccagagcatcgtcatcactggaagtggcggcggcggcatcagccccaagggcagcggccccagcgtggccagtgatgaggtgagcagctttgccagcgccctgcctgacaggaagacagccagcttcagcagcctggagccccaggaccaggaggacctggagcctgtgaagaagaagatgagaggagatggagacctggacctgaatggccagctgctggtggcccagcccaggagaaatgcccagacagtgcatgaagatgtgcgggctgctgctgggaagccagacaagatggaggagaccctgacctgcatcatctgccaggacctgctgcatgactgtgtgtccctgcagccctgcatgcacaccttctgtgccgcctgctacagcggctggatggagaggagcagcctgtgccccacctgccgctgccctgtggagcgcatctgcaagaaccacatcctgaacaacctggtggaggcctacctgatccagcacccagacaagagccgctcagaagaagatgtgcagagcatggatgccaggaacaagatcacccaggacatgctgcagcccaaggtgcggcgctccttcagtgatgaggagggcagcagcgaggacctgctggagctgagtgatgtggacagcgagagcagtgacatcagccagccctacgtggtgtgccggcagtgcccagagtaccgccggcaggccgcccagcccccccactgcccagcccctgagggggagcccggggccccccaggccctgggagatgcccccagcacctctgtgtccctgaccacagctgtgcaggactatgtgtgccccctgcagggcagccacgccctgtgcacctgctgcttccagcccatgccagaccggcgggcagagcgggagcaggacccccgggtggccccccagcagtgtgctgtgtgcctgcagcccttctgccacctgtactggggctgcaccaggacaggctgctacggctgcctggcccccttctgtgagctgaacctgggggacaagtgcctggatggagtgctgaacaacaacagctatgaaagtgacatcctgaagaactacctggccacccggggcctgacctggaagaacatgctgacagagagcctggtggccctgcagaggggcgtcttcctgctgagtgactacagagtgactggagacacagtgctgtgctactgctgcggcctgcgctccttccgggagctgacctaccagtaccggcagaacatcccagccagcgagctgcctgtggccgtgaccagcaggccagactgctactggggcaggaactgcaggacccaggtgaaggcccaccacgccatgaagttcaaccacatctgtgagcagacccgcttcaagaactag

SEQ ID NO: 147178 - DNA, 1995 bp, Artificial Sequence
  Description of Artificial Sequence: Synthetic coding sequence
atggagaggcctgaggagggcaagcagagccccccaccccagccctggggccgcctgctgcggctgggcgctgaggagggggagccccacgtgctgctgaggaagcgggagtggaccatcggcagaagaagaggctgtgacctgtccttccccagcaacaagctggtgtctggggaccactgcagaattgtggtggatgagaagagcggccaggtgaccctggaggacaccagcaccagcggcaccgtcatcaacaagctgaaggtggtgaagaagcagacctgccccctgcagacaggagatgtgatctacctggtgtacaggaagaatgaacctgagcacaacgtggcctacctgtatgagagcctgtctgagaagcagggcatgacccaggagagctttgaggccaacaaggaaaatgtgttccacggcaccaaggacaccagcggggccggggccggcagaggagctgacccccgggtgccccccagcagccctgccacccaggtgtgctttgaggagccccagcccagcaccagcaccagtgacctcttccccacagccagcgccagcagcacagagcccagccctgctggccgggagaggagcagcagctgtggcagcggcggcggcggcatcagccccaagggcagcggccccagcgtggccagtgatgaggtgtcctcctttgccagcgccctgcctgacaggaagacagccagcttcagcagcctggagccccaggaccaggaggacctggagcctgtgaagaagaagatgagaggagatggagacctggacctgaatggccagctgctggtggcccagcccaggagaaatgcccagacagtgcatgaagatgtgcgggctgctgctgggaagccagacaagatggaggagaccctgacctgcatcatctgccaggacctgctgcatgactgtgtgtccctgcagccctgcatgcacaccttctgtgccgcctgctacagcggctggatggagaggagcagcctgtgccccacctgccgctgccctgtggagcgcatctgcaagaaccacatcctgaacaacctggtggaggcctacctgatccagcacccagacaagagccgctctgaggaggatgtgcagagcatggatgccaggaacaagatcacccaggacatgctgcagcccaaggtgagaagaagcttcagtgatgaggagggcagcagcgaggacctgctggagctgagtgatgtggacagcgagagcagtgacatcagccagccctacgtggtgtgccggcagtgcccagagtaccgccggcaggccgcccagcccccccactgcccagcccctgagggggagcccggggccccccaggccctgggagatgcccccagcacctctgtgtccctgaccacagctgtgcaggactatgtgtgccccctgcagggcagccacgccctgtgcacctgctgcttccagcccatgccagacagaagagctgagcgggagcaggacccccgggtggccccccagcagtgtgctgtgtgcctgcagcccttctgccacctgtactggggctgcaccaggacaggctgctacggctgcctggcccccttctgtgagctgaacctgggggacaagtgcctggatggagtgctgaacaacaacagctatgaaagtgacatcctgaagaactacctggccacccggggcctgacctggaagaacatgctgacagagagcctggtggccctgcagaggggcgtcttcctgctgagtgactacagagtgactggagacacagtgctgtgctactgctgcggcctgcggagcttccgggagctgacctaccagtaccggcagaacatcccagccagcgagctgcctgtggccgtgaccagcaggccagactgctactggggcaggaactgcaggacccaggtgaaggcccaccacgccatgaagttcaaccacatctgtgagcagacccgcttcaagaactag

SEQ ID NO: 147179 - DNA, 1959 bp, Artificial Sequence
  Description of Artificial Sequence: Synthetic coding sequence
atggagaggcctgaggagggcaagcagagccccccaccccagccctggggccgcctgctgcggctgggcgctgaggagggggagccccacgtgctgctgaggaagcgggagtggaccatcggcagaagaagaggctgtgacctgtccttccccagcaacaagctggtgtctggggaccactgcagaattgtggtggatgagaagagcggccaggtgaccctggaggacaccagcaccagcggcaccgtcatcaacaagctgaaggtggtgaagaagcagacctgccccctgcagacaggagatgtgatctacctggtgtacaggaagaatgaacctgagcacaacgtggcctacctgtatgagagcctgtctgagaagcagggcatgacccaggagagctttgacaccagcggggccggggccggcagaggagctgacccccgggtgccccccagcagccctgccacccaggtgtgctttgaggagccccagcccagcaccagcaccagtgacctcttccccacagccagcgccagcagcacagagcccagccctgctggccgggagaggagcagcagctgtggcagcggcggcggcggcatcagccccaagggcagcggccccagcgtggccagtgatgaggtgtcctcctttgccagcgccctgcctgacaggaagacagccagcttcagcagcctggagccccaggaccaggaggacctggagcctgtgaagaagaagatgagaggagatggagacctggacctgaatggccagctgctggtggcccagcccaggagaaatgcccagacagtgcatgaagatgtgcgggctgctgctgggaagccagacaagatggaggagaccctgacctgcatcatctgccaggacctgctgcatgactgtgtgtccctgcagccctgcatgcacaccttctgtgccgcctgctacagcggctggatggagaggagcagcctgtgccccacctgccgctgccctgtggagcgcatctgcaagaaccacatcctgaacaacctggtggaggcctacctgatccagcacccagacaagagccgctctgaggaggatgtgcagagcatggatgccaggaacaagatcacccaggacatgctgcagcccaaggtgagaagaagcttcagtgatgaggagggcagcagcgaggacctgctggagctgagtgatgtggacagcgagagcagtgacatcagccagccctacgtggtgtgccggcagtgcccagagtaccgccggcaggccgcccagcccccccactgcccagcccctgagggggagcccggggccccccaggccctgggagatgcccccagcacctctgtgtccctgaccacagctgtgcaggactatgtgtgccccctgcagggcagccacgccctgtgcacctgctgcttccagcccatgccagacagaagagctgagcgggagcaggacccccgggtggccccccagcagtgtgctgtgtgcctgcagcccttctgccacctgtactggggctgcaccaggacaggctgctacggctgcctggcccccttctgtgagctgaacctgggggacaagtgcctggatggagtgctgaacaacaacagctatgaaagtgacatcctgaagaactacctggccacccggggcctgacctggaagaacatgctgacagagagcctggtggccctgcagaggggcgtcttcctgctgagtgactacagagtgactggagacacagtgctgtgctactgctgcggcctgcggagcttccgggagctgacctaccagtaccggcagaacatcccagccagcgagctgcctgtggccgtgaccagcaggccagactgctactggggcaggaactgcaggacccaggtgaaggcccaccacgccatgaagttcaaccacatctgtgagcagacccgcttcaagaactag

SEQ ID NO: 147180 - DNA, 672 bp, Artificial Sequence
  Description of Artificial Sequence: Synthetic coding sequence
atggagaggcctgaggagggcaagcagagccccccaccccagccctggggccgcctgctgcggctgggcgctgaggagggggagccccacgtgctgctgaggaagcgggagtggaccatcggcagaagaagaggctgtgacctgtccttccccagcaacaagctggtgtctggggaccactgcagaattgtggtggatgagaagagcggccaggtgaccctggaggacaccagcaccagcggcaccgtcatcaacaagctgaaggtggtgaagaagcagacctgccccctgcagacaggagatgtgatctacctggtgtacaggaagaatgaacctgagcacaacgtggcctacctgtatgagagcctgtctgagaagcagggcatgacccaggagagctttgacaccagcggggccggggccggcagaggagctgacccccgggtgccccccagcagccctgccacccaggtgtgctttgaggagccccagcccagcaccagcaccagtgacctcttccccacagccagcgccagcagcacagagcccagccctgctggccgggagaggagcagcagctgtggcagcggcggcggcggcatcagccccaagggcagcggccccagcgtggccagtgatgaggtgtcctcctttgccagcgccctgccctag

SEQ ID NO: 147181 - DNA, 1050 bp, Artificial Sequence
  Description of Artificial Sequence: Synthetic coding sequence
atgacccaggagagctttggcagcggcggcggcggcatcagccccaagggcagcggccccagcgtggccagtgatgaggtgtcctcctttgccagcgccctgcctgacaggaagacagccagcttcagcagcctggagccccaggaccaggaggacctggagcctgtgaagaagaagatgagaggagatggagacctggacctgaatggccagctgctggtggcccagcccaggagaaatgcccagacagtgcatgaagatgtgcgggctgctgctgggaagccagacaagatggaggagaccctgacctgcatcatctgccaggacctgctgcatgactgtgtgtccctgcagccctgcatgcacaccttctgtgccgcctgctacagcggctggatggagaggagcagcctgtgccccacctgccgctgccctgtggagcgcatctgcaagaaccacatcctgaacaacctggtggaggcctacctgatccagcacccagacaagagccgctctgaggaggatgtgcagagcatggatgccaggaacaagatcacccaggacatgctgcagcccaaggtgagaagaagcttcagtgatgaggagggcagcagcgaggacctgctggagctgagtgatgtggacagcgagagcagtgacatcagccagccctacgtggtgtgccggcagtgcccagagtaccgccggcaggccgcccagcccccccactgcccagcccctgagggggagcccggggccccccaggccctgggagatgcccccagcacctctgtgtccctgaccacagctgtgcaggactatgtgtgccccctgcagggcagccacgccctgtgcacctgctgcttccagcccatgccagacagaagagctgagcgggagcaggacccccgggtggccccccagcagtgtgctgtgtgcctgcagcccttctgccacctgtactggggctgcaccaggacaggctgctacggctgcctggcccccttctgtgtgtctggccggcagtgcttccctgccaccagcctgtag

SEQ ID NO: 147182 - DNA, 1719 bp, Artificial Sequence
  Description of Artificial Sequence: Synthetic coding sequence
atggagaggcctgaggagggcaagcagagccccccaccccagccctggggccgcctgctgcggctgggcgctgaggagggggagccccacgtgctgctgaggaagcgggagtggaccatcggcagaagaagaggctgtgacctgtccttccccagcaacaagctggtgtctggggaccactgcagaattgtggtggatgagaagagcggccaggtgaccctggaggacaccagcaccagcggcaccgtcatcaacaagctgaaggtggtgaagaagcagacctgccccctgcagacaggagatgtgatctacctggtgtacaggaagaatgaacctgagcacaggtctgggggcggcggcatcagccccaagggcagcggccccagcgtggccagtgatgaggtgtcctcctttgccagcgccctgcctgacaggaagacagccagcttcagcagcctggagccccaggaccaggaggacctggagcctgtgaagaagaagatgagaggagatggagacctggacctgaatggccagctgctggtggcccagcccaggagaaatgcccagacagtgcatgaagatgtgcgggctgctgctgggaagccagacaagatggaggagaccctgacctgcatcatctgccaggacctgctgcatgactgtgtgtccctgcagccctgcatgcacaccttctgtgccgcctgctacagcggctggatggagaggagcagcctgtgccccacctgccgctgccctgtggagcgcatctgcaagaaccacatcctgaacaacctggtggaggcctacctgatccagcacccagacaagagccgctctgaggaggatgtgcagagcatggatgccaggaacaagatcacccaggacatgctgcagcccaaggtgagaagaagcttcagtgatgaggagggcagcagcgaggacctgctggagctgagtgatgtggacagcgagagcagtgacatcagccagccctacgtggtgtgccggcagtgcccagagtaccgccggcaggccgcccagcccccccactgcccagcccctgagggggagcccggggccccccaggccctgggagatgcccccagcacctctgtgtccctgaccacagctgtgcaggactatgtgtgccccctgcagggcagccacgccctgtgcacctgctgcttccagcccatgccagacagaagagctgagcgggagcaggacccccgggtggccccccagcagtgtgctgtgtgcctgcagcccttctgccacctgtactggggctgcaccaggacaggctgctacggctgcctggcccccttctgtgagctgaacctgggggacaagtgcctggatggagtgctgaacaacaacagctatgaaagtgacatcctgaagaactacctggccacccggggcctgacctggaagaacatgctgacagagagcctggtggccctgcagaggggcgtcttcctgctgagtgactacagagtgactggagacacagtgctgtgctactgctgcggcctgcggagcttccgggagctgacctaccagtaccggcagaacatcccagccagcgagctgcctgtggccgtgaccagcaggccagactgctactggggcaggaactgcaggacccaggtgaaggcccaccacgccatgaagttcaaccacatctgtgagcagacccgcttcaagaactag

SEQ ID NO: 147183 - DNA, 345 bp, Artificial Sequence
  Description of Artificial Sequence: Synthetic coding sequence
atgaggctgctgatcctggccctgctgggcatctgcagcctgacagcctacatcgtggagggcgtgggcagcgaggtgtctgacaagaggacctgtgtgtccctgaccacccagaggctgcctgtgagccgcatcaagacctacaccatcacagagggcagcctgcgggctgtgatcttcatcaccaagaggggcctgaaggtgtgtgccgacccccaggccacctgggtgagagatgtggtgcgctccatggacaggaagagcaacaccaggaacaacatgatccagaccaagcccaccggcacccagcagagcaccaacacagctgtgaccctgactggatag

SEQ ID NO: 147184 - DNA, 345 bp, Artificial Sequence
  Description of Artificial Sequence: Synthetic coding sequence
atgaggctgctgatcctggccctgctgggcatctgcagcctgacagcctacatcgtggagggcgtgggcagcgaggtgagccacaggaggacctgtgtgtccctgaccacccagaggctgcctgtgagccgcatcaagacctacaccatcacagagggcagcctgcgggctgtgatcttcatcaccaagaggggcctgaaggtgtgtgccgacccccaggccacctgggtgagagatgtggtgcgctccatggacaggaagagcaacaccaggaacaacatgatccagaccaagcccaccggcacccagcagagcaccaacacagctgtgaccctgactggatag

SEQ ID NO: 147185 - DNA, 1002 bp, Artificial Sequence
  Description of Artificial Sequence: Synthetic coding sequence
atggagagcagcggcaaccctgagagcaccaccttcttctactatgacctgcagagccagccctgtgagaaccaggcctgggtgtttgccaccctggccaccaccgtgctgtactgcctggtgttcctgctgagcctggtgggcaacagcctggtgctgtgggtgctggtgaagtatgagagcctggagagcctgaccaacatcttcatcctgaacctgtgcctgagtgacctggtgtttgcctgcctgctgcctgtgtggatcagcccctaccactggggctgggtgctgggggacttcctgtgcaagctgctgaacatgatcttcagcatcagcctgtacagcagcatcttcttcctgaccatcatgaccatccaccgctacctgtctgtggtgagccccctgagcaccctgcgggtgcccaccctgcgctgccgggtgctggtgaccatggctgtgtgggtggccagcatcctgagcagcatcctggacaccatcttccacaaggtgctgagcagcggctgtgactacagcgagctgacctggtacctgacctctgtgtaccagcacaacctcttcttcctgctgagcctgggcatcatcctcttctgctacgtggagatcctgcggaccctcttccgcagccgcagcaagagaagacacaggacagtgaagctgatctttgccatcgtggtggcctacttcctgtcctggggcccctacaacttcaccctcttcctgcagaccctcttccgcacccagatcatccgcagctgtgaggccaagcagcagctggagtatgccctgctgatctgcaggaacctggccttcagccactgctgcttcaaccctgtgctgtatgtgtttgtgggcgtgaagttccgcacccacctgaagcacgtgctgcggcagttctggttctgccgcctgcaggcccccagccctgccagcatcccccacagccctggggcctttgcctatgaaggagccagcttctactag

SEQ ID NO: 147186 - DNA, 111 bp, Artificial Sequence
  Description of Artificial Sequence: Synthetic coding sequence
atggagagcagcggcaaccctgagagcaccaccttcttctactatgacctgcagagccagccctgtgagaaccaggcctgggtgtttgccaccctggccaccaccgtgtag

SEQ ID NO: 147187 - DNA, 1002 bp, Artificial Sequence; identical to SEQ ID NO: 147185
  Description of Artificial Sequence: Synthetic coding sequence

SEQ ID NO: 147188 - DNA, 300 bp, Artificial Sequence
  Description of Artificial Sequence: Synthetic coding sequence
atgaaggtgtctgctgccctgctgtgcctgctgctgatggccgccaccttcagcccccagggcctggcccagccagattctgtgtccatccccatcacctgctgcttcaacgtcatcaacaggaagatccccatccagaggctggagagctacacccgcatcaccaacatccagtgccccaaggaggccgtcatcttcaagaccaagaggggcaaggaggtgtgtgccgaccccaaggagcgctgggtgcgggacagcatgaagcacctggaccagatcttccagaacctgaagccctag

SEQ ID NO: 147189 - DNA, 291 bp, Artificial Sequence
  Description of Artificial Sequence: Synthetic coding sequence
atgcagatcatcaccacagccctggtgtgcctgctgctggccggcatgtggccagaagatgtggacagcaagtccatgcaggtgcccttcagccgctgctgcttctcctttgctgagcaggagatccccctgcgggccatcctgtgctacagaaacaccagcagcatctgcagcaatgaaggcctcatcttcaagctgaagaggggcaaggaggcctgtgccctggacacagtgggctgggtgcagaggcacaggaagatgctgcggcactgccccagcaagaggaagtag

SEQ ID NO: 147190 - DNA, 282 bp, Artificial Sequence
  Description of Artificial Sequence: Synthetic coding sequence
atgaagatctctgtggccgccatccccttcttcctgctgatcaccatcgccctgggcaccaagacagagagcagcagccggggcccctaccaccccagcgagtgctgcttcacctacaccacctacaagatcccccggcagaggatcatggactactatgagaccaacagccagtgcagcaagccaggcatcgtgttcatcaccaagaggggccacagcgtgtgcaccaaccccagcgacaagtgggtgcaggactacatcaaggacatgaaggagaactag

SEQ ID NO: 147191 - DNA, 330 bp, Artificial Sequence
  Description of Artificial Sequence: Synthetic coding sequence
atgaagatctctgtggccgccatccccttcttcctgctgatcaccatcgccctgggcaccaagacagagagcagcagccagacaggaggcaagcccaaggtggtgaagatccagctgaagctggtgggcggcccctaccaccccagcgagtgctgcttcacctacaccacctacaagatcccccggcagaggatcatggactactatgagaccaacagccagtgcagcaagccaggcatcgtgttcatcaccaagaggggccacagcgtgtgcaccaaccccagcgacaagtgggtgcaggactacatcaaggacatgaaggagaactag

SEQ ID NO: 147192 - DNA, 330 bp, Artificial Sequence; identical to SEQ ID NO: 147191
  Description of Artificial Sequence: Synthetic coding sequence

SEQ ID NO: 147193 - DNA, 342 bp, Artificial Sequence
  Description of Artificial Sequence: Synthetic coding sequence
atgaaggtgtctgtggccgccctgagctgcctgatgctggtggccgtgctgggcagccaggcccagttcatcaatgatgctgagacagagctgatgatgagcaagctgcccctggagaaccctgtggtgctgaacagcttccactttgctgctgactgctgcaccagctacatcagccagagcatcccctgcagcctgatgaagagctactttgagaccagcagcgagtgcagcaagccaggagtcatcttcctgaccaagaagggccggcaggtgtgtgccaagcccagcggccctggggtgcaggactgcatgaagaagctgaagccctacagcatctag

SEQ ID NO: 147194 - DNA, 186 bp, Artificial Sequence
  Description of Artificial Sequence: Synthetic coding sequence
tgatgcaccagctacatcagccagagcatcccctgcagcctgatgaagagctactttgagaccagcagcgagtgcagcaagccaggagtcatcttcctgaccaagaagggccggcaggtgtgtgccaagcccagcggccctggggtgcaggactgcatgaagaagctgaagccctacagcatctag

SEQ ID NO: 147195 - DNA, 342 bp, Artificial Sequence; identical to SEQ ID NO: 147193
  Description of Artificial Sequence: Synthetic coding sequence

SEQ ID NO: 147196 - DNA, 342 bp, Artificial Sequence; identical to SEQ ID NO: 147193
  Description of Artificial Sequence: Synthetic coding sequence

SEQ ID NO: 147197 - DNA, 363 bp, Artificial Sequence
  Description of Artificial Sequence: Synthetic coding sequence
atgaaggtgtctgaggccgccctgagcctgctggtgctgatcctgatcatcaccagcgccagccgcagccagcccaaggtgcctgagtgggtgaacacccccagcacctgctgcctgaagtactatgagaaggtgctgccccggcggctggtggtgggctacaggaaggccctgaactgccacctgcctgccatcatctttgtgaccaagaggaaccgggaggtgtgcaccaaccccaatgatgactgggtgcaggagtacatcaaggaccccaacctgcccctgctgcccaccaggaacctgagcacagtgaagatcatcacagccaagaatggccagccccagctgctgaacagccagtag

SEQ ID NO: 147198 - DNA, 1188 bp, Artificial Sequence
  Description of Artificial Sequence: Synthetic coding sequence
atggcctggaggcacctgaagaagagggcccaggatgctgtgatcatcctgggcggcggcggcctgctgtttgccagctacctgatggccactggagatgagcgcttctacgccgagcacctgatgcccaccctgcagggcctgctggaccctgagagcgcccaccggctggccgtgcgcttcaccagcctgggcctgctgccccgggcccgcttccaggacagcgacatgctggaggtgcgggtgctgggccacaagttcaggaaccctgtgggcattgctgctggctttgacaagcacggggaggccgtggatggcctgtacaagatgggcttcggctttgtggagatcggctctgtgacccccaagccccaggagggcaacccccggcccagggtcttccggctgcctgaggaccaggccgtcatcaacagatatggcttcaacagccacggcctgtctgtggtggagcaccggctgcgggcccggcagcagaagcaggccaagctgacagaagatggcctgcccctgggcgtgaacctgggcaagaacaagacctctgtggatgctgctgaggactatgcagagggcgtgcgggtgctgggccccctggccgactacctggtggtgaatgtgagcagccccaacacagctggcctgcggagcctgcagggcaaggccgagctgcggcggctgctgaccaaggtgctgcaggagagagatggcctgcggcgggtgcacaggcctgctgtgctggtgaagatcgccccagacctgaccagccaggacaaggaggacatcgcctctgtggtgaaggagctgggcattgatggcctcatcgtgaccaacaccaccgtgtccaggcctgctggcctgcagggcgccctgcggtctgagaccggcggcctgagcggcaagcccctgcgggacctgagcacccagaccatccgggagatgtatgccctgacccagggccgggtgcccatcatcggcgtgggcggcgtgagcagcggccaggatgccctggagaagatccgggccggggccagcctggtgcagctgtacacagccctgaccttctggggcccccctgtggtgggcaaggtgaagcgggagctggaggccctgctgaaggagcagggctttggaggagtgacagatgccatcggggctgaccacagaagatag

SEQ ID NO: 147199 - DNA, 270 bp, Artificial Sequence
  Description of Artificial Sequence: Synthetic coding sequence
atgaagggcctggccgccgccctgctggtgctggtgtgcaccatggccctgtgcagctgtgcccaggtgggcaccaacaaggagctgtgctgcctggtgtacacctcctggcagatcccccagaagttcatcgtggactacagcgagaccagcccccagtgccccaagccaggagtcatcctgctgaccaagaggggccggcagatctgtgccgaccccaacaagaagtgggtgcagaagtacatcagtgacctgaagctgaatgcctag

SEQ ID NO: 147200 - DNA, 297 bp, Artificial Sequence
  Description of Artificial Sequence: Synthetic coding sequence
atggccctgctgctggccctgagcctgctggtgctgtggaccagccctgcccccaccctgagcggcaccaatgatgctgaggactgctgcctgtctgtgacccagaagcccatccctggctacatcgtgaggaacttccactacctgctgatcaaggatggctgccgggtgcctgctgtggtgttcaccaccctgcggggccggcagctgtgtgcccccccagaccagccctgggtggagcgcatcatccagaggctgcagaggaccagcgccaagatgaagagaagaagcagctag

SEQ ID NO: 147201 - DNA, 315 bp, Artificial Sequence
  Description of Artificial Sequence: Synthetic coding sequence
atggccctgctgctggccctgagcctgctggtgctgtggaccagccctgcccccaccctgagcggcaccaatgatgctgaggactgctgcctgtctgtgacccagaagcccatccctggctacatcgtgaggaacttccactacctgctgatcaaggatggctgccgggtgcctgctgtggtgttcaccaccctgcggggccggcagctgtgtgcccccccagaccagccctgggtggagcgcatcatccagaggctgcagaggaccagcgccaaggccagcctggccctgcccggccctgtgagcagcctgtag

SEQ ID NO: 147202 - DNA, 291 bp, Artificial Sequence
  Description of Artificial Sequence: Synthetic coding sequence
atgtgctgcaccaagagcctgctgctggccgccctgatgtctgtgctgctgctgcacctgtgtggggagagcgaggccgccagcaactttgactgctgcctgggctacacagaccgcatcctgcaccccaagttcatcgtgggcttcacccggcagctggccaatgaaggctgtgacatcaatgccatcatcttccacaccaagaagaagctgtctgtgtgtgccaaccccaagcagacctgggtgaagtacatcgtgcggctgctgagcaagaaggtgaagaacatgtag

SEQ ID NO: 147203 - DNA, 288 bp, Artificial Sequence
  Description of Artificial Sequence: Synthetic coding sequence
atgtgctgcaccaagagcctgctgctggccgccctgatgtctgtgctgctgctgcacctgtgtggggagagcgaggccagcaactttgactgctgcctgggctacacagaccgcatcctgcaccccaagttcatcgtgggcttcacccggcagctggccaatgaaggctgtgacatcaatgccatcatcttccacaccaagaagaagctgtctgtgtgtgccaaccccaagcagacctgggtgaagtacatcgtgcggctgctgagcaagaaggtgaagaacatgtag

SEQ ID NO: 147204 - DNA, 405 bp, Artificial Sequence
  Description of Artificial Sequence: Synthetic coding sequence
atggcccagagcctggccctgagcctgctgatcctggtgctggccttcggcatccccaggacccagggcagtgatggaggagcccaggactgctgcctgaagtacagccagaggaagatcccagccaaggtggtgcgcagctacaggaagcaggagcccagcctgggctgcagcatcccagccatcctcttcctgcccaggaagaggagccaggccgagctgtgtgccgaccccaaggagctgtgggtgcagcagctgatgcagcacctggacaagacccccagcccccagaagccagcccagggctgcaggaaggacagaggagccagcaagacaggcaagaagggcaagggcagcaagggctgcaagaggacagagaggagccagacccccaagggcccctag

SEQ ID NO: 147205 - DNA, 375 bp, Artificial Sequence
  Description of Artificial Sequence: Synthetic coding sequence
atggcccagagcctggccctgagcctgctgatcctggtgctggccttcggcatccccaggacccagggcagtgatggaggagcccaggactgctgcctgaagtacagccagaggaagatcccagccaaggtggtgcgcagctacaggaagcaggagcccagcctgggctgcagcatcccagccatcctcttcctgcccaggaagaggagccaggccgagctgtgtgccgaccccaaggagctgtgggtgcagcagctgatgcagcacctggacaagacccccagcccccagaagccagcccagggctgcaggaaggacagaggagccagcaagacaggcaagaagggcaagggcagcaagggctgcaagaggtag

SEQ ID NO: 147206 - DNA, 549 bp, Artificial Sequence
  Description of Artificial Sequence: Synthetic coding sequence
atggccgagttccccagcaaggtgtccaccaggaccagcagccctgcccagggcgctgaggcctctgtgtctgccctgcggccagacctgggctttgtgcgcagccggctgggcgccctgatgctgctgcagctggtgctgggcctgctggtgtgggccctgattgctgacaccccctaccacctgtacccagcctacggctgggtgatgtttgtggccgtgttcctgtggctggtgaccatcgtgctcttcaacctgtacctgttccagctgcacatgaagctgtacatggtgccctggcccctggtgctgatgatcttcaacatcagcgccaccgtgctgtacatcacagccttcatcgcctgcagcgctgctgtggacctgaccagcctgcggggcacccggccctacaaccagagagctgctgccagcttctttgcctgcctggtgatgattgcctacggcgtgtctgccttcttctcctaccaggcctggaggggcgtgggcagcaatgctgccaccagccagatggccggcggctacgcctag

SEQ ID NO: 147207 - DNA, 414 bp, Artificial Sequence
  Description of Artificial Sequence: Synthetic coding sequence
atgaaggtgtctgtggccgccctgagctgcctgatgctggtgacagccctgggcagccaggcccgggtgaccaaggatgctgagacagagttcatgatgagcaagctgcccctggagaaccctgtgctgctggacatgctgtggaggaggaagattggcccccagatgaccctgagccatgctgctggcttccacgccaccagcgctgactgctgcatctcctacacccccaggagcatcccctgcagcctgctggagagctactttgagaccaacagcgagtgcagcaagccaggagtcatcttcctgaccaagaagggccgccgcttctgtgccaaccccagcgacaagcaggtgcaggtgtgtgtgaggatgctgaagctggacacccgcatcaagaccaggaagaactag

SEQ ID NO: 147208 - DNA, 363 bp, Artificial Sequence
  Description of Artificial Sequence: Synthetic coding sequence
atgaaggtgtctgtggccgccctgagctgcctgatgctggtgacagccctgggcagccaggcccgggtgaccaaggatgctgagacagagttcatgatgagcaagctgcccctggagaaccctgtgctgctggaccgcttccacgccaccagcgctgactgctgcatctcctacacccccaggagcatcccctgcagcctgctggagagctactttgagaccaacagtgaatgttccaagccaggagtcatcttcctgaccaagaagggccgccgcttctgtgccaaccccagcgacaagcaggtgcaggtgtgtgtgaggatgctgaagctggacacccgcatcaagaccaggaagaactag

SEQ ID NO: 147209 - DNA, 2862 bp, Artificial Sequence
  Description of Artificial Sequence: Synthetic coding sequence
atggaggagcagggccacagcgagatggagatcatccccagcgagagccacccccacatccagctgctgaagagcaaccgggagctgctggtgacccacatccggaacacccagtgcctggtggacaacctgctgaagaatgactacttcagcgcagaagatgctgagatcgtgtgtgcctgccccacccagcctgacaaggtgaggaagatcctggacctggtgcagagcaagggggaggaggtgtctgagttcttcctgtacctgctgcagcagctggctgatgcctacgtggacctgcggccctggctgctggagatcggcttcagccccagcctgctgacccagagcaaggtggtggtgaacacagatcctgtgagccgctacacccagcagctgcggcaccacctgggccgggacagcaagtttgtgctgtgctacgcccagaaggaggagctgctgctggaggagatctacatggacaccatcatggagctggtgggcttcagcaatgaaagcctgggcagcctgaacagcctggcctgcctgctggaccacaccaccggcatcctgaatgagcagggcgagaccatcttcatcctgggagatgctggggtgggcaagtccatgctgctgcagaggctgcagagcctgtgggccaccggccgcctggatgctggggtgaagttcttcttccacttccgctgcaggatgttcagctgcttcaaggagagtgaccggctgtgcctgcaggacctgctcttcaagcactactgctacccagagcgggaccctgaggaggtgtttgccttcctgctgcgcttcccccacgtggccctcttcacctttgatggcctggatgagctgcacagcgacctggacctgagccgggtgcctgacagcagctgcccctgggagcccgcccaccccctggtgctgctggccaacctgctgagcggcaagctgctgaagggggccagcaagctgctgacagccaggacaggcatcgaggtgccccggcagttcctgaggaagaaggtgctgctgcggggcttcagccccagccacctgcgggcctatgcccggaggatgtttcctgagcgggccctgcaggaccggctgctgagccagctggaggccaaccccaacctgtgcagcctgtgcagcgtgcccctcttctgctggatcatcttccgctgcttccagcacttccgggccgcctttgagggcagcccccagctgcctgactgcaccatgaccctgacagatgtgttcctgctggtgacagaggtgcacctgaacaggatgcagcccagcagcctggtgcagaggaacaccaggagccctgtggagaccctgcatgctggccgggacaccctgtgcagcctgggccaggtggcccaccggggcatggagaagagcctgtttgtgttcacccaggaggaggtgcaggccagcggcctgcaggagcgggacatgcagctgggcttcctgcgggccctgcctgagctgggccctggaggagaccagcagagctatgagttcttccacctgaccctgcaggccttcttcaccgccttcttcctggtgctggatgacagagtgggcacccaggagctgctgcgcttcttccaggagtggatgcctcctgctggagctgccaccaccagctgctacccacccttcctgcccttccagtgcctgcagggcagcggccctgcccgggaggacctcttcaagaacaaggaccacttccagttcaccaacctcttcctgtgtggcctgctgagcaaggccaagcagaagctgctgcggcacctggtgcctgctgctgccctgcggaggaagaggaaggccctgtgggcccacctgttcagcagcctgcggggctacctgaagagcctgccccgggtgcaggtggagagcttcaaccaggtgcaggccatgcccaccttcatctggatgctgcgctgcatctatgagacccagagccagaaggtgggccagctggccgcccggggcatctgtgccaactacctgaagctgacctactgcaatgcctgcagcgctgactgcagcgccctgagctttgtgctgcaccacttccccaagaggctggccctggacctggacaacaacaacctgaatgactatggagtgcgggagctgcagccctgcttcagccggctgactgtgctgcggctgtctgtgaaccagatcacagatggcggcgtgaaggtgctgtctgaggagctgaccaagtacaagatcgtgacctacctgggcctgtacaacaaccagatcacagatgtgggcgcccgctacgtgaccaagatcctggatgagtgcaagggcctgacccacctgaagctgggcaagaacaagatcaccagcgagggcggcaagtacctggccctggccgtgaagaacagcaagagcatcagcgaggtgggcatgtggggcaaccaggtgggagatgagggcgccaaggcctttgctgaggccctgaggaaccaccccagcctgaccaccctgagcctggccagcaatggcatcagcacagagggcggcaagagcctggcccgggccctgcagcagaacaccagcctggagatcctgtggctgacccagaatgagctgaatgatgaggtggccgagagcctggccgagatgctgaaggtgaaccagaccctgaagcacctgtggctgatccagaaccagatcacagccaagggcacagcccagctggctgatgccctgcagagcaacacaggcatcacagagatctgcctgaatggaaacctgatcaagccagaggaggccaaggtgtatgaagatgagaagaggatcatctgcttctag

SEQ ID NO: 147210 - DNA, 360 bp, Artificial Sequence
  Description of Artificial Sequence: Synthetic coding sequence
atggccggcctgatgaccatcgtgaccagcctgctcttcctgggcgtgtgtgcccaccacatcatccccaccggctctgtggtgatccccagcccctgctgcatgttctttgtgtccaagagaattcctgagaacagagtggtgtcctaccagctgagcagccgcagcacctgcctgaaggccggggtcatcttcaccaccaagaagggccagcagttctgtggggaccccaagcaggagtgggtgcagcgctacatgaagaacctggatgccaagcagaagaaggccagcccccgggcccgggctgtggccgtgaagggccctgtgcagcgctacccaggcaaccagaccacctgctag

SEQ ID NO: 147211 - DNA, 450 bp, Artificial Sequence
  Description of Artificial Sequence: Synthetic coding sequence
atgaacctgtggctgctggcctgcctggtggccggcttcctgggcgcctgggccccagctgtgcacacccagggcgtgtttgaggactgctgcctggcctaccactaccccatcggctgggccgtgctgcggcgggcctggacctaccgcatccaggaggtgtctggcagctgcaacctgcctgctgccatcttctacctgcccaagaggcacaggaaggtgtgtggcaaccccaagagccgggaggtgcagagggccatgaagctgctggatgccaggaacaaggtgtttgccaagctgcaccacaacacccagaccttccagggcccccatgctgtgaagaagctgagcagcggcaacagcaagctgagcagcagcaagttcagcaaccccatcagcagcagcaagagaaatgtgtccctgctgatcagcgccaacagcggcctgtag

SEQ ID NO: 147212 - DNA, 255 bp, Artificial Sequence
  Description of Artificial Sequence: Synthetic coding sequence
atgaacctgtggctgctggcctgcctggtggccggcttcctgggcgcctgggccccagctgtgcacacccagggcgtgtttgaggactgctgcctggcctaccactaccccatcggctgggccgtgctgcggcgggcctggacctaccgcatccaggaggtgtctggcagctgcaacctgcctgctgccatccggcccagctgctgcaaggaggtggagttctggaagctgcaggtgatcatcgtgcaggtgtag

SEQ ID NO: 147213 - DNA, 453 bp, Artificial Sequence
  Description of Artificial Sequence: Synthetic coding sequence
atgaacctgtggctgctggcctgcctggtggccggcttcctgggcgcctgggccccagctgtgcacacccagggcgtgtttgaggactgctgcctggcctaccactaccccatcggctgggccgtgctgcggcgggcctggacctaccgcatccaggaggtgtctggcagctgcaacctgcctgctgccatcttctacctgcccaagaggcacaggaaggtgtgtggcaaccccaagagccgggaggtgcagagggccatgaagctgctggatgccaggaacaaggtgtttgccaagctgcaccacaacacccagaccttccaggccggcccccatgctgtgaagaagctgagcagcggcaacagcaagctgagcagcagcaagttcagcaaccccatcagcagcagcaagagaaatgtgtccctgctgatcagcgccaacagcggcctgtag

SEQ ID NO: 147214 - DNA, 285 bp, Artificial Sequence
  Description of Artificial Sequence: Synthetic coding sequence
atgatgggcctgagcctggccagcgctgtgctgctggccagcctgctgagcctgcacctgggcacagccacccggggcagtgacatcagcaagacctgctgcttccagtacagccacaagcccctgccctggacctgggtgcgctcctatgagttcaccagcaacagctgcagccagagagctgtgatcttcaccaccaagaggggcaagaaggtgtgcacccaccccaggaagaagtgggtgcagaagtacatcagcctgctgaagacccccaagcagctgtag

SEQ ID NO: 147215 - DNA, 285 bp, Artificial Sequence; identical to SEQ ID NO: 147214
  Description of Artificial Sequence: Synthetic coding sequence

SEQ ID NO: 147216 - DNA, 339 bp, Artificial Sequence
  Description of Artificial Sequence: Synthetic coding sequence
atgaagggcccccccaccttctgcagcctgctgctgctgagcctgctgctgagcccagaccccacagctgccttcctgctgccccccagcacagcctgctgcacccagctgtacaggaagcccctgagtgacaagctgctgaggaaggtgatccaggtggagctgcaggaggctgatggagactgccacctgcaggcctttgtgctgcacctggcccagaggagcatctgcatccacccccagaaccccagcctgagccagtggtttgagcaccaggagaggaagctgcacggcaccctgcccaagctgaactttggcatgctgaggaagatgggctag

SEQ ID NO: 147217 - DNA, 384 bp, Artificial Sequence
  Description of Artificial Sequence: Synthetic coding sequence
atgcagcagaggggcctggccatcgtggccctggccgtgtgtgccgccctgcacgccagcgaggccatcctgcccatcgccagcagctgctgcacagaggtgagccaccacatcagccggcggctgctggagcgggtgaacatgtgccgcatccagagagcagatggagactgtgacctggccgccgtcatcctgcacgtgaagagaagacgcatctgtgtgagcccccacaaccacacagtgaagcagtggatgaaggtgcaggccgccaagaagaatggaaaaggaaatgtgtgccacaggaagaagcaccacggcaagaggaacagcaacagagcccaccagggcaagcatgagacctacggccacaagaccccctactag

SEQ ID NO: 147218 - DNA, 384 bp, Artificial Sequence; identical to SEQ ID NO: 147217
  Description of Artificial Sequence: Synthetic coding sequence

SEQ ID NO: 147219 - DNA, 243 bp, Artificial Sequence
  Description of Artificial Sequence: Synthetic coding sequence
atgtgccgcatccagagagcagatggagactgtgacctggccgctgtgatcctgcacgtgaagagaagacgcatctgtgtgagcccccacaaccacacagtgaagcagtggatgaaggtgcaggccgccaagaagaatggaaaaggaaatgtgtgccacaggaagaagcaccacggcaagaggaacagcaacagagcccaccagggcaagcatgagacctacggccacaagaccccctactag

SEQ ID NO: 147220 - DNA, 354 bp, Artificial Sequence
  Description of Artificial Sequence: Synthetic coding sequence
atgcagcagaggggcctggccatcgtggccctggccgtgtgtgccgccctgcacgccagcgaggccatcctgcccatcgccagcagctgctgcacagaggtgagccaccacatcagccggcggctgctggagcgggtgaacatgtgccgcatccagagagcagatggagactgtgacctggccgctgtgatgctggagtgcagcgacatgatcagcgcccactacaacctgcacctgcccggcagcaatgacagccccaccagcgccttccaggtggccggcatcacagccttcatgagcagcgctgaggagagcgtgtctgcccggaccaccatcctgctgagcagcggctag

SEQ ID NO: 147221 - DNA, 282 bp, Artificial Sequence
  Description of Artificial Sequence: Synthetic coding sequence
atgcaggtgtccacagctgccctggccgtgctgctgtgcaccatggccctgtgcaaccaggtgctgagcgcccccctggccgctgacacccccacagcctgctgcttctcctacaccagccggcagatcccccagaacttcatcgctgactactttgagaccagcagccagtgcagcaagcccagcgtcatcttcctgaccaagaggggccggcaggtgtgtgccgaccccagcgaggagtgggtgcagaagtatgtgtctgacctggagctgagcgcctag

SEQ ID NO: 147222 - DNA, 159 bp, Artificial Sequence
  Description of Artificial Sequence: Synthetic coding sequence
atgcaggtgtccacagctgccctggccgtgctgctgtgcaccatggccctgtgcaaccaggtgctgagcgcccccctgagccggccccgggaggccggccgctctgtgctgacccctgtgcgcagcggcagcaggaacacctctgtgacctggagctag

SEQ ID NO: 147223 - DNA, 144 bp, Artificial Sequence
  Description of Artificial Sequence: Synthetic coding sequence
atgcaggtgtccacagctgccctggccgtgctgctgtgcaccatggccctgtgcaaccaggtgctgagcgccccccaggccggccgctctgtgctgacccctgtgcgcagcggcagcaggaacacctctgtgacctggagctag

SEQ ID NO: 147224 - DNA, 279 bp, Artificial Sequence
  Description of Artificial Sequence: Synthetic coding sequence
atgaagctgtgtgtgacagtgctgagcctgctgatgctggtggccgccttctgcagccctgccctgagcgcccccatgggcagtgaccccccaacagcctgctgcttctcctacacagccaggaagctgcccaggaactttgtggtggactactatgagaccagcagcctgtgcagccagcctgctgtggtgttccagaccaagaggagcaagcaggtgtgtgccgaccccagcgagagctgggtgcaggagtatgtgtatgacctggagctgaactag

SEQ ID NO: 147225 - DNA, 159 bp, Artificial Sequence
  Description of Artificial Sequence: Synthetic coding sequence
atgaagctgtgtgtgacagtgctgagcctgctgatgctggtggccgccttctgcagccctgccctgagcgcccccaacagcaagcccaaggaggccagcaagtctgtgctgatccctgtgaaccctggcagccgcagcacctgcatgacctggaactag

SEQ ID NO: 147226 - DNA, 159 bp, Artificial Sequence
  Description of Artificial Sequence: Synthetic coding sequence
atgaagctgtgtgtgacagtgctgagcctgctggtgctggtggccgccttctgcagcctggccctgagcgcccccaacagcaagcccaaggaggccagcaagagcgccctgacccctgtgtccccaggcagccgcagcacctgcatgacctggaactag

SEQ ID NO: 147227 - DNA, 207 bp, Artificial Sequence
  Description of Artificial Sequence: Synthetic coding sequence
atgaagctgtgtgtgacagtgctgagcctgctggtgctggtggccgccttctgcagcctggccctgagcgcccccaccaagagcagcgagtggaagctgcagggcgtgtgcttccagtgctgcagcaggaaggaccccatccaccagagctgccccacctggaccatggtgcggcagaggaagatgcccaccactggaaaaggatag

SEQ ID NO: 147228 - DNA, 261 bp, Artificial Sequence
  Description of Artificial Sequence: Synthetic coding sequence
atgaagctgtgtgtgacagtgctgagcctgctggtgctggtggccgccttctgcagcctggccctgagcgcccccatgggcagtgaccccccaacagcctgctgcttctcctacacagccaggaagctgcccaggaactttgtggtggactactatgagaccagcagcctgtgcagccagcctgctgtggtggccgccccccacggcccctggagcggccggggccgctgcctgccccaggcccgggacaaggccaggtag

SEQ ID NO: 147229 - DNA, 279 bp, Artificial Sequence
  Description of Artificial Sequence: Synthetic coding sequence
atgaagctgtgtgtgacagtgctgagcctgctggtgctggtggccgccttctgcagcctggccctgagcgcccccatgggcagtgaccccccaacagcctgctgcttctcctacacagccaggaagctgcccaggaactttgtggtggactactatgagaccagcagcctgtgcagccagcctgctgtggtgttccagaccaagaggggcaagcaggtgtgtgccgaccccagcgagagctgggtgcaggagtatgtgtatgacctggagctgaactag

SEQ ID NO: 147230 - DNA, 300 bp, Artificial Sequence
  Description of Artificial Sequence: Synthetic coding sequence
atgaaggtgtctgctgccctgctgtgcctgctgctgattgctgccaccttcatcccccagggcctggcccagccagatgccatcaatgcccctgtgacctgctgctacaacttcaccaacaggaagatctctgtgcagaggctggccagctaccgccgcatcaccagcagcaagtgccccaaggaggccgtcatcttcaagaccatcgtggccaaggagatctgtgccgaccccaagcagaagtgggtgcaggacagcatggaccacctggacaagcagacccagacccccaagacctag

SEQ ID NO: 147231 - DNA, 330 bp, Artificial Sequence
  Description of Artificial Sequence: Synthetic coding sequence
atgctgaagctgacccccctgcccagcaagatgaaggtgtctgctgccctgctgtgcctgctgctgatggccgccaccttcagcccccagggcctggcccagccagattctgtgtccatccccatcacctgctgcttcaacgtcatcaacaggaagatccccatccagaggctggagagctacacccgcatcaccaacatccagtgccccaaggaggccgtcatcttcaagaccaagaggggcaaggaggtgtgtgccgaccccaaggagcgctgggtgcgggacagcatgaagcacctggaccagatcttccagaacctgaagccctag

SEQ ID NO: 147232 - DNA, 1068 bp, Artificial Sequence
  Description of Artificial Sequence: Synthetic coding sequence
atggagacccccaacaccacagaggactatgacaccaccacagaatttgattatggagatgccaccccctgccagaaggtgaatgaaagagccttcggggcccagctgctgccccccctgtacagcctggtgtttgtgattggcctggtgggcaacatcctggtggtgctggtgctggtgcagtacaagaggctgaagaacatgaccagcatctacctgctgaacctggccatcagtgacctgctcttcctgttcaccctgcccttctggattgactacaagctgaaggatgactgggtgtttggagatgccatgtgcaagatcctgagcggcttctactacacaggcctgtacagcgagatcttcttcatcatcctgctgaccatcgaccgctacctggccatcgtgcatgctgtgtttgccctgcgggccaggacagtgacctttggagtcatcaccagcatcatcatctgggccctggccatcctggcctccatgcctggcctgtacttcagcaagacccagtgggagttcacccaccacacctgcagcctgcacttcccccatgagagcctgcgggagtggaagctgttccaggccctgaagctgaacctgtttggcctggtgctgcccctgctggtgatgatcatctgctacacaggcatcatcaagatcctgctgcggcggcccaatgagaagaagagcaaggctgtgcggctcatcttcgtcatcatgatcatcttcttcctgttctggaccccctacaacctgaccatcctgatcagcgtcttccaggacttcctgttcacccatgaatgtgagcagagccgccacctggacctggccgtgcaggtgacagaggtgattgcctacacccactgctgcgtgaaccctgtgatctatgcctttgtgggggagcgcttcaggaagtacctgcggcagctgttccaccggcgggtggccgtgcacctggtgaagtggctgcccttcctgtctgtggaccggctggagcgggtgagcagcaccagccccagcactggagaacatgagctgtctgctggcttctag

SEQ ID NO: 147233 - DNA, 1089 bp, Artificial Sequence
  Description of Artificial Sequence: Synthetic coding sequence
atgggcacagaggccacagagcaggtgtcctggggccactacagcggagatgaagaagatgcctacagcgctgagcccctgcctgagctgtgctacaaggcagatgtgcaggccttcagccgggccttccagcccagcgtgtccctgactgtggccgccctgggcctggccggaaatggcctggtgctggccacccacctggccgcccggcgggccgcccggagccccaccagcgcccacctgctgcagctggccctggccgacctgctgctggccctgaccctgccctttgctgctgctggggccctgcagggctggagcctgggcagcgccacctgcaggaccatcagcggcctgtacagcgccagcttccacgccggcttcctgttcctggcctgcatctctgctgacagatatgtggccatcgcccgggccctgcctgctggcccccggcccagcaccccaggccgggcccacctggtgtctgtcatcgtgtggctgctgagcctgctgctggccctgcctgccctgctcttcagccaggacggccagcgggagggccagaggcgctgccgcctcatcttccctgagggcctgacccagacagtgaagggggccagcgctgtggcccaggtggccctgggctttgccctgcccctgggcgtgatggtggcctgctacgccctgctgggccgcaccctgctggccgcccggggccctgagaggagaagagccctgcgggtggtggtggccctggtggccgcctttgtggtgctgcagctgccctacagcctggccctgctgctggacacagctgacctgctggccgcccgggagaggagctgcccagccagcaagaggaaggatgtggccctgctggtgaccagcggcctggccctggcccgctgtggcctgaaccctgtgctgtatgccttcctgggcctgcgcttccggcaggacctgcggcggctgctgcggggcggcagctgccccagcggcccccagccccggcggggctgcccccggcggccccggctgagcagctgcagcgcccccacagagacccacagcctgtcctgggacaactag

SEQ ID NO: 147234 - DNA, 1125 bp, Artificial Sequence
  Description of Artificial Sequence: Synthetic coding sequence
atgctgagcaccagccgcagccgcttcatccggaacaccaatgaaagtggagaggaggtgaccaccttctttgattatgactatggagccccctgccacaagtttgatgtgaagcagatcggggcccagctgctgccccccctgtacagcctggtgttcatctttggatttgtgggcaacatgctggtggtgctgatcctgatcaactgcaagaagctgaagtgcctgacagacatctacctgctgaacctggccatcagtgacctgctcttcctgatcaccctgcccctgtgggcccacagcgctgccaatgagtgggtgtttggaaatgccatgtgcaagctgttcaccggcctgtaccacatcggctactttggaggcatcttcttcatcatcctgctgaccatcgaccgctacctggccatcgtgcatgctgtgtttgccctgaaggccaggacagtgaccttcggcgtggtgaccagcgtcatcacctggctggtggccgtgtttgcctctgtgcccggcatcatcttcaccaagtgccagaaggaggacagcgtgtatgtgtgtggcccctacttcccccggggctggaacaacttccacaccatcatgaggaacatcctgggcctggtgctgcccctgctgatcatggtgatctgctacagcggcatcctgaagaccctgctgcgctgcagaaatgagaagaagaggcacagagctgtgcgggtcatcttcaccatcatgattgtgtacttcctgttctggaccccctacaacatcgtcatcctgctgaacaccttccaggagttcttcggcctgagcaactgtgagagcaccagccagctggaccaggccacccaggtgacagagaccctgggcatgacccactgctgcatcaaccccatcatctatgcctttgtgggggagaagttccgcagcctcttccacatcgccctgggctgccgcatcgcccccctgcagaagcctgtgtgtggcggccctggggtgcggcctgggaagaatgtgaaggtgaccacccagggcctgctggatggccggggcaagggcaagagcatcggccgggcccctgaggccagcctgcaggacaaggagggcgcctag

SEQ ID NO: 147235 - DNA, 1125 bp, Artificial Sequence; identical to SEQ ID NO: 147234
  Description of Artificial Sequence: Synthetic coding sequence

SEQ ID NO: 147236 - DNA, 366 bp, Artificial Sequence
  Description of Artificial Sequence: Synthetic coding sequence
atgctgagcaccagccgcagccgcttcatccggaacaccaatgaaagtggagaggaggtgaccaccttctttgattatgactatggagccccctgccacaagtttgatgtgaagcagatcggggcccagctgctgccccccctgtacagcctggtgttcatctttggatttgtgggcaacatgctggtggtgctgatcctgatcaactgcaagaagctgaagtgcctgacagacatctacctgctgaacctggccatcagtgacctgctcttcctgatcaccctgcccctgtgggcccacagcgctgccaatgagtgggtgtttggaaatgccatgtgcaagctgttcaccggcctgtaccactag

SEQ ID NO: 147237 - DNA, 1083 bp, Artificial Sequence
  Description of Artificial Sequence: Synthetic coding sequence
atgctgagcaccagccgcagccgcttcatccggaacaccaatgaaagtggagaggaggtgaccaccttctttgattatgactatggagccccctgccacaagtttgatgtgaagcagatcggggcccagctgctgccccccctgtacagcctggtgttcatctttggatttgtgggcaacatgctggtggtgctgatcctgatcaactgcaagaagctgaagtgcctgacagacatctacctgctgaacctggccatcagtgacctgctcttcctgatcaccctgcccctgtgggcccacagcgctgccaatgagtgggtgtttggaaatgccatgtgcaagctgttcaccggcctgtaccacatcggctactttggaggcatcttcttcatcatcctgctgaccatcgaccgctacctggccatcgtgcatgctgtgtttgccctgaaggccaggacagtgaccttcggcgtggtgaccagcgtcatcacctggctggtggccgtgtttgcctctgtgcccggcatcatcttcaccaagtgccagaaggaggacagcgtgtatgtgtgtggcccctacttcccccggggctggaacaacttccacaccatcatgaggaacatcctgggcctggtgctgcccctgctgatcatggtgatctgctacagcggcatcctgaagaccctgctgcgctgcagaaatgagaagaagaggcacagagctgtgcgggtcatcttcaccatcatgattgtgtacttcctgttctggaccccctacaacatcgtcatcctgctgaacaccttccaggagttcttcggcctgagcaactgtgagagcaccagccagctggaccaggccacccaggtgacagagaccctgggcatgacccactgctgcatcaaccccatcatctatgcctttgtgggggagaagttccgccgctacctgtctgtgttcttcaggaagcacatcaccaagcgcttctgcaagcagtgccctgtgttctaccgggagaccgtggatggagtgaccagcaccaacacccccagcactggagagcaggaggtgtctgctggcctgtag

SEQ ID NO: 147238 - DNA, 1068 bp, Artificial Sequence
  Description of Artificial Sequence: Synthetic coding sequence
atgaccaccagcctggacacagtggagaccttcggcaccaccagctactatgatgatgtgggcctgctgtgtgagaaggctgacacccgggccctgatggcccagtttgtgccccccctgtacagcctggtgttcaccgtgggcctgctgggcaatgtggtggtggtgatgatcctgatcaagtacagaaggctgcgcatcatgaccaacatctacctgctgaacctggccatcagtgacctgctcttcctggtgaccctgcccttctggatccactacgtgcggggccacaactgggtgtttggacatggcatgtgcaagctgctgagcggcttctaccacacaggcctgtacagcgagatcttcttcatcatcctgctgaccatcgaccgctacctggccatcgtgcatgctgtgtttgccctgcgggccaggacagtgacctttggagtcatcaccagcatcgtgacctggggcctggccgtgctggccgccctgcctgagttcatcttctatgaaacagaggagctgtttgaggagaccctgtgcagcgccctgtacccagaagatactgtgtacagctggaggcacttccacaccctgaggatgaccatcttctgcctggtgctgcccctgctggtgatggccatctgctacacaggcatcatcaagaccctgctgcgctgccccagcaagaagaagtacaaggccatccgcctcatcttcgtcatcatggctgtgttcttcatcttctggaccccctacaacgtggccatcctgctgagcagctaccagagcatcctgtttggaaatgactgtgagaggagcaagcacctggacctggtgatgctggtgacagaggtgattgcctacagccactgctgcatgaaccctgtgatctatgcctttgtgggggagcgcttcaggaagtacctgcggcacttcttccaccgccacctgctgatgcacctgggccgctacatccccttcctgcccagcgagaagctggagaggaccagctctgtgagccccagcacagctgagcctgagctgagcatcgtgttctag

SEQ ID NO: 147239 - DNA, 1068 bp, Artificial Sequence; identical to SEQ ID NO: 147238
  Description of Artificial Sequence: Synthetic coding sequence

SEQ ID NO: 147240 - DNA, 1068 bp, Artificial Sequence; identical to SEQ ID NO: 147238
  Description of Artificial Sequence: Synthetic coding sequence

SEQ ID NO: 147241 - DNA, 243 bp, Artificial Sequence
  Description of Artificial Sequence: Synthetic coding sequence
atgaccaccagcctggacacagtggagaccttcggcaccaccagctactatgatgatgtgggcctgctgtgtgagaaggctgacacccgggccctgatggcccagtttgtgccccccctgtacagcctggtgttcaccgtgggcctgctgggcaatgtggtggtggtgatgatcctgatcaagtacagaaggctgcgcatcatgaccaacatctacctgctgaacctggccatcagtgactag

SEQ ID NO: 147242 - DNA, 66 bp, Artificial Sequence
  Description of Artificial Sequence: Synthetic coding sequence
atgaccaccagcctggacacagtggagaccttcggcaccaccagctactatgatgatgtgggctag

SEQ ID NO: 147243 - DNA, 1068 bp, Artificial Sequence; identical to SEQ ID NO: 147238
  Description of Artificial Sequence: Synthetic coding sequence

SEQ ID NO: 147244 - DNA, 1131 bp, Artificial Sequence
  Description of Artificial Sequence: Synthetic coding sequence
atgcccttcggcatccgcatgctgctgcgggcccacaagccaggcagcagccgccgctctgagatgaccaccagcctggacacagtggagaccttcggcaccaccagctactatgatgatgtgggcctgctgtgtgagaaggctgacacccgggccctgatggcccagtttgtgccccccctgtacagcctggtgttcaccgtgggcctgctgggcaatgtggtggtggtgatgatcctgatcaagtaccgccgcctgcgcatcatgaccaacatctacctgctgaacctggccatcagtgacctgctcttcctggtgaccctgcccttctggatccactacgtgcggggccacaactgggtgtttggccacggcatgtgcaagctgctgagcggcttctaccacacaggcctgtacagcgagatcttcttcatcatcctgctgaccatcgaccgctacctggccatcgtgcatgctgtgtttgccctgcgggccaggacagtgaccttcggggtcatcaccagcatcgtgacctggggcctggccgtgctggccgccctgcctgagttcatcttctatgaaacagaggagctgtttgaggagaccctgtgcagcgccctgtacccagaggacacagtgtacagctggaggcacttccacaccctgaggatgaccatcttctgcctggtgctgcccctgctggtgatggccatctgctacacaggcatcatcaagaccctgctgcgctgccccagcaagaagaagtacaaggccatccgcctcatctttgtgatcatggctgtgttcttcatcttctggaccccctacaacgtggccatcctgctgagcagctaccagagcatcctgtttggaaatgactgtgagaggagcaagcacctggacctggtgatgctggtgacagaggtgattgcctacagccactgctgcatgaaccctgtgatctatgcctttgtgggggagcgcttcaggaagtacctgcggcacttcttccaccgccacctgctgatgcacctgggccgctacatccccttcctgcccagcgagaagctggagaggaccagctctgtgagccccagcacagctgagcctgagctgagcatcgtgttctag

SEQ ID NO: 147245 - DNA, 1083 bp, Artificial Sequence
  Description of Artificial Sequence: Synthetic coding sequence
atgaaccccacagacattgctgacaccaccctggatgagagcatctacagcaactactacctgtatgagagcatccccaagccctgcaccaaggagggcatcaaggcctttggagagctgttcctgccccccctgtacagcctggtgtttgtgtttggcctgctgggcaacagcgtggtggtgctggtgctcttcaagtacaagaggctgcgctccatgacagatgtgtacctgctgaacctggccatcagtgacctgctgtttgtgttcagcctgcccttctggggctactatgctgctgaccagtgggtgtttggcctgggcctgtgcaagatgatctcctggatgtacctggtgggcttctacagcggcatcttctttgtgatgctgatgagcattgaccgctacctggccatcgtgcatgctgtgttcagcctgcgggcccggaccctgacctatggagtcatcaccagcctggccacctggagcgtggccgtgtttgccagcctgcccggcttcctgttcagcacctgctacacagagaggaaccacacctactgcaagaccaagtacagcctgaacagcaccacctggaaggtgctgagcagcctggagatcaacatcctgggcctggtgatccccctgggcatcatgctgttctgctacagcatgatcatccgcaccctgcagcactgcaagaatgagaagaagaacaaggctgtgaagatgatctttgctgtggtggtgctcttcctgggcttctggaccccctacaacatcgtgctcttcctggagaccctggtggagctggaggtgctgcaggactgcacctttgagcgctacctggactatgccatccaggccacagagaccctggcctttgtgcactgctgcctgaaccccatcatctacttcttcctgggggagaagttcaggaagtacatcctgcagctgttcaagacctgccggggcctgtttgtgctgtgccagtactgcggcctgctgcagatctacagcgctgacacccccagcagcagctacacccagagcaccatggaccatgacctgcatgatgccctgtag

SEQ ID NO: 147246 - DNA, 1059 bp, Artificial Sequence
  Description of Artificial Sequence: Synthetic coding sequence
atggactaccaggtgagcagccccatctatgacatcaactactacaccagcgagccctgccagaagatcaacgtgaagcagattgctgcccggctgctgccccccctgtacagcctggtgttcatctttggatttgtgggcaacatgctggtgatcctgatcctgatcaactgcaagaggctgaagtccatgacagacatctacctgctgaacctggccatcagtgacctcttcttcctgctgactgtgcccttctgggcccactacgccgccgcccagtgggactttggaaacaccatgtgccagctgctgaccggcctgtacttcatcggcttcttcagcggcatcttcttcatcatcctgctgaccatcgaccgctacctggccgtggtgcatgctgtgtttgccctgaaggccaggacagtgaccttcggcgtggtgaccagcgtcatcacctgggtggtggccgtgtttgccagcctgcccggcatcatcttcaccaggagccagaaggagggcctgcactacacctgcagcagccacttcccctacagccagtaccagttctggaagaacttccagaccctgaagatcgtcatcctgggcctggtgctgcccctgctggtgatggtgatctgctacagcggcatcctgaagaccctgctgcgctgcagaaatgagaagaagaggcacagagctgtgcggctcatcttcaccatcatgattgtgtacttcctgttctgggccccctacaacatcgtgctgctgctgaacaccttccaggagttcttcggcctgaacaactgcagcagcagcaaccggctggaccaggccatgcaggtgacagagaccctgggcatgacccactgctgcatcaaccccatcatctatgcctttgtgggggagaagttcaggaactacctgctggtgttcttccagaagcacatcgccaagcgcttctgcaagtgctgcagcatcttccagcaggaggcccctgagcgggccagctctgtgtacaccaggagcactggagagcaggagatctctgtgggcctgtag

SEQ ID NO: 147247 - DNA, 1059 bp, Artificial Sequence; identical to SEQ ID NO: 147246
  Description of Artificial Sequence: Synthetic coding sequence

SEQ ID NO: 147248 - DNA, 999 bp, Artificial Sequence
  Description of Artificial Sequence: Synthetic coding sequence
ctgcccaagaaccagtgtgaggccaacagaagccccccaccagccagcgccctgctgactggagtgcacctgtggttctgcaacatgctggtgatcctgatcctgatcaactgcaagaggctgaagtccatgacagacatctacctgctgaacctggccatcagtgacctcttcttcctgctgactgtgcccttctgggcccactacgccgccgcccagtgggactttggaaacaccatgtgccagctgctgaccggcctgtacttcatcggcttcttcagcggcatcttcttcatcatcctgctgaccatcgaccgctacctggccgtggtgcatgctgtgtttgccctgaaggccaggacagtgaccttcggcgtggtgaccagcgtcatcacctgggtggtggccgtgtttgccagcctgcccggcatcatcttcaccaggagccagaaggagggcctgcactacacctgcagcagccacttcccctacagccagtaccagttctggaagaacttccagaccctgaagatcgtcatcctgggcctggtgctgcccctgctggtgatggtgatctgctacagcggcatcctgaagaccctgctgcgctgcagaaatgagaagaagaggcacagagctgtgcggctcatcttcaccatcatgattgtgtacttcctgttctgggccccctacaacatcgtgctgctgctgaacaccttccaggagttcttcggcctgaacaactgcagcagcagcaaccggctggaccaggccatgcaggtgacagagaccctgggcatgacccactgctgcatcaaccccatcatctatgcctttgtgggggagaagttcaggaactacctgctggtgttcttccagaagcacatcgccaagcgcttctgcaagtgctgcagcatcttccagcaggaggcccctgagcgggccagctctgtgtacaccaggagcactggagagcaggagatctctgtgggcctgtag

SEQ ID NO: 147249 - DNA, 1059 bp, Artificial Sequence; identical to SEQ ID NO: 147246
  Description of Artificial Sequence: Synthetic coding sequence

SEQ ID NO: 147250 - DNA, 1125 bp, Artificial Sequence
  Description of Artificial Sequence: Synthetic coding sequence
atgtctggagagagcatgaacttcagtgatgtgtttgacagcagcgaggactactttgtgtctgtgaacaccagctactacagcgtggacagcgagatgctgctgtgcagcctgcaggaggtgcggcagttcagccggctgtttgtgcccatcgcctacagcctcatctgtgtgtttggcctgctgggcaacatcctggtggtgatcacctttgccttctacaagaaggcccgctccatgacagatgtgtacctgctgaacatggccatcgctgacatcctgtttgtgctgaccctgcccttctgggccgtgagccacgccaccggggcctgggtgttcagcaatgccacctgcaagctgctgaagggcatctatgccatcaacttcaactgtggcatgctgctgctgacctgcatctccatggaccgctacatcgccatcgtgcaggccaccaagagcttccggctgcggagcaggaccctgcccaggagcaagatcatctgcctggtggtgtggggcctgagcgtcatcatcagcagcagcacctttgtgttcaaccagaagtacaacacccagggcagtgatgtgtgtgagcccaagtaccagacagtgtctgagcccatccgctggaagctgctgatgctgggcctggagctgctgtttggcttcttcatccccctgatgttcatgatcttctgctacaccttcatcgtgaagaccctggtgcaggcccagaacagcaagaggcacaaggccatccgggtcatcatcgctgtggtgctggtgttcctggcctgccagatcccccacaacatggtgctgctggtgacagctgccaacctgggcaagatgaacagaagctgccagagcgagaagctgattggctacaccaagacagtgacagaggtgctggccttcctgcactgctgcctgaaccctgtgctgtatgccttcatcggccagaagttcaggaactacttcctgaagatcctgaaggacctgtggtgtgtgcggaggaagtacaagagcagcggcttcagctgtgccggccgctacagcgagaacatcagccggcagaccagcgagacagctgacaatgacaatgccagcagcttcaccatgtag

SEQ ID NO: 147251 - DNA, 1125 bp, Artificial Sequence; identical to SEQ ID NO: 147250
  Description of Artificial Sequence: Synthetic coding sequence

SEQ ID NO: 147252 - DNA, 1125 bp, Artificial Sequence; identical to SEQ ID NO: 147250
  Description of Artificial Sequence: Synthetic coding sequence

SEQ ID NO: 147253 - DNA, 1137 bp, Artificial Sequence
  Description of Artificial Sequence: Synthetic coding sequence
atggacctgggcaagcccatgaagtctgtgctggtggtggccctgctggtgatcttccaggtgtgcctgtgccaggatgaggtgacagatgactacatcggggacaacaccaccgtggactacaccctgtttgagagcctgtgcagcaagaaggatgtgaggaacttcaaggcctggttcctgcccatcatgtacagcatcatctgctttgtgggcctgctgggcaatggcctggtggtgctgacctacatctacttcaagaggctgaagaccatgacagacacctacctgctgaacctggccgtggccgacatcctcttcctgctgaccctgcccttctgggcctacagcgctgccaagtcctgggtgtttggagtgcacttctgcaagctgatctttgccatctacaagatgtccttcttcagcggcatgctgctgctgctgtgcatcagcattgacagatatgtggccatcgtgcaggccgtgtctgcccaccgccaccgggcccgggtgctgctgatcagcaagctgagctgtgtgggcatctggatcctggccaccgtgctgagcatccctgagctgctgtacagcgacctgcagaggagcagcagcgagcaggccatgcgctgcagcctcatcacagagcacgtggaggccttcatcaccatccaggtggcccagatggtgattggcttcctggtgcccctgctggccatgtccttctgctacctggtgatcatccgcaccctgctgcaggccaggaactttgagaggaacaaggccatcaaggtgatcatcgctgtggtggtggtgttcatcgtgttccagctgccctacaacggggtggtgctggcccagacagtggccaacttcaacatcaccagcagcacctgtgagctgagcaagcagctgaacatcgcctatgatgtgacctacagcctggcctgtgtgcgctgctgcgtgaaccccttcctgtatgccttcatcggcgtgaagttcagaaatgacctcttcaagctgttcaaggacctgggctgcctgagccaggagcagctgcggcagtggagcagctgccgccacatccgccgcagctccatgtctgtggaggccgagaccaccaccaccttcagcccctag

SEQ ID NO: 147254 - DNA, 1068 bp, Artificial Sequence
  Description of Artificial Sequence: Synthetic coding sequence
atggactacaccctggacctgtctgtgaccaccgtgacagactactactacccagacatcttcagcagcccctgtgatgctgagctgatccagaccaacgggaagctgctgctggccgtgttctactgcctgctgtttgtgttcagcctgctgggcaacagcctggtgatcctggtgctggtggtgtgcaagaagctgcggagcatcacagatgtgtacctgctgaacctggccctgagtgacctgctgtttgtgttctccttccccttccagacctactacctgctggaccagtgggtgtttggaacagtgatgtgcaaggtggtgtctggcttctactacatcggcttctacagctccatgttcttcatcaccctgatgtctgtggaccgctacctggccgtggtgcatgctgtgtatgccctgaaggtgaggaccatccgcatgggcaccaccctgtgcctggccgtgtggctgacagccatcatggccaccatccccctgctggtgttctaccaggtggcctctgaagatggagtgctgcagtgctacagcttctacaaccagcagaccctgaagtggaagatcttcaccaacttcaagatgaacatcctgggcctgctgatccccttcaccatcttcatgttctgctacatcaagatcctgcaccagctgaagcgctgccagaaccacaacaagaccaaggccatccggctggtgctgattgtggtgattgccagcctgctcttctgggtgcccttcaacgtggtgctcttcctgaccagcctgcacagcatgcacatcctggatggctgcagcatcagccagcagctgacctacgccacccacgtgacagagatcatctccttcacccactgctgcgtgaaccctgtgatctatgcctttgtgggggagaagttcaagaagcacctgtctgagatcttccagaagagctgcagccagatcttcaactacctgggccggcagatgccccgggagagctgtgagaagagcagcagctgccagcagcacagcagccgcagcagctctgtggactacatcctgtag

SEQ ID NO: 147255 - DNA, 819 bp, Artificial Sequence
  Description of Artificial Sequence: Synthetic coding sequence
atgaggaacctcttccggcagatgacctactacctgctggaccagtgggtgtttggcaccgtgatgtgcaaggtggtgtctggcttctactacatcggcttctacagctccatgttcttcatcaccctgatgtctgtggaccgctacctggccgtggtgcatgctgtgtatgccctgaaggtgaggaccatccgcatgggcaccaccctgtgcctggccgtgtggctgacagccatcatggccaccatccccctgctggtgttctaccaggtggcctctgaagatggagtgctgcagtgctacagcttctacaaccagcagaccctgaagtggaagatcttcaccaacttcaagatgaacatcctgggcctgctgatccccttcaccatcttcatgttctgctacatcaagatcctgcaccagctgaagcgctgccagaaccacaacaagaccaaggccatccggctggtgctgattgtggtgattgccagcctgctcttctgggtgcccttcaacgtggtgctcttcctgaccagcctgcacagcatgcacatcctggatggctgcagcatcagccagcagctgacctacgccacccacgtgacagagatcatctccttcacccactgctgcgtgaaccctgtgatctatgcctttgtgggggagaagttcaagaagcacctgtctgagatcttccagaagagctgcagccagatcttcaactacctgggccggcagatgccccgggagagctgtgagaagagcagcagctgccagcagcacagcagccgcagcagctctgtggactacatcctgtag

SEQ ID NO: 147256 - DNA, 1074 bp, Artificial Sequence
  Description of Artificial Sequence: Synthetic coding sequence
atggctgatgattatggcagcgagagcaccagctccatggaggactatgtgaacttcaacttcacagacttctactgtgagaagaacaacgtgcggcagtttgccagccacttcctgccccccctgtactggctggtgttcatcgtgggcgccctgggcaacagcctggtgatcctggtgtactggtactgcaccagggtgaagaccatgacagacatgttcctgctgaacctggccatcgctgacctgctcttcctggtgaccctgcccttctgggccatcgctgctgctgaccagtggaagttccagaccttcatgtgcaaggtggtgaacagcatgtacaagatgaacttctacagctgtgtgctgctgatcatgtgcatctctgtggaccgctacatcgccatcgcccaggccatgagggcccacacctggagggagaagaggctgctgtacagcaagatggtgtgcttcaccatctgggtgctggccgccgccctgtgcatccctgagatcctgtacagccagatcaaggaggagagcggcatcgccatctgcaccatggtgtaccccagtgatgagagcaccaagctgaagtctgctgtgctgaccctgaaggtgatcctgggcttcttcctgccctttgtggtgatggcctgctgctacaccatcatcatccacaccctcatccaggccaagaagagcagcaagcacaaggccctgaaggtgaccatcaccgtgctgactgtgtttgtgctgagccagttcccctacaactgcatcctgctggtgcagaccattgatgcctatgccatgttcatcagcaactgtgctgtgtccaccaacatcgacatctgcttccaggtgacccagaccatcgccttcttccacagctgcctgaaccctgtgctgtatgtgtttgtgggggagcgcttcagaagagacctggtgaagaccctgaagaacctgggctgcatcagccaggcccagtgggtgtccttcacccggcgggagggcagcctgaagctgagctccatgctgctggagaccaccagcggggccctgagcctgtag

SEQ ID NO: 147257 - DNA, 1110 bp, Artificial Sequence
  Description of Artificial Sequence: Synthetic coding sequence
atgacccccacagacttcaccagccccatccccaacatggctgatgattatggcagcgagagcaccagctccatggaggactatgtgaacttcaacttcacagacttctactgtgagaagaacaacgtgcggcagtttgccagccacttcctgccccccctgtactggctggtgttcatcgtgggcgccctgggcaacagcctggtgatcctggtgtactggtactgcaccagggtgaagaccatgacagacatgttcctgctgaacctggccatcgctgacctgctcttcctggtgaccctgcccttctgggccatcgctgctgctgaccagtggaagttccagaccttcatgtgcaaggtggtgaacagcatgtacaagatgaacttctacagctgtgtgctgctgatcatgtgcatctctgtggaccgctacatcgccatcgcccaggccatgagggcccacacctggagggagaagaggctgctgtacagcaagatggtgtgcttcaccatctgggtgctggccgccgccctgtgcatccctgagatcctgtacagccagatcaaggaggagagcggcatcgccatctgcaccatggtgtaccccagtgatgagagcaccaagctgaagtctgctgtgctgaccctgaaggtgatcctgggcttcttcctgccctttgtggtgatggcctgctgctacaccatcatcatccacaccctcatccaggccaagaagagcagcaagcacaaggccctgaaggtgaccatcaccgtgctgactgtgtttgtgctgagccagttcccctacaactgcatcctgctggtgcagaccattgatgcctatgccatgttcatcagcaactgtgctgtgtccaccaacatcgacatctgcttccaggtgacccagaccatcgccttcttccacagctgcctgaaccctgtgctgtatgtgtttgtgggggagcgcttcagaagagacctggtgaagaccctgaagaacctgggctgcatcagccaggcccagtgggtgtccttcacccggcgggagggcagcctgaagctgagctccatgctgctggagaccaccagcggggccctgagcctgtag

SEQ ID NO: 147258 - DNA, 1074 bp, Artificial Sequence; identical to SEQ ID NO: 147256
  Description of Artificial Sequence: Synthetic coding sequence

SEQ ID NO: 147259 - DNA, 1053 bp, Artificial Sequence
  Description of Artificial Sequence: Synthetic coding sequence
atggccctggagcagaaccagagcacagactactactatgaagaaaatgagatgaatggcacctatgactacagccagtatgagctgatctgcatcaaggaggatgtgcgggagtttgccaaggtgttcctgcctgtgttcctgaccatcgtgtttgtgattggcctggccggcaacagcatggtggtggccatctatgcctactacaagaagcagaggaccaagacagatgtgtacatcctgaacctggccgtggccgacctgctgctgctcttcaccctgcccttctgggccgtgaatgctgtgcacggctgggtgctgggcaagatcatgtgcaagatcaccagcgccctgtacaccctgaactttgtgtctggcatgcagttcctggcctgcatcagcattgaccgctacgtggccgtgaccaaggtgcccagccagagcggcgtgggcaagccctgctggatcatctgcttctgtgtgtggatggccgccatcctgctgagcatcccccagctggtgttctacacagtgaatgacaatgcccgctgcatccccatcttcccccgctacctgggcacctccatgaaggccctgatccagatgctggagatctgcattggatttgtggtgcccttcctgatcatgggcgtgtgctacttcatcacagcccggaccctgatgaagatgcccaacatcaagatcagccggcccctgaaggtgctgctgactgtggtgattgtgttcatcgtgacccagctgccctacaacatcgtgaagttctgccgggccatcgacatcatctacagcctcatcaccagctgcaacatgagcaagaggatggacatcgccatccaggtgacagagagcatcgccctcttccacagctgcctgaaccccatcctgtatgtgttcatgggcgccagcttcaagaactacgtgatgaaggtggccaagaagtatggctcctggaggcggcagaggcagagcgtggaggagttcccctttgacagcgagggccccacagagcccaccagcaccttcagcatctag

SEQ ID NO: 147260 - DNA, 825 bp, Artificial Sequence
  Description of Artificial Sequence: Synthetic coding sequence
atggccctggagcagaaccagagcacagactactactatgaagaaaatgagatgaatggcacctatgactacagccagtatgagctgatctgcatcaaggaggatgtgcgggagtttgccaaggtgttcctgcctgtgttcctgaccatcgtgtttgtgattggcctggccggcaacagcatggtggtggccatctatgcctactacaagaagcagaggaccaagacagatgtgtacatcctgaacctggccgtggccgacctgctgctgctcttcaccctgcccttctgggccgtgaatgctgtgcacggctgggtgctgggcaagatcatgtgcaagatcaccagcgccctgtacaccctgaactttgtgtctggcatgcagttcctggcctgcatcagcattgaccgctacgtggccgtgaccaaggtgcccagccagagcggcgtgggcaagccctgctggatcatctgcttctgtgtgtggatggccgccatcctgctgagcatcccccagctggtgttctacacagtgaatgacaatgcccgctgcatccccatcttcccccgctacctgggcacctccatgaaggccctgatccagatgctggagatctgcattggatttgtggtgcccttcctgatcatgggcgtgtgctacttcatcacagcccggaccctgatgaagatgcccaacatcaagatcagccggcccctgaaggtgctgctgactgtggtgattgtgttcatcgtgacccagctgccctttgcctggatccacatgaatgatgccttccccagcaacaagaccagcgccctcttctag

SEQ ID NO: 147261 - DNA, 1071 bp, Artificial Sequence
  Description of Artificial Sequence: Synthetic coding sequence
atgatctacacccgcttcctgaagggcagcctgaagatggccaactacaccctggccccagaagatgaatatgatgtgctgattgaaggagagctggagagtgatgaagctgagcagtgtgacaagtatgatgcccaggccctgagcgcccagctggtgcccagcctgtgcagcgctgtgtttgtgattggagtgctggacaacctgctggtggtgctgatcctggtgaagtacaagggcctgaagagggtggagaacatctacctgctgaacctggccgtgagcaacctgtgcttcctgctgaccctgcccttctgggcccatgctggaggagaccccatgtgcaagatcctgattggcctgtactttgtgggcctgtacagcgagaccttcttcaactgcctgctgactgtgcagcgctacctggtgttcctgcacaagggcaacttcttcagcgccaggagaagagtgccctgtggcatcatcacctctgtgctggcctgggtgacagccatcctggccaccctgcctgagtttgtggtgtacaagccccagatggaggaccagaagtacaagtgtgccttcagcaggacccccttcctgcctgcagatgagaccttctggaagcacttcctgaccctgaagatgaacatctctgtgctggtgctgcccctcttcatcttcaccttcctgtatgtgcagatgaggaagaccctgcgcttccgggagcagcgctacagcctcttcaagctggtgtttgccatcatggtggtgttcctgctgatgtgggccccctacaacatcgccttcttcctgagcaccttcaaggagcacttcagcctgagtgactgcaagagcagctacaacctggacaagtctgtgcacatcaccaagctgattgccaccacccactgctgcatcaaccccctgctgtatgccttcctggatggcaccttcagcaagtacctgtgccgctgcttccacctgcggagcaacacccccctgcagccccggggccagagcgcccagggcaccagccgggaggagccagaccacagcacagaggtgtag

SEQ ID NO: 147262 - DNA, 1035 bp, Artificial Sequence
  Description of Artificial Sequence: Synthetic coding sequence
atggccaactacaccctggccccagaagatgaatatgatgtgctgattgaaggagagctggagagtgatgaagctgagcagtgtgacaagtatgatgcccaggccctgagcgcccagctggtgcccagcctgtgcagcgctgtgtttgtgattggagtgctggacaacctgctggtggtgctgatcctggtgaagtacaagggcctgaagagggtggagaacatctacctgctgaacctggccgtgagcaacctgtgcttcctgctgaccctgcccttctgggcccatgctggaggagaccccatgtgcaagatcctgattggcctgtactttgtgggcctgtacagcgagaccttcttcaactgcctgctgactgtgcagcgctacctggtgttcctgcacaagggcaacttcttcagcgccaggagaagagtgccctgtggcatcatcacctctgtgctggcctgggtgacagccatcctggccaccctgcctgagtttgtggtgtacaagccccagatggaggaccagaagtacaagtgtgccttcagcaggacccccttcctgcctgcagatgagaccttctggaagcacttcctgaccctgaagatgaacatctctgtgctggtgctgcccctcttcatcttcaccttcctgtatgtgcagatgaggaagaccctgcgcttccgggagcagcgctacagcctcttcaagctggtgtttgccatcatggtggtgttcctgctgatgtgggccccctacaacatcgccttcttcctgagcaccttcaaggagcacttcagcctgagtgactgcaagagcagctacaacctggacaagtctgtgcacatcaccaagctgattgccaccacccactgctgcatcaaccccctgctgtatgccttcctggatggcaccttcagcaagtacctgtgccgctgcttccacctgcggagcaacacccccctgcagccccggggccagagcgcccagggcaccagccgggaggagccagaccacagcacagaggtgtag

SEQ ID NO: 147263 - DNA, 1035 bp, Artificial Sequence; identical to SEQ ID NO: 147262
  Description of Artificial Sequence: Synthetic coding sequence

SEQ ID NO: 147264 - DNA, 1035 bp, Artificial Sequence; identical to SEQ ID NO: 147262
  Description of Artificial Sequence: Synthetic coding sequence

SEQ ID NO: 147265 - DNA, 654 bp, Artificial Sequence
  Description of Artificial Sequence: Synthetic coding sequence
atggccaactacaccctggccccagaagatgaatatgatgtgctgattgaaggagagctggagagtgatgaagctgagcagtgtgacaagtatgatgcccaggccctgagcgcccagctggtgcccagcctgtgcagcgctgtgtttgtgattggagtgctggacaacctgctggtggtgctgatcctggtgaagtacaagggcctgaagagggtggagaacatctacctgctgaacctggccgtgagcaacctgtgcttcctgctgaccctgcccttctgggcccatgctggaggagaccccatgtgcaagatcctgattggcctgtactttgtgggcctgtacagcgagaccttcttcaactgcctgctgactgtgcagcgctacctggtgttcctgcacaagggcaacttcttcagcgccaggagaagagtgccctgtggcatcatcacctctgtgctggcctgggtgacagccatcctggccaccctgcctgagtttgtggtgtacaagccccagatggaggaccagaagtacaagtgtgccttcagcaggacccccttcctgcctgcagatgagaccttctggaagcacttcctgaccctgaagatgaacatctctgtgctggtgctgcccctcttcatcttcacctag

SEQ ID NO: 147266 - DNA, 1194 bp, Artificial Sequence
  Description of Artificial Sequence: Synthetic coding sequence
atggcccccatcagcctgtcctggctgctgcggctggccaccttctgccacctgactgtgctgctggccggccagcaccacggcgtgaccaagtgcaacatcacctgcagcaagatgaccagcaagatccctgtggccctgctgatccactaccagcagaaccaggccagctgtgggaagagggccatcatcctggagacccggcagcacaggctcttctgtgccgaccccaaggagcagtgggtgaaggatgccatgcagcacctggaccggcaggccgccgccctgaccagaaatggaggcacctttgagaagcagattggagaggtgaagcccaggaccaccccagctgctgggggcatggatgagagcgtggtgctggagcctgaggccaccggggagagcagcagcctggagcccacccccagcagccaggaggcccagagggccctgggcaccagccctgagctgcccactggagtgacaggcagcagcggcacccggctgccccccacccccaaggcccaggacggcggccctgtgggcacagagctgttccgggtgccccctgtgtccacagctgccacctggcagagcagcgccccccaccagcccggccccagcctgtgggccgaggccaagaccagcgaggcccccagcacccaggaccccagcacccaggccagcacagccagcagccctgcccctgaggagaatgcccccagcgagggccagagggtgtggggccagggccagagccccaggcctgagaacagcctggagcgggaggagatgggccctgtgcctgcccacacagatgccttccaggactggggccctggctccatggcccacgtgtctgtggtgcctgtgtcctctgagggcacccccagccgggagcctgtggccagcggctcctggacccccaaggccgaggagcccatccacgccaccatggacccccagaggctgggcgtgctgatcacccctgtgcctgatgcccaggccgccacccggcggcaggccgtgggcctgctggccttcctgggcctgctcttctgcctgggcgtggccatgttcacctaccagagcctgcagggctgccccaggaagatggccggggagatggccgagggcctgcgctacatccccaggagctgtggcagcaacagctatgtgctggtgcctgtgtag

SEQ ID NO: 147267 - DNA, 1164 bp, Artificial Sequence
  Description of Artificial Sequence: Synthetic coding sequence
atgagggagcccctggaggccttcaagctggccgacctggacttcaggaagagcagcctggccagcggctggaggatggccagcggggccttcaccatggaccagtttcctgagagcgtgacagagaactttgaatatgatgacctggccgaggcctgctacatcggggacatcgtggtgtttggaacagtgttcctgagcatcttctacagcgtcatctttgccatcggcctggtgggcaacctgctggtggtgtttgccctgaccaacagcaagaagcccaagtctgtgacagacatctacctgctgaacctggccctgagtgacctgctgtttgtggccaccctgcccttctggacccactacctgatcaatgagaagggcctgcacaatgccatgtgcaagttcaccacagccttcttcttcatcggcttcttcggcagcatcttcttcatcaccgtcatcagcattgaccgctacctggccatcgtgctggccgccaacagcatgaacaacagaacagtgcagcacggcgtgaccatcagcctgggcgtgtgggccgccgccatcctggtggccgccccccagttcatgttcaccaagcagaaggaaaatgaatgtctgggggactacccagaggtgctgcaggagatctggcctgtgctgagaaatgtggagaccaacttcctgggcttcctgctgcccctgctgatcatgagctactgctacttccgcatcatccagaccctcttcagctgcaagaaccacaagaaggccaaggccatcaagctgatcctgctggtggtgattgtgttcttcctgttctggaccccctacaacgtgatgatcttcctggagaccctgaagctgtatgacttcttccccagctgtgacatgaggaaggacctgcggctggccctgtctgtgacagagaccgtggccttcagccactgctgcctgaaccccctcatctatgcctttgctggggagaagttccgccgctacctgtaccacctgtatggcaagtgcctggccgtgctgtgtggccgctctgtgcacgtggacttcagcagcagcgagagccagaggagccgccacggctctgtgctgagcagcaacttcacctaccacaccagtgatggagatgccctgctgctgctgtag

SEQ ID NO: 147268 - DNA, 1068 bp, Artificial Sequence
  Description of Artificial Sequence: Synthetic coding sequence
atggaccagtttcctgagagcgtgacagagaactttgaatatgatgacctggccgaggcctgctacatcggggacatcgtggtgtttggaacagtgttcctgagcatcttctacagcgtcatctttgccatcggcctggtgggcaacctgctggtggtgtttgccctgaccaacagcaagaagcccaagtctgtgacagacatctacctgctgaacctggccctgagtgacctgctgtttgtggccaccctgcccttctggacccactacctgatcaatgagaagggcctgcacaatgccatgtgcaagttcaccacagccttcttcttcatcggcttcttcggcagcatcttcttcatcaccgtcatcagcattgaccgctacctggccatcgtgctggccgccaacagcatgaacaacagaacagtgcagcacggcgtgaccatcagcctgggcgtgtgggccgccgccatcctggtggccgccccccagttcatgttcaccaagcagaaggaaaatgaatgtctgggggactacccagaggtgctgcaggagatctggcctgtgctgagaaatgtggagaccaacttcctgggcttcctgctgcccctgctgatcatgagctactgctacttccgcatcatccagaccctcttcagctgcaagaaccacaagaaggccaaggccatcaagctgatcctgctggtggtgattgtgttcttcctgttctggaccccctacaacgtgatgatcttcctggagaccctgaagctgtatgacttcttccccagctgtgacatgaggaaggacctgcggctggccctgtctgtgacagagaccgtggccttcagccactgctgcctgaaccccctcatctatgcctttgctggggagaagttccgccgctacctgtaccacctgtatggcaagtgcctggccgtgctgtgtggccgctctgtgcacgtggacttcagcagcagcgagagccagaggagccgccacggctctgtgctgagcagcaacttcacctaccacaccagtgatggagatgccctgctgctgctgtag

SEQ ID NO: 147269 - DNA, 321 bp, Artificial Sequence
  Description of Artificial Sequence: Synthetic coding sequence
atggaccagtttcctgagagcgtgacagagaactttgaatatgatgacctggccgaggcctgctacatcggggacatcgtggtgtttggaacagtgttcctgagcatcttctacagcgtcatctttgccatcggcctggtgggcaacctgctggtggtgtttgccctgaccaacagcaagaagcccaagtctgtgacagacatctacctgctgaacctggccctgagtgacctgctgtttgtggccaccctgcccttctggacccactacctgatcaatgagaagggcctgcacaatgccatgtgcaagttcaccacctag

SEQ ID NO: 147270 - DNA, 501 bp, Artificial Sequence
  Description of Artificial Sequence: Synthetic coding sequence
atggaccagtttcctgagagcgtgacagagaactttgaatatgatgacctggccgaggcctgctacatcggggacatcgtggtgtttggaacagtgttcctgagcatcttctacagcgtcatctttgccatcggcctggtgggcaacctgctggtggtgtttgccctgaccaacagcaagaagcccaagtctgtgacagacatctacctgctgaacctggccctgagtgacctgctgtttgtggccaccctgcccttctggacccactacctgatcaatgagaagggcctgcacaatgccatgtgcaagttcaccacagccttcttcttcatcggcttcttcggcagcatcttcttcatcaccgtcatcagcattgaccgctacctggccatcgtgctggccgccaacagcatgaacaacagaacagtgcagcacggcgtgaccatcagcctgggcgtgtgggccgccgccatcctggtggccgccccccagttcatgtag

SEQ ID NO: 147271 - DNA, 1092 bp, Artificial Sequence
  Description of Artificial Sequence: Synthetic coding sequence
atggccagcggcaaggccttcaccatggaccagtttcctgagagcgtgacagagaactttgaatatgatgacctggccgaggcctgctacatcggggacatcgtggtgtttggaacagtgttcctgagcatcttctacagcgtcatctttgccatcggcctggtgggcaacctgctggtggtgtttgccctgaccaacagcaagaagcccaagtctgtgacagacatctacctgctgaacctggccctgagtgacctgctgtttgtggccaccctgcccttctggacccactacctgatcaatgagaagggcctgcacaatgccatgtgcaagttcaccacagccttcttcttcatcggcttcttcggcagcatcttcttcatcaccgtcatcagcattgaccgctacctggccatcgtgctggccgccaacagcatgaacaacagaacagtgcagcacggcgtgaccatcagcctgggcgtgtgggccgccgccatcctggtggccgccccccagttcatgttcaccaagcagaaggaaaatgaatgtctgggggactacccagaggtgctgcaggagatctggcctgtgctgagaaatgtggagaccaacttcctgggcttcctgctgcccctgctgatcatgagctactgctacttccgcatcatccagaccctcttcagctgcaagaaccacaagaaggccaaggccatcaagctgatcctgctggtggtgattgtgttcttcctgttctggaccccctacaacgtgatgatcttcctggagaccctgaagctgtatgacttcttccccagctgtgacatgaggaaggacctgcggctggccctgtctgtgacagagaccgtggccttcagccactgctgcctgaaccccctcatctatgcctttgctggggagaagttccgccgctacctgtaccacctgtatggcaagtgcctggccgtgctgtgtggccgctctgtgcacgtggacttcagcagcagcgagagccagaggagccgccacggctctgtgctgagcagcaacttcacctaccacaccagtgatggagatgccctgctgctgctgtag

SEQ ID NO: 147272 - DNA, 1068 bp, Artificial Sequence; identical to SEQ ID NO: 147268
  Description of Artificial Sequence: Synthetic coding sequence

SEQ ID NO: 147273 - DNA, 1068 bp, Artificial Sequence; identical to SEQ ID NO: 147268
  Description of Artificial Sequence: Synthetic coding sequence

SEQ ID NO: 147274 - DNA, 324 bp, Artificial Sequence
  Description of Artificial Sequence: Synthetic coding sequence
atggcccgggccgccctgtctgctgcccccagcaacccccggctgctgcgggtggccctgctgctgctgctgctggtggccgccggccggcgggctgctggggcctctgtggccacagagctgcgctgccagtgcctgcagaccctgcagggcatccaccccaagaacatccagagcgtgaatgtgaagagccctggcccccactgtgcccagacagaggtgattgccaccctgaagaatggaaggaaggcctgcctgaacccagccagccccatcgtgaagaagatcatcgagaagatgctgaacagcgacaagagcaactag

SEQ ID NO: 147275 - DNA, 285 bp, Artificial Sequence
  Description of Artificial Sequence: Synthetic coding sequence
atgtctgtgaagggcatggccatcgccctggccgtcatcctgtgtgccaccgtggtgcagggcttccccatgttcaagaggggccgctgcctgtgcatcggccctggggtgaaggctgtgaaggtggccgacatcgagaaggccagcatcatgtaccccagcaacaactgtgacaagattgaggtgatcatcaccctgaaggagaacaagggccagcgctgcctgaaccccaagagcaagcaggcccggctcatcatcaagaaggtggagaggaagaacttctag

SEQ ID NO: 147276 - DNA, 285 bp, Artificial Sequence; identical to SEQ ID NO: 147275
  Description of Artificial Sequence: Synthetic coding sequence

SEQ ID NO: 147277 - DNA, 336 bp, Artificial Sequence
  Description of Artificial Sequence: Synthetic coding sequence
atgagcctgctgccccggcgggcccctcctgtgtccatgaggctgctggccgccgccctgctgctgctgctgctggccctgtacacagcccgggtggatggcagcaagtgcaagtgcagcaggaagggccccaagatccgctacagtgatgtgaagaagctggagatgaagcccaagtacccccactgtgaggagaagatggtgatcatcaccaccaagtctgtgagccgctaccggggccaggagcactgcctgcaccccaagctgcagagcaccaagcgcttcatcaagtggtacaatgcctggaatgagaagagaagagtgtatgaggagtag

SEQ ID NO: 147278 - DNA, 300 bp, Artificial Sequence
  Description of Artificial Sequence: Synthetic coding sequence
atgaggctgctggccgccgccctgctgctgctgctgctggccctgtacacagcccgggtggatggcagcaagtgcaagtgcagcaggaagggccccaagatccgctacagtgatgtgaagaagctggagatgaagcccaagtacccccactgtgaggagaagatggtgatcatcaccaccaagtctgtgagccgctaccggggccaggagcactgcctgcaccccaagctgcagagcaccaagcgcttcatcaagtggtacaatgcctggaatgagaagagaagagtgtatgaggagtag

SEQ ID NO: 147279 - DNA, 822 bp, Artificial Sequence
  Description of Artificial Sequence: Synthetic coding sequence
atgagcggcagccagagcgaggtggcccccagcccccagagccccaggagccctgagatgggccgggacctgcggcccggcagccgggtgctgctgctgctgctgctgctgctgctggtgtacctgacccagcctggaaatggaaatgaaggctctgtgacaggcagctgctactgcggcaagaggatcagcagtgacagcccccccagcgtgcagttcatgaaccggctgaggaagcacctgcgggcctaccaccgctgcctgtactacacccgcttccagctgctgtcctggagcgtgtgtggcggcaacaaggacccctgggtgcaggagctgatgagctgcctggacctgaaggaatgtggccacgcctacagcggcatcgtggcccaccagaagcacctgctgcccaccagcccccccatcagccaggccagcgagggcgccagcagtgacatccacaccccagcccagatgctgctgagcaccctgcagagcacccagaggcccaccctgcctgtgggcagcctgagcagtgacaaggagctgacccggcccaatgagaccaccatccacacagctggccacagcctggccgccggccctgaggccggggagaaccagaagcagcctgagaagaatgccggccccacagcccggaccagcgccaccgtgcctgtgctgtgcctgctggccatcatcttcatcctgacagctgccctgtcctatgtgctgtgcaagagaagaagaggccagagcccccagagcagcccagacctgcctgtgcactacatccctgtggccccagacagcaacacctag

SEQ ID NO: 147280 - DNA, 822 bp, Artificial Sequence; identical to SEQ ID NO: 147279
  Description of Artificial Sequence: Synthetic coding sequence

SEQ ID NO: 147281 - DNA, 360 bp, Artificial Sequence
  Description of Artificial Sequence: Synthetic coding sequence
atgaaggtgctgatcagcagcctgctgctgctgctgcccctgatgctgatgtccatggtgagcagcagcctgaaccctggggtggcccggggccaccgggaccggggccaggccagccgccgctggctgcaggagggcggccaggagtgtgagtgcaaggactggttcctgcgggcccccaggaggaagttcatgacagtgtctggcctgcccaagaagcagtgcccctgtgaccacttcaagggaaatgtgaagaagaccaggcaccagaggcaccacaggaagcccaacaagcacagccgggcctgccagcagttcctgaagcagtgccagctgcggagctttgccctgcccctgtag

SEQ ID NO: 147282 - DNA, 360 bp, Artificial Sequence; identical to SEQ ID NO: 147281
  Description of Artificial Sequence: Synthetic coding sequence

SEQ ID NO: 147283 - DNA, 324 bp, Artificial Sequence
  Description of Artificial Sequence: Synthetic coding sequence
atggcccgggccaccctgtctgctgcccccagcaacccccggctgctgcgggtggccctgctgctgctgctgctggtggccgccagccggcgggctgctggggcccccctggccacagagctgcgctgccagtgcctgcagaccctgcagggcatccacctgaagaacatccagagcgtgaaggtgaagagccctggcccccactgtgcccagacagaggtgattgccaccctgaagaatggccagaaggcctgcctgaacccagccagccccatggtgaagaagatcatcgagaagatgctgaagaatggcaagagcaactag

SEQ ID NO: 147284 - DNA, 324 bp, Artificial Sequence
  Description of Artificial Sequence: Synthetic coding sequence
atggcccacgccaccctgtctgctgcccccagcaacccccggctgctgcgggtggccctgctgctgctgctgctggtggccgccagccggcgggctgctggggcctctgtggtgacagagctgcgctgccagtgcctgcagaccctgcagggcatccacctgaagaacatccagagcgtgaatgtgcgcagccctggcccccactgtgcccagacagaggtgattgccaccctgaagaatggcaagaaggcctgcctgaacccagccagccccatggtgcagaagatcatcgagaagatcctgaacaagggcagcaccaactag

SEQ ID NO: 147285 - DNA, 345 bp, Artificial Sequence
  Description of Artificial Sequence: Synthetic coding sequence
atgagcctgctgagcagccgggccgcccgggtgcccggccccagcagcagcctgtgtgccctgctggtgctgctgctgctgctgacccagcccggccccatcgccagcgctggccctgctgctgctgtgctgcgggagctgcgctgtgtgtgcctgcagaccacccagggcgtgcaccccaagatgatcagcaacctgcaggtgtttgccatcggcccccagtgcagcaaggtggaggtggtggccagcctgaagaatggcaaggagatctgcctggaccctgaggcccccttcctgaagaaggtgatccagaagatcctggatggcggcaacaaggaaaattag

SEQ ID NO: 147286 - DNA, 1053 bp, Artificial Sequence
  Description of Artificial Sequence: Synthetic coding sequence
atgagcaacatcacagacccccagatgtgggactttgatgacctgaacttcaccggcatgcccccagcagatgaggactacagcccctgcatgctggagacagagaccctgaacaagtatgtggtgatcatcgcctatgccctggtgttcctgctgagcctgctgggcaacagcctggtgatgctggtgatcctgtacagccgggtgggccgctctgtgacagatgtgtacctgctgaacctggccctggccgacctgctgtttgccctgaccctgcccatctgggccgccagcaaggtgaatggctggatcttcggcaccttcctgtgcaaggtggtgtccctgctgaaggaggtgaacttctacagcggcatcctgctgctggcctgcatctctgtggaccgctacctggccatcgtgcacgccaccaggaccctgacccagaagaggcacctggtgaagtttgtgtgcctgggctgctggggcctgtccatgaacctgagcctgcccttcttcctgttccggcaggcctaccaccccaacaacagcagccctgtgtgctatgaggtgctgggcaatgacacagccaagtggaggatggtgctgcgcatcctgccccacaccttcggcttcatcgtgcccctgtttgtgatgctgttctgctacggcttcaccctgcggaccctcttcaaggcccacatgggccagaagcaccgggccatgagggtcatctttgctgtggtgctgatcttcctgctgtgctggctgccctacaacctggtgctgctggccgacaccctgatgaggacccaggtgatccaggagagctgtgaaagaagaaacaacatcggccgggccctggatgccacagagatcctgggcttcctgcacagctgcctgaaccccatcatctatgccttcatcggccagaacttccgccacggcttcctgaagatcctggccatgcacggcctggtgtccaaggagttcctggcccggcaccgggtgaccagctacaccagcagctctgtgaatgtgagcagcaacctgtag

SEQ ID NO: 147287 - DNA, 885 bp, Artificial Sequence
  Description of Artificial Sequence: Synthetic coding sequence
atgagcaacatcacagacccccagatgtgggactttgatgacctgaacttcaccggcatgcccccagcagatgaggactacagcccctgcatgctggagacagagaccctgaacaagtatgtggtgatcatcgcctatgccctggtgttcctgctgagcctgctgggcaacagcctggtgatgctggtgatcctgtacagccgggtgggccgctctgtgacagatgtgtacctgctgaacctggccatcgtgcacgccaccaggaccctgacccagaagaggcacctggtgaagtttgtgtgcctgggctgctggggcctgtccatgaacctgagcctgcccttcttcctgttccggcaggcctaccaccccaacaacagcagccctgtgtgctatgaggtgctgggcaatgacacagccaagtggaggatggtgctgcgcatcctgccccacaccttcggcttcatcgtgcccctgtttgtgatgctgttctgctacggcttcaccctgcggaccctcttcaaggcccacatgggccagaagcaccgggccatgagggtcatctttgctgtggtgctgatcttcctgctgtgctggctgccctacaacctggtgctgctggccgacaccctgatgaggacccaggtgatccaggagagctgtgaaagaagaaacaacatcggccgggccctggatgccacagagatcctgggcttcctgcacagctgcctgaaccccatcatctatgccttcatcggccagaacttccgccacggcttcctgaagatcctggccatgcacggcctggtgtccaaggagttcctggcccggcaccgggtgaccagctacaccagcagctctgtgaatgtgagcagcaacctgtag

SEQ ID NO: 147288 - DNA, 804 bp, Artificial Sequence
  Description of Artificial Sequence: Synthetic coding sequence
atggtgctggaggtgtctgaccaccaggtgctgaatgatgctgaggtggccgccctgctggagaacttcagcagcagctatgactatggagaaaatgaaagtgacagctgctgcaccagccccccctgcccccaggacttcagcctgaactttgaccgggccttcctgcctgccctgtacagcctgctcttcctgctgggcctgctgggcaatggagctgtggccgctgtgctgctgagcagaagaacagccctgagcagcacagacaccttcctgctgcacctggccgtggccgacaccctgctggtgctgaccctgcccctgtgggccgtggatgctgctgtgcagtgggtgtttggaagtggcctgtgcaaggtggccggggccctcttcaacatcaacttctacgccggggccctgctgctggcctgcatcagctttgaccgctacctgaacatcgtgcacgccacccagctgtacagaagaggccccccagcccgggtgaccctgacctgcctggccgtgtggggcctgtgcctgctgtttgccctgcctgacttcatcttcctgagcgcccaccatgatgagcggctgaatgccacccactgccagtacaacttcccccagggcagcagcagcggcagcggctgcggctgctgcagctgtgcctgggccgcccccacccgggagggcagccggggcagccaccggctgcctgctggcatccaccctggcctgcggccccagaggcctcccacccgggcctgtgaggccggcatccgggcccccctgagccccacctag

SEQ ID NO: 147289 - DNA, 1248 bp, Artificial Sequence
  Description of Artificial Sequence: Synthetic coding sequence
atggagctgaggaaatatggccctggccgcctggccggcaccgtcatcggcggggccgcccagagcaagagccagaccaagagtgacagcatcaccaaggagttcctgcccggcctgtacacagcccccagcagccccttcccccccagccaggtgtctgaccaccaggtgctgaatgatgctgaggtggccgccctgctggagaacttcagcagcagctatgactatggagaaaatgaaagtgacagctgctgcaccagccccccctgcccccaggacttcagcctgaactttgaccgggccttcctgcctgccctgtacagcctgctcttcctgctgggcctgctgggcaatggagctgtggccgctgtgctgctgagcagaagaacagccctgagcagcacagacaccttcctgctgcacctggccgtggccgacaccctgctggtgctgaccctgcccctgtgggccgtggatgctgctgtgcagtgggtgtttggcagcggcctgtgcaaggtggccggggccctcttcaacatcaacttctacgccggggccctgctgctggcctgcatcagctttgaccgctacctgaacatcgtgcacgccacccagctgtaccgccggggccccccagcccgggtgaccctgacctgcctggccgtgtggggcctgtgcctgctgtttgccctgcctgacttcatcttcctgagcgcccaccatgatgagcggctgaatgccacccactgccagtacaacttcccccaggtgggccgcacagccctgcgggtgctgcagctggtggccggcttcctgctgcccctgctggtgatggcctactgctacgcccacatcctggccgtgctgctggtgtcccggggccagaggcggctgcgggccatgaggctggtggtggtggtggtggtggcctttgccctgtgctggaccccctaccacctggtggtgctggtggacatcctgatggacctgggcgccctggccaggaactgtggccgggagagccgggtggatgtggccaagtctgtgaccagcggcctgggctacatgcactgctgcctgaaccccctgctgtatgcctttgtgggcgtgaagttccgggagaggatgtggatgctgctgctgcggctgggctgccccaaccagaggggcctgcagaggcagcccagcagcagcagaagagacagctcctggagcgagaccagcgaggccagctacagcggcctgtag

SEQ ID NO: 147290 - DNA, 1107 bp, Artificial Sequence
  Description of Artificial Sequence: Synthetic coding sequence
atggtgctggaggtgtctgaccaccaggtgctgaatgatgctgaggtggccgccctgctggagaacttcagcagcagctatgactatggagaaaatgaaagtgacagctgctgcaccagccccccctgcccccaggacttcagcctgaactttgaccgggccttcctgcctgccctgtacagcctgctcttcctgctgggcctgctgggcaatggagctgtggccgctgtgctgctgagcagaagaacagccctgagcagcacagacaccttcctgctgcacctggccgtggccgacaccctgctggtgctgaccctgcccctgtgggccgtggatgctgctgtgcagtgggtgtttggaagtggcctgtgcaaggtggccggggccctcttcaacatcaacttctacgccggggccctgctgctggcctgcatcagctttgaccgctacctgaacatcgtgcacgccacccagctgtacagaagaggccccccagcccgggtgaccctgacctgcctggccgtgtggggcctgtgcctgctgtttgccctgcctgacttcatcttcctgagcgcccaccatgatgagcggctgaatgccacccactgccagtacaacttcccccaggtgggccgcacagccctgcgggtgctgcagctggtggccggcttcctgctgcccctgctggtgatggcctactgctacgcccacatcctggccgtgctgctggtgtcccggggccagaggcggctgcgggccatgaggctggtggtggtggtggtggtggcctttgccctgtgctggaccccctaccacctggtggtgctggtggacatcctgatggacctgggcgccctggccaggaactgtggccgggagagccgggtggatgtggccaagtctgtgaccagcggcctgggctacatgcactgctgcctgaaccccctgctgtatgcctttgtgggcgtgaagttccgggagaggatgtggatgctgctgctgcggctgggctgccccaaccagaggggcctgcagaggcagcccagcagcagccggcgggacagctcctggagcgagaccagcgaggccagctacagcggcctgtag

SEQ ID NO: 147291 - DNA, 1119 bp, Artificial Sequence
  Description of Artificial Sequence: Synthetic coding sequence
atgaactaccccctgaccctggagatggacctggagaacctggaggacctcttctgggagctggaccggctggacaactacaatgacaccagcctggtggagaaccacctgtgcccagccacagagggccccctgatggccagcttcaaggctgtgtttgtgcctgtggcctacagcctcatcttcctgctgggcgtgattggaaatgtgctggtgctggtgatcctggagcggcaccggcagaccaggagcagcacagagaccttcctgttccacctggccgtggccgacctgctgctggtgttcatcctgccctttgctgtggccgagggctctgtgggctgggtgctgggcaccttcctgtgcaagacagtcatcgccctgcacaaggtgaacttctactgcagcagcctgctgctggcctgcatcgctgtggaccgctacctggccatcgtgcatgctgtgcacgcctaccgccaccggcggctgctgagcatccacatcacctgtggcaccatctggctggtgggcttcctgctggccctgcctgagatcctgtttgccaaggtgtcccagggccaccacaacaacagcctgccccgctgcaccttcagccaggagaaccaggccgagacccacgcctggttcaccagccgcttcctgtaccacgtggccggcttcctgctgcccatgctggtgatgggctggtgctacgtgggcgtggtgcaccggctgcggcaggcccagaggcggccccagaggcagaaggctgtgcgggtggccatcctggtgaccagcatcttcttcctgtgctggagcccctaccacatcgtcatcttcctggacaccctggcccggctgaaggctgtggacaacacctgcaagctgaatggcagcctgcctgtggccatcaccatgtgtgagttcctgggcctggcccactgctgcctgaaccccatgctgtacacctttgctggggtgaagttcagaagtgacctgagccggctgctgaccaagctgggctgcaccggccctgccagcctgtgccagctgttccccagctggaggaggagcagcctgtctgagagtgaaaatgccaccagcctgaccaccttctag

SEQ ID NO: 147292 - DNA, 1029 bp, Artificial Sequence
  Description of Artificial Sequence: Synthetic coding sequence
atggccgagcatgactaccacgaggactatggcttcagcagcttcaatgacagcagccaggaggagcaccaggacttcctgcagttcagcaaggtgttcctgccctgcatgtacctggtggtgtttgtgtgtggcctggtgggcaacagcctggtgctggtgatcagcatcttctaccacaagctgcagagcctgacagatgtgttcctggtgaacctgcccctggccgacctggtgtttgtgtgcaccctgcccttctgggcctatgccggcatccacgagtgggtgtttggccaggtgatgtgcaagagcctgctgggcatctacaccatcaacttctacacctccatgctgatcctgacctgcatcaccgtggaccgcttcatcgtggtggtgaaggccaccaaggcctacaaccagcaggccaagaggatgacctggggcaaggtgaccagcctgctgatctgggtgatcagcctgctggtgtccctgccccagatcatctatggaaatgtgttcaacctggacaagctgatctgtggctaccatgatgaggccatcagcacagtggtgctggccacccagatgaccctgggcttcttcctgcccctgctgaccatgattgtgtgctacagcgtcatcatcaagaccctgctgcatgctgggggcttccagaagcacaggagcctgaagatcatcttcctggtgatggctgtgttcctgctgacccagatgcccttcaacctgatgaagttcatccgcagcacccactgggagtactatgccatgaccagcttccactacaccatcatggtgacagaggccatcgcctacctgcgggcctgcctgaaccctgtgctgtatgcctttgtgtccctgaagttcaggaagaacttctggaagctggtgaaggacatcggctgcctgccctacctgggcgtgagccaccagtggaagagcagcgaggacaacagcaagaccttcagcgccagccacaacgtggaggccacctccatgttccagctgtag

SEQ ID NO: 147293 - DNA, 1029 bp, Artificial Sequence; identical to SEQ ID NO: 147292
  Description of Artificial Sequence: Synthetic coding sequence

SEQ ID NO: 147294 - DNA, 1029 bp, Artificial Sequence; identical to SEQ ID NO: 147292
  Description of Artificial Sequence: Synthetic coding sequence

SEQ ID NO: 147295 - DNA, 1029 bp, Artificial Sequence; identical to SEQ ID NO: 147292
  Description of Artificial Sequence: Synthetic coding sequence

SEQ ID NO: 147296 - DNA, 1089 bp, Artificial Sequence
  Description of Artificial Sequence: Synthetic coding sequence
atggacctgcacctgtttgactacagcgagcccggcaacttcagtgacatctcctggccctgcaacagcagtgactgcatcgtggtggacacagtgatgtgccccaacatgcccaacaagtctgtgctgctgtacaccctgtccttcatctacatcttcatctttgtgattggcatgattgccaacagcgtggtggtgtgggtgaacatccaggccaagaccaccggctatgacacccactgctacatcctgaacctggccatcgctgacctgtgggtggtgctgaccatccctgtgtgggtggtgtccctggtgcagcacaaccagtggcccatgggagagctgacctgcaaggtgacccacctgatcttcagcatcaacctgtttggcagcatcttcttcctgacctgcatgtctgtggaccgctacctgagcatcacctacttcaccaacacccccagcagcaggaagaagatggtgagaagagtggtgtgcatcctggtgtggctgctggccttctgtgtgtccctgcctgacacctactacctgaagacagtgaccagcgccagcaacaatgagacctactgccgctccttctacccagagcacagcatcaaggagtggctgattggcatggagctggtgtctgtggtgctgggctttgctgtgcccttcagcatcatcgctgtgttctacttcctgctggcccgggccatcagcgccagcagtgaccaggagaagcacagcagcaggaagatcatcttctcctatgtggtggtgttcctggtgtgctggctgccctaccacgtggccgtgctgctggacatcttcagcatcctgcactacatccccttcacctgccgcctggagcacgccctcttcaccgccctgcacgtgacccagtgcctgagcctggtgcactgctgcgtgaaccctgtgctgtacagcttcatcaacagaaactaccgctatgagctgatgaaggccttcatcttcaagtacagcgccaagacaggcctgaccaagctgattgatgccagccgggtgtctgaaacagagtacagcgccctggagcagagcaccaagtag

SEQ ID NO: 147297 - DNA, 636 bp, Artificial Sequence
  Description of Artificial Sequence: Synthetic coding sequence
atggacctgcacctgtttgactacagcgagcccggcaacttcagtgacatctcctggccctgcaacagcagtgactgcatcgtggtggacacagtgatgtgccccaacatgcccaacaagtctgtgctgctgtacaccctgtccttcatctacatcttcatctttgtgattggcatgattgccaacagcgtggtggtgtgggtgaacatccaggccaagaccaccggctatgacacccactgctacatcctgaacctggccatcgctgacctgtgggtggtgctgaccatccctgtgtgggtggtgtccctggtgcagcacaaccagtggcccatgggagagctgacctgcaaggtgacccacctgatcttcagcatcaacctgtttggcagcatcttcttcctgacctgcatgtctgtggaccgctacctgagcatcacctacttcaccaacacccccagcagcaggaagaagatggtgagaagagtggtgtgcatcctggtgtggctgctggccttctgtgtgtccctgcctgacacctactacctgaagacagtgaccagcgccagcaacaatgagacctactgccgctccttctacccagagcacagcatcaaggagtggctgattggatag

SEQ ID NO: 147298 - DNA, 1155 bp, Artificial Sequence
  Description of Artificial Sequence: Synthetic coding sequence
atggccgccacagccagcccccagcccctggccacagaagatgctgacagcgagaacagcagcttctactactatgactacctggatgaggtggccttcatgctgtgcaggaaggatgctgtggtgtcctttgggaaggtgttcctgcccgtcttctacagcctcatctttgtgctgggcctgagcggcaacctgctgctgctgatggtgctgctgcgctacgtgcccaggaggaggatggtggagatctacctgctgaacctggccatcagcaacctgctcttcctggtgaccctgcccttctggggcatctctgtggcctggcactgggtgtttggcagcttcctgtgcaagatggtgtccaccctgtacaccatcaacttctacagcggcatcttcttcatcagctgcatgagcctggacaagtacctggagatcgtgcacgcccagccctaccaccggctgcggacccgggccaagagcctgctgctggccaccatcgtgtgggccgtgtccctggccgtgtccatcccagacatggtgtttgtgcagacccatgagaaccccaagggcgtgtggaactgccacgccgactttggaggccacggcaccatctggaagctgttcctgcgcttccagcagaacctgctgggcttcctgctgcccctgctggccatgatcttcttctacagcagaattggctgtgtgctggtgcggctgcggcctgctggccagggccgggccctgaagattgctgctgccctggtggtggccttctttgtgctgtggttcccctacaacctgaccctcttcctgcacaccctgctggacctgcaggtgtttggaaactgtgaggtgtcccagcacctggactatgccctgcaggtgacagagagcatcgccttcctgcactgctgcttcagccccatcctgtatgccttcagcagccaccgcttccggcagtacctgaaggccttcctggccgctgtgctgggctggcacctggcccctggaacagcccaggccagcctgagcagctgcagcgagagcagcatcctgacagcccaggaggagatgacaggcatgaatgacctgggggagcggcagagcgagaactaccccaacaaggaggatgtgggcaacaagagcgcctag

SEQ ID NO: 147299 - DNA, 1155 bp, Artificial Sequence; identical to SEQ ID NO: 147298
  Description of Artificial Sequence: Synthetic coding sequence

SEQ ID NO: 147300 - DNA, 1155 bp, Artificial Sequence; identical to SEQ ID NO: 147298
  Description of Artificial Sequence: Synthetic coding sequence

SEQ ID NO: 147301 - DNA, 1122 bp, Artificial Sequence
  Description of Artificial Sequence: Synthetic coding sequence
atgaggatggaggatgaggactacaacaccagcatctcctatggagatgagtacccagactacctggacagcatcgtggtgctggaggacctgagccccctggaggcccgggtgacccgcatcttcctggtggtggtgtacagcatcgtgtgcttcctgggcatcctgggcaatggcctggtgatcatcatcgccaccttcaagatgaagaagacagtgaacatggtgtggttcctgaacctggccgtggccgacttcctgttcaacgtgttcctgcccatccacatcacctatgctgccatggactaccactgggtgtttggaacagccatgtgcaagatcagcaacttcctgctgatccacaacatgttcaccagcgtcttcctgctgaccatcatcagcagtgaccgctgcatctctgtgctgctgcctgtgtggagccagaaccacaggtctgtgcggctggcctacatggcctgcatggtgatctgggtgctggccttcttcctgagcagccccagcctggtgttccgggacacagccaacctgcacggcaagatcagctgcttcaacaacttcagcctgagcaccccaggcagcagctcctggcccacccacagccagatggaccctgtgggctacagccgccacatggtggtgacagtgacccgcttcctgtgtggcttcctggtgcctgtgctgatcatcacagcctgctacctgaccatcgtgtgcaagctgcagaggaaccggctggccaagaccaagaagcccttcaagatcatcgtgaccatcatcatcaccttcttcctgtgctggtgcccctaccacaccctgaacctgctggagctgcaccacacagccatgcctggcagcgtcttcagcctgggcctgcccctggccacagccctggccatcgccaacagctgcatgaaccccatcctgtatgtgttcatgggccaggacttcaagaagttcaaggtggccctcttcagccggctggtgaatgccctgtctgaggacaccggccacagcagctaccccagccacaggagcttcaccaagatgagctccatgaatgaaagaacctccatgaatgaaagagagaccggcatgctgtag

SEQ ID NO: 147302 - DNA, 1116 bp, Artificial Sequence
  Description of Artificial Sequence: Synthetic coding sequence
atggaggatgaggactacaacaccagcatctcctatggagatgagtacccagactacctggacagcatcgtggtgctggaggacctgagccccctggaggcccgggtgacccgcatcttcctggtggtggtgtacagcatcgtgtgcttcctgggcatcctgggcaatggcctggtgatcatcatcgccaccttcaagatgaagaagacagtgaacatggtgtggttcctgaacctggccgtggccgacttcctgttcaacgtgttcctgcccatccacatcacctatgctgccatggactaccactgggtgtttggaacagccatgtgcaagatcagcaacttcctgctgatccacaacatgttcaccagcgtcttcctgctgaccatcatcagcagtgaccgctgcatctctgtgctgctgcctgtgtggagccagaaccacaggtctgtgcggctggcctacatggcctgcatggtgatctgggtgctggccttcttcctgagcagccccagcctggtgttccgggacacagccaacctgcacggcaagatcagctgcttcaacaacttcagcctgagcaccccaggcagcagctcctggcccacccacagccagatggaccctgtgggctacagccgccacatggtggtgacagtgacccgcttcctgtgtggcttcctggtgcctgtgctgatcatcacagcctgctacctgaccatcgtgtgcaagctgcagaggaaccggctggccaagaccaagaagcccttcaagatcatcgtgaccatcatcatcaccttcttcctgtgctggtgcccctaccacaccctgaacctgctggagctgcaccacacagccatgcctggcagcgtcttcagcctgggcctgcccctggccacagccctggccatcgccaacagctgcatgaaccccatcctgtatgtgttcatgggccaggacttcaagaagttcaaggtggccctcttcagccggctggtgaatgccctgtctgaggacaccggccacagcagctaccccagccacaggagcttcaccaagatgagctccatgaatgaaagaacctccatgaatgaaagagagaccggcatgctgtag

SEQ ID NO: 147303 - DNA, 1122 bp, Artificial Sequence; identical to SEQ ID NO: 147301
  Description of Artificial Sequence: Synthetic coding sequence

SEQ ID NO: 147304 - DNA, 432 bp, Artificial Sequence
  Description of Artificial Sequence: Synthetic coding sequence
atgaggatggaggatgaggactacaacaccagcatctcctatggagatgagtacccagactacctggacagcatcgtggtgctggaggacctgagccccctggaggcccgggtgacccgcatcttcctggtggtggtgtacagcatcgtgtgcttcctgggcatcctgggcaatggcctggtgatcatcatcgccaccttcaagatgaagaagacagtgaacatggtgtggttcctgaacctggccgtggccgacttcctgttcaacgtgttcctgcccatccacatcacctatgctgccatggactaccactgggtgtttggaacagccatgtgcaagatcagcaacttcctgctgatccacaacatgttcaccagcgtcttcctgctgaccatcatcagcagtgaccgctgcatctctgtgctgctgtag

SEQ ID NO: 147305 - DNA, 1122 bp, Artificial Sequence; identical to SEQ ID NO: 147301
  Description of Artificial Sequence: Synthetic coding sequence

SEQ ID NO: 147306 - DNA, 444 bp, Artificial Sequence
  Description of Artificial Sequence: Synthetic coding sequence
atgaggatggaggatgaggactacaacaccagcatctcctatggagatgagtacccagactacctggacagcatcgtggtgctggaggacctgagccccctggaggcccgggtgacccgcatcttcctggtggtggtgtacagcatcgtgtgcttcctgggcatcctgggcaatggcctggtgatcatcatcgccaccttcaagatgaagaagacagtgaacatggtgtggttcctgaacctggccgtggccgacttcctgttcaacgtgttcctgcccatccacatcacctatgctgccatggactaccactgggtgtttggaacagccatgtgcaagatcagcaacttcctgctgatccacaacatgttcaccagcgtcttcctgctgaccatcatcagcagtgaccgctgcatctctgtgctgctgcctgtgtggagctag

SEQ ID NO: 147307 - DNA, 1116 bp, Artificial Sequence; identical to SEQ ID NO: 147302
  Description of Artificial Sequence: Synthetic coding sequence

SEQ ID NO: 147308 - DNA, 1005 bp, Artificial Sequence
  Description of Artificial Sequence: Synthetic coding sequence
atgcccagcaaggagagctggagcggcaggaagaccaacagagctgctgtgcacaagagcaagcaggagggccggcagcaggacctgctgattgctgccctgggcatgaagctgggcagccccaagagctctgtgaccatctggcagcccctgaagctgtttgcctacagccagctgaccagcctggtgcggcgggccaccctgaaggaaaatgagcagatccccaagtatgagaagatccacaacttcaaggtgcacaccttccggggcccccactggtgtgagtactgtgccaacttcatgtggggcctgattgcccagggcgtgaagtgtgccgactgtggcctgaatgtgcacaagcagtgcagcaagatggtgcccaatgactgcaagccagacctgaagcacgtgaagaaggtgtacagctgtgacctgaccaccctggtgaaggcccacaccaccaagaggcccatggtggtggacatgtgcatccgggagattgagagccggggcctgaacagcgagggcctgtacagagtgtctggcttcagtgacctgattgaagatgtgaagatggcctttgacagagatggagagaaggctgacatctctgtgaacatgtatgaggacatcaacatcatcactggagccctgaagctgtacttccgggacctgcccatccccctcatcacctatgatgcctaccccaagttcattgaaagtgccaagatcatggaccctgatgagcagctggagaccctgcacgaggccctgaagctgctgcccccagcccactgtgagaccctgcgctacctgatggcccacctgaagagggtgaccctgcacgagaaggagaacctgatgaatgctgagaacctgggcatcgtgtttggccccaccctgatgaggagccctgagctggatgccatggccgccctgaatgacatccgctaccagaggctggtggtggagctgctgatcaagaatgaagacatcctcttctag

SEQ ID NO: 147309 - DNA, 1302 bp, Artificial Sequence
  Description of Artificial Sequence: Synthetic coding sequence
atggccctgaccctgtttgacacagatgagtacagacctcctgtgtggaagagctacctgtaccagctgcagcaggaggccccccacccccggcgcatcacctgcacctgtgaggtggagaaccggcccaagtactacggccgggagttccacggcatgatcagccgggaggccgctgaccagctgctgattgtggccgagggcagctacctgatccgggagagccagaggcagcccggcacctacaccctggccctgcgcttcggcagccagaccaggaacttccggctgtactatgatggcaagcactttgtgggggagaagagatttgagagcatccatgacctggtgacagatggcctcatcaccctgtacatcgagaccaaggctgctgagtacatcgccaagatgaccatcaaccccatctatgaacatgtgggctacaccaccctgaaccgggagcccgcctacaagaagcacatgcctgtgctgaaggagacccatgatgagcgggacagcacaggccaggatggagtgtctgagaagagggtgcacaccttccggggcccccactggtgtgagtactgtgccaacttcatgtggggcctcatcgcccagggcgtgaagtgtgccgactgtggcctgaatgtgcacaagcagtgcagcaagatggtgcccaatgactgcaagccagacctgaagcacgtgaagaaggtgtacagctgtgacctgaccaccctggtgaaggcccacaccaccaagaggcccatggtggtggacatgtgcatccgggagattgagagccggggcctgaacagcgagggcctgtacagagtgtctggcttcagtgacctgattgaagatgtgaagatggcctttgacagagatggagagaaggctgacatctctgtgaacatgtatgaggacatcaacatcatcaccggggccctgaagctgtacttccgggacctgcccatccccctcatcacctatgatgcctaccccaagttcatcgagagcgccaagatcatggaccctgatgagcagctggagaccctgcacgaggccctgaagctgctgcccccagcccactgtgagaccctgcgctacctgatggcccacctgaagagggtgaccctgcacgagaaggagaacctgatgaatgctgagaacctgggcatcgtgtttggccccaccctgatgaggagccctgagctggatgccatggccgccctgaatgacatccgctaccagaggctggtggtggagctgctgatcaagaatgaagacatcctcttctag

SEQ ID NO: 147310 - DNA, 1380 bp, Artificial Sequence
  Description of Artificial Sequence: Synthetic coding sequence
atggccctgaccctgtttgacacagatgagtacagacctcctgtgtggaagagctacctgtaccagctgcagcaggaggccccccacccccggcgcatcacctgcacctgtgaggtggagaaccggcccaagtactacggccgggagttccacggcatgatcagccgggaggccgctgaccagctgctgattgtggccgagggcagctacctgatccgggagagccagaggcagcccggcacctacaccctggccctgcgcttcggcagccagaccaggaacttccggctgtactatgatggcaagcactttgtgggggagaagagatttgagagcatccatgacctggtgacagatggcctcatcaccctgtacatcgagaccaaggctgctgagtacatcgccaagatgaccatcaaccccatctatgaacatgtgggctacaccaccctgaaccgggagcccgcctacaagaagcacatgcctgtgctgaaggagacccatgatgagcgggacagcacaggccaggatggagtgtctgagaagaggctgaccagcctggtgagaagagccaccctgaaggaaaatgagcagatccccaagtatgagaagatccacaacttcaaggtgcacaccttccggggcccccactggtgtgagtactgtgccaacttcatgtggggcctcatcgcccagggcgtgaagtgtgccgactgtggcctgaatgtgcacaagcagtgcagcaagatggtgcccaatgactgcaagccagacctgaagcacgtgaagaaggtgtacagctgtgacctgaccaccctggtgaaggcccacaccaccaagaggcccatggtggtggacatgtgcatccgggagattgagagccggggcctgaacagcgagggcctgtacagagtgtctggcttcagtgacctgattgaagatgtgaagatggcctttgacagagatggagagaaggctgacatctctgtgaacatgtatgaggacatcaacatcatcaccggggccctgaagctgtacttccgggacctgcccatccccctcatcacctatgatgcctaccccaagttcatcgagagcgccaagatcatggaccctgatgagcagctggagaccctgcacgaggccctgaagctgctgcccccagcccactgtgagaccctgcgctacctgatggcccacctgaagagggtgaccctgcacgagaaggagaacctgatgaatgctgagaacctgggcatcgtgtttggccccaccctgatgaggagccctgagctggatgccatggccgccctgaatgacatccgctaccagaggctggtggtggagctgctgatcaagaatgaagacatcctcttctag

SEQ ID NO: 147311 - DNA, 1167 bp, Artificial Sequence
  Description of Artificial Sequence: Synthetic coding sequence
atgacagcctctgtgctgctgcacccccgctggattgagcccaccgtgatgttcctgtatgacaatggaggcggcctggtggctgatgagctgaacaagaacatggagggcgctgctgctgctgctgctgctgctgctgctgctgctgctgctggagctgggggcggcggcttcccccaccctgctgctgctgctgctgggggcaacttctctgtggccgctgctgctgctgctgctgctgctgctgctgccaaccagtgcaggaacctgatggcccacccagcccccctggcccctggagctgccagcgcctacagcagcgcccctggagaggcccctccttctgctgctgctgctgctgctgctgctgctgctgctgctgctgctgctgctgctgccagcagcagcggcggccctggccctgctggccctgctggagctgaggccgccaagcagtgcagcccctgcagcgctgctgcccagagcagcagcggccctgctgccctgccctacggctacttcggcagcggctactacccctgtgccaggatgggcccccaccccaatgccatcaagagctgtgcccagcctgccagcgctgctgctgctgctgcctttgctgacaagtacatggacacagctggccctgctgctgaggagttcagcagccgggccaaggagtttgccttctaccaccagggctacgccgccggcccctaccaccaccaccagcccatgcctggctacctggacatgcctgtggtgcccggcctgggcggccctggagagagcagacatgagcccctgggcctgcccatggagagctaccagccctgggccctgcccaacggctggaatggccagatgtactgccccaaggagcaggcccagcccccccacctgtggaagagcaccctgcctgatgtggtgagccaccccagtgatgccagcagctaccgccggggcaggaagaagagggtgccctacaccaaggtgcagctgaaggagctggagcgggagtatgccaccaacaagttcatcaccaaggacaagagaagacgcatcagcgccaccaccaacctgtctgagcggcaggtgaccatctggttccagaacagaagagtgaaggagaagaaggtgatcaacaagctgaagaccaccagctag

SEQ ID NO: 147312 - DNA, 999 bp, Artificial Sequence
  Description of Artificial Sequence: Synthetic coding sequence
atgttttctgaggagctgtggctggagaatgagaagaagtgtgctgtggtgaggaagagcaagcagggcaggaagaggcaggagctgctggccgtggccttcggcgtgaaggtgggcgtgaagggcggcttcctgtggccacccctgaagctgtttgcctgcagccagatcagcagcctggtgcggcgggccgccctgacccacaatgacaaccacttcaactatgagaagacccacaacttcaaggtgcacaccttccggggcccccactggtgtgagtactgtgccaacttcatgtggggcctgattgcccagggcgtgcgctgcagcgactgtggcctgaatgtgcacaagcagtgcagcaagcacgtgcccaatgactgccagcctgacctgaagaggatcaagaaggtgtactgctgtgacctgaccaccctggtgaaggcccacaacacccagaggcccatggtggtggacatctgcatccgggagattgaggcccggggcctgaagtctgagggcctgtacagagtgtctggcttcacagagcacattgaagatgtgaagatggcctttgacagagatggagagaaggctgacatcagcgccaacgtgtacccagacatcaacatcatcactggagccctgaagctgtacttccgggacctgcccatccctgtgatcacctatgacacctacagcaagttcattgatgctgccaagatcagcaatgctgatgagcggctggaggccgtgcatgaggtgctgatgctgctgcccccagcccactatgagaccctgcgctacctgatgatccacctgaagaaggtgaccatgaatgagaaggacaacttcatgaatgctgagaacctgggcatcgtgtttggccccaccctgatgaggcctcctgaggacagcaccctgaccaccctgcatgacatgagataccagaagctgattgtgcagatcctgattgaaaatgaagatgtgctcttctag

SEQ ID NO: 147313 - DNA, 525 bp, Artificial Sequence
  Description of Artificial Sequence: Synthetic coding sequence
atggccgccagcagcaacagcagcctgagcggcagctctgtgtcctctgtgtacagcgagcccaggagcccccgggagctgcccaagtatgcagaggagtaccagccccccatctggaagagctacctgtaccagctgcagcaggaggccccccggcccaagaggatcatctgcccccgggaggtggagaaccggcccaagtactacggccgggagttccacggcatcatcagccgggagcaggctgatgagctgctgggcggcgtggagggcgcctacatcctgcgggagagccagaggcagcccggctgctacaccctggccctgcgctttggaaaccagaccctgaactaccgcctcttccatgatggcaagcactttgtgggggagaagagatttgagagcatccatgacctggtgacagatggcctcatcaccctgtacatcgagaccaaggctgctgagtacatcagcaagatgaccaccaaccccatctatgagcacatcggctacgccaccctgtag

SEQ ID NO: 147314 - DNA, 825 bp, Artificial Sequence
  Description of Artificial Sequence: Synthetic coding sequence
atgttttctgaggagctgtggctggagaatgagaagaagtgtgctgtggtgaggaagagcaagcagggcaggaagaggcaggagctgctggccgtggccttcggcgtgaaggtgggcgtgaagggcggcttcctgtggccacccctgaagctgtttgcctgcagccagatcagcagcctggtgcggcgggccgccctgacccacaatgacaaccacttcaactatgagaagacccacaacttcaaggtgcacaccttccggggcccccactggtgtgagtactgtgccaacttcatgtggggcctgattgcccagggcgtgcgctgcagcggcctgaagtctgagggcctgtacagagtgtctggcttcacagagcacattgaagatgtgaagatggcctttgacagagatggagagaaggctgacatcagcgccaacgtgtacccagacatcaacatcatcactggagccctgaagctgtacttccgggacctgcccatccctgtgatcacctatgacacctacagcaagttcattgatgctgccaagatcagcaatgctgatgagcggctggaggccgtgcatgaggtgctgatgctgctgcccccagcccactatgagaccctgcgctacctgatgatccacctgaagaaggtgaccatgaatgagaaggacaacttcatgaatgctgagaacctgggcatcgtgtttggccccaccctgatgaggcctcctgaggacagcaccctgaccaccctgcatgacatgagataccagaagctgattgtgcagatcctgattgaaaatgaagatgtgctcttctag

SEQ ID NO: 147315 - DNA, 864 bp, Artificial Sequence
  Description of Artificial Sequence: Synthetic coding sequence
atgttttctgaggagctgtggctggagaatgagaagaagtgtgctgtggtgaggaagagcaagcagggcaggaagaggcaggagctgctggccgtggccttcggcgtgaaggtgcacaccttccggggcccccactggtgtgagtactgtgccaacttcatgtggggcctcatcgcccagggcgtgcgctgcagcgactgtggcctgaatgtgcacaagcagtgcagcaagcacgtgcccaatgactgccagcctgacctgaagaggatcaagaaggtgtactgctgtgacctgaccaccctggtgaaggcccacaacacccagaggcccatggtggtggacatctgcatccgggagattgaggcccggggcctgaagtctgagggcctgtacagagtgtctggcttcacagagcacattgaagatgtgaagatggcctttgacagagatggagagaaggctgacatcagcgccaacgtgtacccagacatcaacatcatcaccggggccctgaagctgtacttccgggacctgcccatccctgtgatcacctatgacacctacagcaagttcattgatgctgccaagatcagcaatgctgatgagcggctggaggccgtgcatgaggtgctgatgctgctgcccccagcccactatgagaccctgcgctacctgatgatccacctgaagaaggtgaccatgaatgagaaggacaacttcatgaatgctgagaacctgggcatcgtgtttggccccaccctgatgaggcccccagaggacagcaccctgaccaccctgcatgacatgagataccagaagctgattgtgcagatcctgattgaaaatgaagatgtgctcttctag

SEQ ID NO: 147316 - DNA, 579 bp, Artificial Sequence
  Description of Artificial Sequence: Synthetic coding sequence
atggccgccagcagcaacagcagcctgagcggcagctctgtgtccagtgatgctgaggagtaccagccccccatctggaagagctacctgtaccagctgcagcaggaggccccccggcccaagaggatcatctgcccccgggaggtggagaaccggcccaagtactacggccgggagttccacggcatcatcagccgggagcaggctgatgagctgctgggcggcgtggagggcgcctacatcctgcgggagagccagaggcagcccggctgctacaccctggccctgaggaaccccaccaagatcagcaatgctgatgagcggctggaggccgtgcatgaggtgctgatgctgctgcccccagcccactatgagaccctgcgctacctgatgatccacctgaagaaggtgaccatgaatgagaaggacaacttcatgaatgctgagaacctgggcatcgtgtttggccccaccctgatgaggcctcctgaggacagcaccctgaccaccctgcatgacatgagataccagaagctgattgtgcagatcctgattgaaaatgaagatgtgctcttctag

SEQ ID NO: 147317 - DNA, 861 bp, Artificial Sequence
  Description of Artificial Sequence: Synthetic coding sequence
atgttttctgaggagctgtggctggagaatgagaagaagtgtgctgtggtgaggaagagcaagcagggcaggaagaggcaggagctgctggccgtggccttcggcgtgaaggtgggcgtgaagggcggcttcctgtggccacccctgaagctgtttgcctgcagccagatcagcagcctggtgcggcgggccgccctgacccacaatgacaaccacttcaactatgagaagacccacaacttcaaggtgcacaccttccggggcccccactggtgtgagtactgtgccaacttcatgtggggcctgattgcccagggcgtgcgctgcagcgactgtggcctgaatgtgcacaagcagtgcagcaagcacgtgcccaatgactgccagcctgacctgaagaggatcaagaaggtgtactgctgtgacctgaccaccctggtgaaggcccacaacacccagaggcccatggtggtggacatctgcatccgggagattgaggcccggggcctgaagtctgagggcctgtacagagtgtctggcttcacagagcacattgaagatgtgaagatggcctttgaccgggagatcagcaatgctgatgagcggctggaggccgtgcatgaggtgctgatgctgctgcccccagcccactatgagaccctgcgctacctgatgatccacctgaagaaggtgaccatgaatgagaaggacaacttcatgaatgctgagaacctgggcatcgtgtttggccccaccctgatgaggcctcctgaggacagcaccctgaccaccctgcatgacatgagataccagaagctgattgtgcagatcctgattgaaaatgaagatgtgctcttctag

SEQ ID NO: 147318 - DNA, 1446 bp, Artificial Sequence
  Description of Artificial Sequence: Synthetic coding sequence
atggccgccagcagcaacagcagcctgagcggcagctctgtgtcctctgtgtacagcgagcccaggagcccccgggagctgcccaagtatgcagaggagtaccagccccccatctggaagagctacctgtaccagctgcagcaggaggccccccggcccaagaggatcatctgcccccgggaggtggagaaccggcccaagtactacggccgggagttccacggcatcatcagccgggagcaggctgatgagctgctgggcggcgtggagggcgcctacatcctgcgggagagccagaggcagcccggctgctacaccctggccctgcgctttggaaaccagaccctgaactaccgcctcttccatgatggcaagcactttgtgggggagaagagatttgagagcatccatgacctggtgacagatggcctcatcaccctgtacatcgagaccaaggctgctgagtacatcagcaagatgaccaccaaccccatctatgagcacatcggctacgccaccctgctgcgggagaaggtgtcccggcggctgagccgcagcaagaatgagcccaggaagaccaacgtgacccatgaggagcacacagctgtggagaagatcagcagcctggtgagaagagctgccctgacccacaatgacaaccacttcaactatgagaagacccacaacttcaaggtgcacaccttccggggcccccactggtgtgagtactgtgccaacttcatgtggggcctcatcgcccagggcgtgcgctgcagcgactgtggcctgaatgtgcacaagcagtgcagcaagcacgtgcccaatgactgccagcctgacctgaagaggatcaagaaggtgtactgctgtgacctgaccaccctggtgaaggcccacaacacccagaggcccatggtggtggacatctgcatccgggagattgaggcccggggcctgaagtctgagggcctgtacagagtgtctggcttcacagagcacattgaagatgtgaagatggcctttgacagagatggagagaaggctgacatcagcgccaacgtgtacccagacatcaacatcatcaccggggccctgaagctgtacttccgggacctgcccatccctgtgatcacctatgacacctacagcaagttcattgatgctgccaagatcagcaatgctgatgagcggctggaggccgtgcatgaggtgctgatgctgctgcccccagcccactatgagaccctgcgctacctgatgatccacctgaagaaggtgaccatgaatgagaaggacaacttcatgaatgctgagaacctgggcatcgtgtttggccccaccctgatgaggcccccagaggacagcaccctgaccaccctgcatgacatgagataccagaagctgattgtgcagatcctgattgaaaatgaagatgtgctcttctag

SEQ ID NO: 147319 - DNA, 975 bp, Artificial Sequence
  Description of Artificial Sequence: Synthetic coding sequence
atggccgccagcagcaacagcagcctgagcggcagctctgtgtccagtgatgctgaggagtaccagccccccatctggaagagctacctgtaccagctgcagcaggaggccccccggcccaagaggatcatctgcccccgggagatcagcagcctggtgcggcgggccgccctgacccacaatgacaaccacttcaactatgagaagacccacaacttcaaggtgcacaccttccggggcccccactggtgtgagtactgtgccaacttcatgtggggcctgattgcccagggcgtgcgctgcagcgactgtggcctgaatgtgcacaagcagtgcagcaagcacgtgcccaatgactgccagcctgacctgaagaggatcaagaaggtgtactgctgtgacctgaccaccctggtgaaggcccacaacacccagaggcccatggtggtggacatctgcatccgggagattgaggcccggggcctgaagtctgagggcctgtacagagtgtctggcttcacagagcacattgaagatgtgaagatggcctttgacagagatggagagaaggctgacatcagcgccaacgtgtacccagacatcaacatcatcactggagccctgaagctgtacttccgggacctgcccatccctgtgatcacctatgacacctacagcaagttcattgatgctgccaagatcagcaatgctgatgagcggctggaggccgtgcatgaggtgctgatgctgctgcccccagcccactatgagaccctgcgctacctgatgatccacctgaagaaggtgaccatgaatgagaaggacaacttcatgaatgctgagaacctgggcatcgtgtttggccccaccctgatgaggcctcctgaggacagcaccctgaccaccctgcatgacatgagataccagaagctgattgtgcagatcctgattgaaaatgaagatgtgctcttctag

SEQ ID NO: 147320 - DNA, 1632 bp, Artificial Sequence
  Description of Artificial Sequence: Synthetic coding sequence
atgacccagacccaccgggccaagagcgccagcagctgccccaacctgctggtgcctgagacctggccccaccaggtgtctgccagccatgctggccgcagcaagcagccccagggcggcatcctgaagatcaatgaggagcacagaagaggagccatccaggacctgctggccagccctggcttcaccttcggcaagagggtggtgtttgacagccactgcctgaagaggcagcacacctttgctgatggcctgcacagcagctgcaccagcaatgctgaggagtaccagccccccatctggaagagctacctgtaccagctgcagcaggaggccccccggcccaagaggatcatctgcccccgggaggtggagaaccggcccaagtactacggccgggagttccacggcatcatcagccgggagcaggctgatgagctgctgggcggcgtggagggcgcctacatcctgcgggagagccagaggcagcccggctgctacaccctggccctgcgctttggaaaccagaccctgaactaccgcctcttccatgatggcaagcactttgtgggggagaagagatttgagagcatccatgacctggtgacagatggcctcatcaccctgtacatcgagaccaaggctgctgagtacatcagcaagatgaccaccaaccccatctatgagcacatcggctacgccaccctgctgcgggagaaggtgtcccggcggctgagccgcagcaagaatgagcccaggaagaccaacgtgacccatgaggagcacacagctgtggagaagatcagcagcctggtgagaagagctgccctgacccacaatgacaaccacttcaactatgagaagacccacaacttcaaggtgcacaccttccggggcccccactggtgtgagtactgtgccaacttcatgtggggcctcatcgcccagggcgtgcgctgcagcgactgtggcctgaatgtgcacaagcagtgcagcaagcacgtgcccaatgactgccagcctgacctgaagaggatcaagaaggtgtactgctgtgacctgaccaccctggtgaaggcccacaacacccagaggcccatggtggtggacatctgcatccgggagattgaggcccggggcctgaagtctgagggcctgtacagagtgtctggcttcacagagcacattgaagatgtgaagatggcctttgacagagatggagagaaggctgacatcagcgccaacgtgtacccagacatcaacatcatcaccggggccctgaagctgtacttccgggacctgcccatccctgtgatcacctatgacacctacagcaagttcattgatgctgccaagatcagcaatgctgatgagcggctggaggccgtgcatgaggtgctgatgctgctgcccccagcccactatgagaccctgcgctacctgatgatccacctgaagaaggtgaccatgaatgagaaggacaacttcatgaatgctgagaacctgggcatcgtgtttggccccaccctgatgaggcccccagaggacagcaccctgaccaccctgcatgacatgagataccagaagctgattgtgcagatcctgattgaaaatgaagatgtgctcttctag

SEQ ID NO: 147321 - DNA, 1362 bp, Artificial Sequence
  Description of Artificial Sequence: Synthetic coding sequence
atggatgctgaggagtaccagccccccatctggaagagctacctgtaccagctgcagcaggaggccccccggcccaagaggatcatctgcccccgggaggtggagaaccggcccaagtactacggccgggagttccacggcatcatcagccgggagcaggctgatgagctgctgggcggcgtggagggcgcctacatcctgcgggagagccagaggcagcccggctgctacaccctggccctgcgctttggaaaccagaccctgaactaccgcctcttccatgatggcaagcactttgtgggggagaagagatttgagagcatccatgacctggtgacagatggcctcatcaccctgtacatcgagaccaaggctgctgagtacatcagcaagatgaccaccaaccccatctatgagcacatcggctacgccaccctgctgcgggagaaggtgtcccggcggctgagccgcagcaagaatgagcccaggaagaccaacgtgacccatgaggagcacacagctgtggagaagatcagcagcctggtgagaagagctgccctgacccacaatgacaaccacttcaactatgagaagacccacaacttcaaggtgcacaccttccggggcccccactggtgtgagtactgtgccaacttcatgtggggcctcatcgcccagggcgtgcgctgcagcgactgtggcctgaatgtgcacaagcagtgcagcaagcacgtgcccaatgactgccagcctgacctgaagaggatcaagaaggtgtactgctgtgacctgaccaccctggtgaaggcccacaacacccagaggcccatggtggtggacatctgcatccgggagattgaggcccggggcctgaagtctgagggcctgtacagagtgtctggcttcacagagcacattgaagatgtgaagatggcctttgacagagatggagagaaggctgacatcagcgccaacgtgtacccagacatcaacatcatcaccggggccctgaagctgtacttccgggacctgcccatccctgtgatcacctatgacacctacagcaagttcattgatgctgccaagatcagcaatgctgatgagcggctggaggccgtgcatgaggtgctgatgctgctgcccccagcccactatgagaccctgcgctacctgatgatccacctgaagaaggtgaccatgaatgagaaggacaacttcatgaatgctgagaacctgggcatcgtgtttggccccaccctgatgaggcccccagaggacagcaccctgaccaccctgcatgacatgagataccagaagctgattgtgcagatcctgattgaaaatgaagatgtgctcttctag

SEQ ID NO: 147322 - DNA, 1152 bp, Artificial Sequence
  Description of Artificial Sequence: Synthetic coding sequence
atgggcgtgaaggccagccagacaggctttgtggtgctggtgctgctgcagtgctgcagcgcctacaagctggtgtgctactacacctcctggagccagtaccgggagggagatggcagctgcttcccagatgccctggaccgcttcctgtgcacccacatcatctacagctttgccaacatcagcaatgaccacatcgacacctgggagtggaatgatgtgaccctgtatggcatgctgaacaccctgaagaacagaaaccccaacctgaagaccctgctgtctgtgggcggctggaactttggcagccagcgcttcagcaagatcgccagcaacacccagagcaggaggaccttcatcaagtctgtgccccccttcctgcggacccacggctttgatggcctggacctggcctggctgtacccaggccggcgggacaagcagcacttcaccaccctcatcaaggagatgaaggccgagttcatcaaggaggcccagcccgggaagaagcagctgctgctgtctgctgccctgtctgctgggaaggtgaccatcgacagcagctatgacatcgccaagatcagccagcacctggacttcatcagcatcatgacctatgacttccatggagcctggaggggcaccaccggccaccacagccccctcttccggggccaggaggatgccagcccagaccgcttcagcaacacagattatgctgtgggctacatgctgcggctgggcgccccagccagcaagctggtgatgggcatccccaccttcggccgctccttcaccctggccagcagcgagaccggggtgggcgcccccatcagcggccctggcatccctggccgcttcaccaaggaggccggcaccctggcctactatgagatctgtgacttcctgcggggggccaccgtgcaccgcatcctgggccagcaggtgccctatgccaccaagggcaaccagtgggtgggctatgatgaccaggagagcgtgaagagcaaggtgcagtacctgaaggaccggcagctggccggggccatggtgtgggccctggacctggatgacttccagggcagcttctgtggccaggacctgcgcttccccctgaccaatgccatcaaggatgccctggccgccacctag

SEQ ID NO: 147323 - DNA, 459 bp, Artificial Sequence
  Description of Artificial Sequence: Synthetic coding sequence
tgactgctgctgtctgctgccctgtctgctgggaaggtgaccatcgacagcagctatgacatcgccaagatcagccagcacctggacttcatcagcatcatgacctatgacttccatggagcctggaggggcaccaccggccaccacagccccctcttccggggccaggaggatgccagcccagaccgcttcagcaacaccatctgtgacttcctgcggggggccaccgtgcaccgcatcctgggccagcaggtgccctatgccaccaagggcaaccagtgggtgggctatgatgaccaggagagcgtgaagagcaaggtgcagtacctgaaggaccggcagctggccggggccatggtgtgggccctggacctggatgacttccagggcagcttctgtggccaggacctgcgcttccccctgaccaatgccatcaaggatgccctggccgccacctag

SEQ ID NO: 147324 - DNA, 306 bp, Artificial Sequence
  Description of Artificial Sequence: Synthetic coding sequence
atggtgtccaccccagagaaccggcagaccttcatcaccagcgtcatcaagttcctgcggcagtatgaatttgatggcctggactttgactgggagtacccaggcagccggggcagccccccccaggacaagcacctgttcaccgtgctggtgcagatgaggaagctgaagtaccgggaggacctgagcaacctgcccaagatcacccagctggtgggcatcatcaccagcagcgctgtgtggccccagagccccctgctgctgagcatcaccctgggctgccccctgctgctgagaaatgcctag

SEQ ID NO: 147325 - DNA, 1431 bp, Artificial Sequence
  Description of Artificial Sequence: Synthetic coding sequence
atgaccaagctgatcctgctgaccggcctggtgctgatcctgaacctgcagctgggcagcgcctaccagctgacctgctacttcaccaactgggcccagtaccggcccggcctgggccgcttcatgccagacaacatcgacccctgcctgtgcacccacctgatctatgcctttgctggccggcagaacaatgagatcaccaccatcgagtggaatgatgtgaccctgtaccaggccttcaacggcctgaagaacaagaacagccagctgaagaccctgctggccatcggcggctggaactttggaacagcccccttcaccgccatggtgtccaccccagagaaccggcagaccttcatcaccagcgtcatcaagttcctgcggcagtatgaatttgatggcctggactttgactgggagtacccaggcagccggggcagccccccccaggacaagcacctgttcaccgtgctggtgcaggagatgagggaggcctttgagcaggaggccaagcagatcaacaagccccggctgatggtgacagctgctgtggccgccggcatcagcaacatccagagcggctatgagatcccccagctgagccagtacctggactacatccacgtgatgacctatgacctgcacggctcctgggagggctacaccggggagaacagccccctgtacaagtaccccacagacaccggcagcaatgcctacctgaatgtggactatgtgatgaactactggaaggacaatggagccccagctgagaagctgattgtgggcttccccacctacggccacaacttcatcctgagcaaccccagcaacacaggaattggagcccccaccagcggggccggccctgctggcccctatgccaaggagagcggcatctgggcctactatgagatctgcaccttcctgaagaatggagccacccagggctgggatgccccccaggaggtgccctatgcctaccagggcaatgtgtgggtgggctatgacaacatcaagagctttgacatcaaggcccagtggctgaagcacaacaagtttggaggagccatggtgtgggccatcgacctggatgacttcaccggcaccttctgcaaccagggcaagttccccctcatcagcaccctgaagaaggccctgggcctgcagagcgccagctgcacagccccagcccagcccatcgagcccatcacagctgcccccagcggcagcggaaatggaagtggcagcagcagcagcggcggcagcagcggcggcagcggcttctgtgctgtgcgggccaacggcctgtaccctgtggccaacaacagaaatgccttctggcactgtgtgaatggagtgacctaccagcagaactgccaggccggcctggtgtttgacaccagctgtgactgctgcaactgggcctag

SEQ ID NO: 147326 - DNA, 948 bp, Artificial Sequence
  Description of Artificial Sequence: Synthetic coding sequence
atgagggaggcctttgagcaggaggccaagcagatcaacaagccccggctgatggtgacagctgctgtggccgccggcatcagcaacatccagagcggctatgagatcccccagctgagccagtacctggactacatccacgtgatgacctatgacctgcacggctcctgggagggctacacaggagagaacagccccctgtacaagtaccccacagacaccggcagcaatgcctacctgaatgtggactatgtgatgaactactggaaggacaacggggccccagctgagaagctgattgtgggcttccccacctacggccacaacttcatcctgagcaaccccagcaacacaggcatcggggcccccaccagcggggccggccctgctggcccctatgccaaggagagcggcatctgggcctactatgagatctgcaccttcctgaagaatggagccacccagggctgggatgccccccaggaggtgccctatgcctaccagggcaatgtgtgggtgggctatgacaacatcaagagctttgacatcaaggcccagtggctgaagcacaacaagtttggaggagccatggtgtgggccatcgacctggatgacttcaccggcaccttctgcaaccagggcaagttccccctcatcagcaccctgaagaaggccctgggcctgcagagcgccagctgcacagccccagcccagcccatcgagcccatcacagctgcccccagcggcagcggaaatggcagcggcagcagcagcagcggcggcagcagcggcggcagcggcttctgtgctgtgcgggccaacggcctgtaccctgtggccaacaacagaaatgccttctggcactgtgtgaatggagtgacctaccagcagaactgccaggccggcctggtgtttgacaccagctgtgactgctgcaactgggcctag

SEQ ID NO: 147327 - DNA, 1431 bp, Artificial Sequence; identical to SEQ ID NO: 147325
  Description of Artificial Sequence: Synthetic coding sequence

SEQ ID NO: 147328 - DNA, 1263 bp, Artificial Sequence
  Description of Artificial Sequence: Synthetic coding sequence
gagaccagcagctctgtgcatgagcaggtggccgacagcggggcccaggccgtggccttccagagcggcggggagagcagcatcgtgtggaacagccagctgaagaccctgctggccatcggcggctggaactttggaacagcccccttcaccgccatggtgtccaccccagagaaccggcagaccttcatcaccagcgtcatcaagttcctgcggcagtatgaatttgatggcctggactttgactgggagtacccaggcagccggggcagccccccccaggacaagcacctgttcaccgtgctggtgcaggagatgagggaggcctttgagcaggaggccaagcagatcaacaagccccggctgatggtgacagctgctgtggccgccggcatcagcaacatccagagcggctatgagatcccccagctgagccagtacctggactacatccacgtgatgacctatgacctgcacggctcctgggagggctacaccggggagaacagccccctgtacaagtaccccacagacaccggcagcaatgcctacctgaatgtggactatgtgatgaactactggaaggacaatggagccccagctgagaagctgattgtgggcttccccacctacggccacaacttcatcctgagcaaccccagcaacacaggaattggagcccccaccagcggggccggccctgctggcccctatgccaaggagagcggcatctgggcctactatgagatctgcaccttcctgaagaatggagccacccagggctgggatgccccccaggaggtgccctatgcctaccagggcaatgtgtgggtgggctatgacaacatcaagagctttgacatcaaggcccagtggctgaagcacaacaagtttggaggagccatggtgtgggccatcgacctggatgacttcaccggcaccttctgcaaccagggcaagttccccctcatcagcaccctgaagaaggccctgggcctgcagagcgccagctgcacagccccagcccagcccatcgagcccatcacagctgcccccagcggcagcggaaatggaagtggcagcagcagcagcggcggcagcagcggcggcagcggcttctgtgctgtgcgggccaacggcctgtaccctgtggccaacaacagaaatgccttctggcactgtgtgaatggagtgacctaccagcagaactgccaggccggcctggtgtttgacaccagctgtgactgctgcaactgggcctag

SEQ ID NO: 147329 - DNA, 1107 bp, Artificial Sequence
  Description of Artificial Sequence: Synthetic coding sequence
atggtgtccaccccagagaaccggcagaccttcatcaccagcgtcatcaagttcctgcggcagtatgaatttgatggcctggactttgactgggagtacccaggcagccggggcagccccccccaggacaagcacctgttcaccgtgctggtgcaggagatgagggaggcctttgagcaggaggccaagcagatcaacaagccccggctgatggtgacagctgctgtggccgccggcatcagcaacatccagagcggctatgagatcccccagctgagccagtacctggactacatccacgtgatgacctatgacctgcacggctcctgggagggctacaccggggagaacagccccctgtacaagtaccccacagacaccggcagcaatgcctacctgaatgtggactatgtgatgaactactggaaggacaatggagccccagctgagaagctgattgtgggcttccccacctacggccacaacttcatcctgagcaaccccagcaacacaggaattggagcccccaccagcggggccggccctgctggcccctatgccaaggagagcggcatctgggcctactatgagatctgcaccttcctgaagaatggagccacccagggctgggatgccccccaggaggtgccctatgcctaccagggcaatgtgtgggtgggctatgacaacatcaagagctttgacatcaaggcccagtggctgaagcacaacaagtttggaggagccatggtgtgggccatcgacctggatgacttcaccggcaccttctgcaaccagggcaagttccccctcatcagcaccctgaagaaggccctgggcctgcagagcgccagctgcacagccccagcccagcccatcgagcccatcacagctgcccccagcggcagcggaaatggaagtggcagcagcagcagcggcggcagcagcggcggcagcggcttctgtgctgtgcgggccaacggcctgtaccctgtggccaacaacagaaatgccttctggcactgtgtgaatggagtgacctaccagcagaactgccaggccggcctggtgtttgacaccagctgtgactgctgcaactgggcctag

SEQ ID NO: 147330 - DNA, 948 bp, Artificial Sequence; identical to SEQ ID NO: 147326
  Description of Artificial Sequence: Synthetic coding sequence

SEQ ID NO: 147331 - DNA, 948 bp, Artificial Sequence; identical to SEQ ID NO: 147326
  Description of Artificial Sequence: Synthetic coding sequence

SEQ ID NO: 147332 - DNA, 864 bp, Artificial Sequence
  Description of Artificial Sequence: Synthetic coding sequence
atgagggaggcctttgagcaggaggccaagcagatcaacaagccccggctgatggtgacagctgctgtggccgccggcatcagcaacatccagagcggctatgagatcccccagctgagccagtacctggactacatccacgtgatgacctatgacctgcacggctcctgggagggctacacaggagagaacagccccctgtacaagtaccccacagacaccggcagcaatgcctacctgaatgtggactatgtgatgaactactggaaggacaacggggccccagctgagaagctgattgtgggcttccccacctacggccacaacttcatcctgagcaaccccagcaacacaggcatcggggcccccaccagcggggccggccctgctggcccctatgccaaggagagcggcatctgggcctactatgagatctgcaccttcctgaagaatggagccacccagggctgggatgccccccaggaggtgccctatgcctaccagggcaatgtgtgggtgggctatgacaacatcaagagctttgacatcaaggcccagtggctgaagcacaacaagtttggaggagccatggtgtgggccatcgacctggatgacttcaccggcaccttctgcaaccagggcaagttccccctcatcagcaccctgaagaaggccctgggcctgcagagcgccagctgcacagccccagcccagcccatcgagcccatcacagctgcccccagcggcagcggaaatggcagcggcagcagcagcagcggcggcagcagcggcggcagcggcttctgtgctgtgcgggccaacggcctgtaccctgtggccaacaacagaaatgccttctggtag

SEQ ID NO: 147333 - DNA, 1158 bp, Artificial Sequence
  Description of Artificial Sequence: Synthetic coding sequence
atgagccggccccagctgcggcgctggaggctggtgagcagccccccatctggagtgcccggcctggccctgctggccctgctggccctgctggccctgcggctggccgccggcacagactgcccctgcccagagcctgagctgtgccggcccatccgccaccacccagactttgaggtgtttgtgtttgatgtgggccagaagacctggaagagctatgactggagccagatcaccaccgtggccaccttcggcaagtatgattctgagctgatgtgctacgcccacagcaagggggcccgggtggtgctgaagggagatgtgtccctgaaggacatcatcgaccctgccttccgggcctcctggatcgcccagaagctgaacctggccaagacccagtacatggatggcatcaacatcgacatcgagcaggaggtgaactgcctgagcccagaatatgatgccctgacagccctggtgaaggagaccacagacagcttccaccgggagattgagggcagccaggtgacctttgatgtggcctggagccccaagaacatcgaccggcgctgctacaactacacaggaattgctgatgcctgtgacttcctgtttgtgatgtcctatgatgagcagagccagatctggagcgagtgcatcgccgccgccaatgccccctacaaccagaccctgaccggctacaatgactacatcaagatgagcatcaaccccaagaagctggtgatgggcgtgccctggtacggctatgactacacctgcctgaacctgtctgaagatcatgtgtgcaccatcgccaaggtgcccttccggggggccccctgcagtgatgctgctggccggcaggtgccctacaagaccatcatgaagcagatcaacagcagcatcagcggcaacctgtgggacaaggaccagagggccccctactacaactacaaggaccctgctggccacttccaccaggtgtggtatgacaacccccagagcatcagcctgaaggccacctacatccagaactaccgcctgcggggcatcggcatgtggaatgccaactgcctggactacagcggagatgctgtggccaagcagcagacagaggagatgtgggaggtgctgaagcccaagctgctgcagaggtag

SEQ ID NO: 147334 - DNA, 2967 bp, Artificial Sequence
  Description of Artificial Sequence: Synthetic coding sequence
atggagcagagccgcagccagcagaggggcggggagcagagctggtggggcagtgacccccagtaccagtacatgccctttgagcactgcaccagctatggcctgcccagtgaaaatggaggcctgcagcaccggctgaggaaggatgctggccccaggcacaacgtgcaccccacccagatctacggccaccacaaggagcagttcagtgaccgggagcaggacatcggcatgcccaagaagacaggcagcagcagcacagtggacagcaaggatgaggaccactacagcaagtgccaggactgcatccaccggctgggccaggtggtgcggaggaagctgggggaggatggcatcttcctggtgctgctgggcctgctgatggccctggtgtcctggagcatggactatgtgtctgccaagagcctgcaggcctacaagtggagctatgcccagatgcagcccagcctgcccctgcagttcctggtgtgggtgaccttccccctggtgctgatcctcttcagcgccctcttctgccacctgatcagcccccaggccgtgggcagcggcatccctgagatgaagaccatcctgcggggcgtggtgctgaaggagtacctgaccatgaaggcctttgtggccaaggtggtggccctgacagctggcctgggcagcggcatccctgtgggcaaggagggcccctttgtgcacatcgccagcatctgtgccgctgtgctgagcaagttcatgtctgtgttctgtggggtgtatgagcagccctactactacagcgacatcctgactgtgggctgtgctgtgggcgtgggctgctgcttcggcacccccctgggcggcgtgctcttcagcattgaggtgaccagcacctactttgctgtgaggaactactggaggggcttctttgctgccaccttcagcgcctttgtgttccgggtgctggccgtgtggaacaaggatgctgtgaccatcacagccctcttccgcaccaacttcaggatggacttcccctttgacctgaaggagctgcctgcctttgctgccatcggcatctgctgcggcctgctgggcgctgtgtttgtgtacctgcaccggcaggtgatgctgggcgtgaggaagcacaaggccctgagccagttcctggccaagcaccggctgctgtacccaggcatcgtgacctttgtgattgccagcttcaccttccccccaggcatgggccagttcatggccggggagctgatgccccgggaggccatcagcaccctgtttgacaacaacacctgggtgaagcatgctggggaccctgagagcctgggccagagcgctgtgtggatccacccccgggtgaatgtggtgatcatcatcttcctgttctttgtgatgaagttctggatgagcatcgtggccaccaccatgcccatcccctgtggcggcttcatgcctgtgtttgtgctgggcgccgccttcggccgcctggtgggggagatcatggccatgctgttcccagatggcatcctgtttgatgacatcatctacaagatcctgcccggcggctatgctgtgattggagctgctgccctgactggagctgtgagccacacagtgtccacagctgtgatctgctttgagctgaccggccagatcgcccacatcctgcccatgatggtggccgtcatcctggccaacatggtggcccagagcctgcagcccagcctgtatgacagcatcatccaggtgaagaagctgccctacctgcctgacctgggctggaaccagctgagcaagtacaccatctttgtggaggacatcatggtgagagatgtgaagtttgtgtctgccagctacacctacggggagctgcggaccctgctgcagaccaccaccgtgaagaccctgcccctggtggacagcaaggacagcatgatcctgctgggctctgtggagaggtctgagctgcaggccctgctgcagaggcacctgtgcccagagcggcggctgcgggccgcccaggagatggccaggaagctgtctgagctgccctatgatggcaaggcccggctggccggggagggcctgcccggggcccctcctggccggcctgagagctttgcctttgtggatgaagatgaagatgaggacctgagcggcaagtctgagctgccccccagcctggccctgcaccccagcaccacagcccccctgagccctgaggagcccaacggccccctgcccggccacaagcagcagcctgaggcccctgagcctgctggccagaggcccagcatcttccagagcctgctgcactgcctgctgggccgggcccggcccaccaagaagaagaccacccaggacagcacagacctggtggacaacatgagccctgaggagattgaggcctgggagcaggagcagctgagccagcctgtgtgctttgacagctgctgcatcgaccagagccccttccagctggtggagcagaccaccctgcacaagacccacaccctcttcagcctgctgggcctgcacctggcctacgtgacctccatgggcaagctgcggggcgtgctggccctggaggagctgcagaaggccatcgagggccacaccaagagcggcgtgcagctgcggccccccctggccagcttcaggaacaccaccagcaccaggaagagcactggagccccacccagcagcgctgagaactggaacctgcctgaagatagacctggggccactggaactggagatgtgattgctgccagccctgagacccctgtgcccagccccagccctgagccccccctgagcctggcccctgggaaggtggagggggagctggaggagctggagctggtggagagccctggcctggaggaggagctggccgacatcctgcagggccccagcctgcggagcacagatgaagaagatgaagatgagctgatcctgtag

SEQ ID NO: 147335 - DNA, 2697 bp, Artificial Sequence
  Description of Artificial Sequence: Synthetic coding sequence
atggctgctgctgctgctgaggagggcatggagccccgggccctgcagtatgagcagaccctgatgtatggccgctacacccaggacctgggcgcctttgccaaggaggaggccgcccgcatccggctgggcggccctgagccctggaagggcccccccagcagcagagctgcccctgagctgctggagtatggccgcagccgctgtgcccgctgccgggtgtgcagcgtgcgctgccacaagttcctggtgtcccgggtgggggaggactggatcttcctggtgctgctgggcctgctgatggccctggtgtcctgggtgatggactatgccatcgccgcctgcctgcaggcccagcagtggatgagccggggcctgaacaccagcatcctgctgcagtacctggcctgggtgacctaccctgtggtgctgatcaccttctctgctggcttcacccagatcctggccccccaggccgtgggcagcggcatccctgagatgaagaccatcctgcggggcgtggtgctgaaggagtacctgaccctgaagaccttcatcgccaaggtgattggcctgacctgtgccctgggcagcggcatgcccctgggcaaggagggcccctttgtgcacatcgcctccatgtgtgccgccctgctgagcaagttcctgagcctgtttggaggcatctatgaaaatgaaagcaggaacacagagatgctggccgccgcctgtgctgtgggcgtgggctgctgctttgctgcccccatcggcggcgtgctcttcagcattgaggtgaccagcaccttctttgctgtgaggaactactggaggggcttctttgctgccaccttcagcgccttcatcttccgggtgctggccgtgtggaacagagatgaggagaccatcacagccctcttcaagacccgcttccggctggacttcccctttgacctgcaggagctgcctgcctttgctgtgattggaattgccagcggctttggaggagccctgtttgtgtacctgaacaggaagatcgtgcaggtgatgaggaagcagaagaccatcaaccgcttcctgatgaggaagaggctgctcttccctgccctggtgaccctgctgatcagcaccctgaccttccccccaggcttcggccagttcatggccggccagctgagccagaaggagaccctggtgaccctgtttgacaacagaacctgggtgcggcagggcctggtggaggagctggagccccccagcaccagccaggcctggaaccccccccgggccaacgtgttcctgaccctggtgatcttcatcctgatgaagttctggatgtctgccctggccaccaccatccctgtgccctgtggggccttcatgcctgtgtttgtgattggagctgccttcggccgcctggtgggggagagcatggccgcctggttcccagatggcatccacacagacagcagcacctaccgcatcgtgcctgggggctatgctgtggtgggcgctgctgccctggccggggctgtgacccacacagtgtccacagctgtgattgtgtttgagctgaccggccagatcgcccacatcctgcctgtgatgattgctgtgatcctggccaatgctgtggcccagagcctgcagcccagcctgtatgacagcatcatccgcatcaagaagctgccctacctgcctgagctgggctggggccgccaccagcagtacagagtgcgggtggaggacatcatggtgagagatgtgccccacgtggccctgagctgcaccttccgggacctgcggctggccctgcacaggaccaagggccgcatgctggccctggtggagagccctgagagcatgatcctgctgggcagcattgaaagaagccaggtggtggccctgctgggcgcccagctgagccctgcccggcggcggcagcacatgcaggagcggcgggccacccagaccagccccctgagtgaccaggagggcccccccaccccagaggcctctgtgtgcttccaggtgaacacagaggacagcgccttccctgctgcccggggggagacccacaagcccctgaagccagccctgaagaggggccccagcgtgaccaggaacctgggggagagccccaccggcagcgctgagagcgctggcatcgccctgcggagcctcttctgtggcagccccccacctgaggccgccagcgagaagctggagagctgtgagaagaggaagctgaagagggtgcgcatcagcctggccagtgatgctgacctggagggggagatgagccctgaggagatcctggagtgggaggagcagcagctggatgagcctgtgaacttcagtgactgcaagattgatcctgcccccttccagctggtggagaggaccagcctgcacaagacccacaccatcttcagcctgctgggcgtggaccacgcctacgtgaccagcatcggccgcctgattggaattgtgaccctgaaggagctgaggaaggccatcgagggctctgtgacagcccagggcgtgaaggtgcggccccccctggccagcttccgggacagcgccaccagcagcagtgacacagagaccacagaggtgcacgccctgtggggcccccacagccgccacggcctgccccgggagggcagccccagcgacagtgatgacaagtgccagtag

SEQ ID NO: 147336 - DNA, 381 bp, Artificial Sequence
  Description of Artificial Sequence: Synthetic coding sequence
atgaggaagaggctgctcttccctgccctggtgaccctgctgatcagcaccctgaccttccccccaggcttcggccagttcatggccggccagctgagccagaaggagaccctggtgaccctgtttgacaacagaacctgggtgcggcagggcctggtggaggagctggagccccccagcaccagccaggcctggaaccccccccgggccaacgtgttcctgaccctggtgatcttcatcctgatgaagcacctgggcgtgtggtgggtgaaggcctggctgcccggcagccagatggagttcatcagaacagctgcccccaccggcctgtgcctgggcgccaccctgtggagcggccagctgcgctggcaggagaggtag

SEQ ID NO: 147337 - DNA, 2601 bp, Artificial Sequence
  Description of Artificial Sequence: Synthetic coding sequence
atggagagcgagcagctgttccaccggggctactacagaaattcctacaacagcatcaccagcgccagcagtgatgaggagctgctggatggagctggggtcatcatggacttccagaccagtgaagatgacaacctgctggatggagacacagctgtgggcacccactacaccatgaccaatggaggcagcatcaacagcagcacccacctgctggacctgctggatgagcccatccctggggtgggcacctatgatgacttccacaccatcgactgggtgcgggagaagtgcaaggaccgggagcggcaccggcgcatcaacagcaagaagaaggagagcgcctgggagatgaccaagagcctgtatgatgcctggagcggctggctggtggtgaccctgaccggcctggccagcggggccctggccggcctgattgatattgctgctgactggatgacagacctgaaggagggcatctgcctgagcgccctgtggtacaaccacgagcagtgctgctggggcagcaatgagaccacctttgaggagcgggacaagtgcccccagtggaagacctgggccgagctgatcatcggccaggccgagggccctggcagctacatcatgaactacatcatgtacatcttctgggccctgagctttgccttcctggccgtgtccctggtgaaggtgtttgccccctatgcctgtggcagcggcatccctgagatcaagaccatcctgagcggcttcatcatccggggctacctgggcaagtggaccctgatgatcaagaccatcaccctggtgctggccgtggccagcggcctgagcctgggcaaggagggccccctggtgcacgtggcctgctgctgcggcaacatcttctcctacctgttccccaagtacagcaccaatgaggccaagaagcgggaggtgctgtctgctgccagcgctgctggggtgtctgtggccttcggggcccccatcggcggcgtgctcttcagcctggaggaggtgtcctactacttccccctgaagaccctgtggaggagcttctttgctgccctggtggccgcctttgtgctgcggagcatcaacccctttggaaacagccggctggtgctcttctacgtggagtaccacaccccctggtacctgtttgagctgttccccttcatcctgctgggcgtgtttggaggcctgtggggcgccttcttcatccgggccaacatcgcctggtgcagaagaaggaagagcaccaagtttgggaagtaccctgtgctggaggtgatcatcgtggccgccatcacagctgtgattgccttccccaacccctacacccggctgaacaccagcgagctgatcaaggagctgttcacagactgtggccccctggagagcagcagcctgtgtgactacagaaatgacatgaatgccagcaagatcgtggatgacatcccagacaggcctgctggcatcggcgtgtacagcgccatctggcagctgtgcctggccctgatcttcaagatcatcatgaccgtcttcaccttcggcatcaaggtgcccagcggcctcttcatccccagcatggccatcggggccatcgccggccgcatcgtgggcattgctgtggagcagctggcctactaccaccacgactggttcatcttcaaggagtggtgtgaggtgggcgctgactgcatcaccccaggcctgtatgccatggtgggcgccgccgcctgcctgggcggcgtgaccaggatgacagtgtccctggtggtgattgtgtttgagctgactggaggcctggagtacatcgtgcccctgatggctgctgtgatgaccagcaagtgggtgggagatgccttcggccgggagggcatctatgaggcccacatccggctgaatggctaccccttcctggatgccaaggaggagttcacccacaccaccctggccgcagatgtgatgaggcccaggagaaatgacccccccctggccgtgctgacccaggacaacatgacagtggatgacatcgagaacatgatcaatgagaccagctacaacggcttccctgtgatcatgagcaaggagagccagaggctggtgggctttgccctgcggcgggacctgaccatcgccatcgagagcgccaggaagaagcaggagggcatcgtgggcagcagccgggtgtgctttgcccagcacacccccagcctgcctgctgagagcccccggcccctgaagctgcggagcatcctggacatgagccccttcaccgtgacagaccacacccccatggagatcgtggtggacatcttcaggaagctgggcctgcggcagtgcctggtgacccacaacggcatcgtgctgggcatcatcaccaagaagaacatcctggagcacctggagcagctgaagcagcacgtggagcccctggccccaccctggcactacaacaagaagcgctaccccccagcctacggcccagatggcaagccccggccccgcttcaacaacgtgcagctgaacctgacagatgaggagcgggaggagacagaggaggaggtgtacctgctgaacagcaccaccctgtag

SEQ ID NO: 147338 - DNA, 2376 bp, Artificial Sequence
  Description of Artificial Sequence: Synthetic coding sequence
atggagagcgagcagctgttccaccggggctactacagaaattcctacaacagcatcaccagcgccagcagtgatgaggagctgctggatggagctggggtcatcatggacttccagaccagtgaagatgacaacctgctggatggagacacagctgtgggcacccactacaccatgaccaatggaggcagcatcaacagcagcacccacctgctggacctgctggatgagcccatccctggggtgggcacctatgatgacttccacaccatcgactgggtgcgggagaagtgcaaggaccgggagcggcaccggcgcatcaacagcaagaagaaggagagcgcctgggagatgaccaagagcctgtatgatgcctggagcggctggctggtggtgaccctgaccggcctggccagcggggccctggccggcctgattgatattgctgctgactggatgacagacctgaaggagggcatctgcctgagcgccctgtggtacaaccacgagcagtgctgctggggcagcaatgagaccacctttgaggagcgggacaagtgcccccagtggaagacctgggccgagctgatcatcggccaggccgagggccctggcagctacatcatgaactacatcatgtacatcttctgggccctgagctttgccttcctggccgtgtccctggtgaaggtgtttgccccctatgcctgtggcagcggcatccctgagatcaagaccatcctgagcggcttcatcatccggggctacctgggcaagtggaccctgatgatcaagaccatcaccctggtgctggccgtggccagcggcctgagcctgggcaaggagggccccctggtgcacgtggcctgctgctgcggcaacatcttctcctacctgttccccaagtacagcaccaatgaggccaagaagcgggaggtgtcctactacttccccctgaagaccctgtggaggagcttctttgctgccctggtggccgcctttgtgctgcggagcatcaaccccttcggcaacagccggctggtgctcttctacgtggagtaccacaccccctggtacctgtttgagctgttccccttcatcctgctgggcgtgtttggaggcctgtggggcgccttcttcatccgggccaacatcgcctggtgcagaagaaggaagagcaccaagtttgggaagtaccctgtgctggaggtgatcatcgtggccgccatcacagctgtgattgccttccccaacccctacacccggctgaacaccagcgagctgatcaaggagctgttcacagactgtggccccctggagagcagcagcctgtgtgactacagaaatgacatgaatgccagcaagatcgtggatgacatcccagacaggcctgctggcattggagtgtacagcgccatctggcagctgtgcctggccctgatcttcaagatcatcatgacagtgttcaccttcggcatcaaggtgcccagcggcctcttcatccccagcatggccatcggggccatcgccggcagaattgtgggcattgctgtggagcagctggcctactaccaccacgactggttcatcttcaaggagtggtgtgaggtgggcgctgactgcatcaccccaggcctgtatgccatggtgggcgctgctgcctgcctgggcggcgtgaccaggatgacagtgtccctggtggtgattgtgtttgagctgaccggcggcctggagtacatcgtgcccctgatggctgctgtgatgaccagcaagtgggtgggagatgccttcggccgggagggcatctatgaggcccacatccggctgaatggctaccccttcctggatgccaaggaggagttcacccacaccaccctggccgcagatgtgatgaggcccaggagaaatgacccccccctggccgtgctgacccaggacaacatgacagtggatgacatcgagaacatgatcaatgagaccagctacaacggcttccctgtgatcatgagcaaggagagccagaggctggtgggctttgccctgcggcgggacctgaccatcgccattgaaagtgccaggaagaagcaggagggcatcgtgggcagcagccgggtgtgctttgcccagcacacccccagcctgcctgctgagagcccccggcccctgaagctgcggagcatcctggacatgagccccttcaccgtgacagaccacacccccatggagatcgtggtggacatcttcaggaagctgggcctgcggcagtgcctggtgacccacaacggccgcctgctgggcatcatcaccaagaaggacatcctgcggcacatggcccagacagccaaccaggaccctgccagcatcatgttcaactag

SEQ ID NO: 147339 - DNA, 2406 bp, Artificial Sequence
  Description of Artificial Sequence: Synthetic coding sequence
atggtgaccctgcagctgggggagagccactacgtggtgcaggccggcctgcagctgctgggcagcagcaaccccccagccctggccagccaggtggccgagatcaccggcacccactacaccatgaccaacggcggcagcatcaacagcagcacccacctgctggacctgctggatgagcccatccctggggtgggcacctatgatgacttccacaccatcgactgggtgcgggagaagtgcaaggaccgggagcggcaccggcgcatcaacagcaagaagaaggagagcgcctgggagatgaccaagagcctgtatgatgcctggagcggctggctggtggtgaccctgaccggcctggccagcggggccctggccggcctgattgatattgctgctgactggatgacagacctgaaggagggcatctgcctgagcgccctgtggtacaaccacgagcagtgctgctggggcagcaatgagaccacctttgaggagcgggacaagtgcccccagtggaagacctgggccgagctgatcatcggccaggccgagggccctggcagctacatcatgaactacatcatgtacatcttctgggccctgagctttgccttcctggccgtgtccctggtgaaggtgtttgccccctatgcctgtggcagcggcatccctgagatcaagaccatcctgagcggcttcatcatccggggctacctgggcaagtggaccctgatgatcaagaccatcaccctggtgctggccgtggccagcggcctgagcctgggcaaggagggccccctggtgcacgtggcctgctgctgcggcaacatcttctcctacctgttccccaagtacagcaccaatgaggccaagaagcgggaggtgctgtctgctgccagcgctgctggggtgtctgtggcctttggagcccccatcggcggcgtgctcttcagcctggaggaggtgtcctactacttccccctgaagaccctgtggaggagcttctttgctgccctggtggccgcctttgtgctgcggagcatcaaccccttcggcaacagccggctggtgctcttctacgtggagtaccacaccccctggtacctgtttgagctgttccccttcatcctgctgggcgtgtttggaggcctgtggggcgccttcttcatccgggccaacatcgcctggtgcagaagaaggaagagcaccaagtttgggaagtaccctgtgctggaggtgatcatcgtggccgccatcacagctgtgattgccttccccaacccctacacccggctgaacaccagcgagctgatcaaggagctgttcacagactgtggccccctggagagcagcagcctgtgtgactacagaaatgacatgaatgccagcaagatcgtggatgacatcccagacaggcctgctggcattggagtgtacagcgccatctggcagctgtgcctggccctgatcttcaagatcatcatgacagtgttcaccttcggcatcaaggtgcccagcggcctcttcatccccagcatggccatcggggccatcgccggcagaattgtgggcattgctgtggagcagctggcctactaccaccacgactggttcatcttcaaggagtggtgtgaggtgggcgctgactgcatcaccccaggcctgtatgccatggtgggcgctgctgcctgcctgggcggcgtgaccaggatgacagtgtccctggtggtgattgtgtttgagctgaccggcggcctggagtacatcgtgcccctgatggctgctgtgatgaccagcaagtgggtgggagatgccttcggccgggagggcatctatgaggcccacatccggctgaatggctaccccttcctggatgccaaggaggagttcacccacaccaccctggccgcagatgtgatgaggcccaggagaaatgacccccccctggccgtgctgacccaggacaacatgacagtggatgacatcgagaacatgatcaatgagaccagctacaacggcttccctgtgatcatgagcaaggagagccagaggctggtgggctttgccctgcggcgggacctgaccatcgccattgaaagtgccaggaagaagcaggagggcatcgtgggcagcagccgggtgtgctttgcccagcacacccccagcctgcctgctgagagcccccggcccctgaagctgcggagcatcctggacatgagccccttcaccgtgacagaccacacccccatggagatcgtggtggacatcttcaggaagctgggcctgcggcagtgcctggtgacccacaacggccgcctgctgggcatcatcaccaagaaggacatcctgcggcacatggcccagacagccaaccaggaccctgccagcatcatgttcaactag

SEQ ID NO: 147340 - DNA, 522 bp, Artificial Sequence
  Description of Artificial Sequence: Synthetic coding sequence
atggagagcgagcagctgttccaccggggctactacagaaattcctacaacagcatcaccagcgccagcagtgatgaggagctgctggatggagctggggtcatcatggacttccagaccagtgaagatgacaacctgctggatggagacacagctgtgggcacccactacaccatgaccaatggaggcagcatcaacagcagcacccacctgctggacctgctggatgagcccatccctggggtgggcacctatgatgacttccacaccatcgactgggtgcgggagaagtgcaaggaccgggagcggcaccggcgcatcaacagcaagaagaaggagagcgcctgggagatgaccaagagcctgtatgatgcctggagcggctggctggtggtgaccctgaccggcctggccagcggggccctggccggcctgattgatattgctgctgactggatgacagacctgaaggagggcatctgcctgagcgccctgtggtacaaccacgagcagtgctgctag

SEQ ID NO: 147341 - DNA, 420 bp, Artificial Sequence
  Description of Artificial Sequence: Synthetic coding sequence
atggagagcgagcagctgttccaccggggctactacagaaattcctacaacagcatcaccagcgccagcagtgatgaggagctgctggatggagctggggtcatcatggacttccagaccagtgaagatgacaacctgctggatggagacacagctgtgggcacccactacaccatgaccaatggaggcagcatcaacagcagcacccacctgctggacctgctggatgagcccatccctggggtgggcacctatgatgacttccacaccatcgactgggtgcgggagaagtgcaaggaccgggagcggcaccggcgcatcaacagcaagaagaaggagagcgcctgggagatgaccaagagcctgtatgatgcctggagcggctggctggtggtgaccctgaccggcctggccagctag

SEQ ID NO: 147342 - DNA, 2457 bp, Artificial Sequence
  Description of Artificial Sequence: Synthetic coding sequence
atggagagcgagcagctgttccaccggggctactacagaaattcctacaacagcatcaccagcgccagcagtgatgaggagctgctggatggagctggggtcatcatggacttccagaccagtgaagatgacaacctgctggatggagacacagctgtgggcacccactacaccatgaccaatggaggcagcatcaacagcagcacccacctgctggacctgctggatgagcccatccctggggtgggcacctatgatgacttccacaccatcgactgggtgcgggagaagtgcaaggaccgggagcggcaccggcgcatcaacagcaagaagaaggagagcgcctgggagatgaccaagagcctgtatgatgcctggagcggctggctggtggtgaccctgaccggcctggccagcggggccctggccggcctgattgatattgctgctgactggatgacagacctgaaggagggcatctgcctgagcgccctgtggtacaaccacgagcagtgctgctggggcagcaatgagaccacctttgaggagcgggacaagtgcccccagtggaagacctgggccgagctgatcatcggccaggccgagggccctggcagctacatcatgaactacatcatgtacatcttctgggccctgagctttgccttcctggccgtgtccctggtgaaggtgtttgccccctatgcctgtggcagcggcatccctgagatcaagaccatcctgagcggcttcatcatccggggctacctgggcaagtggaccctgatgatcaagaccatcaccctggtgctggccgtggccagcggcctgagcctgggcaaggagggccccctggtgcacgtggcctgctgctgcggcaacatcttctcctacctgttccccaagtacagcaccaatgaggccaagaagcgggaggtgctgtctgctgccagcgctgctggggtgtctgtggccttcggggcccccatcggcggcgtgctcttcagcctggaggaggtgtcctactacttccccctgaagaccctgtggaggagcttctttgctgccctggtggccgcctttgtgctgcggagcatcaacccctttggaaacagccggctggtgctcttctacgtggagtaccacaccccctggtacctgtttgagctgttccccttcatcctgctgggcgtgtttggaggcctgtggggcgccttcttcatccgggccaacatcgcctggtgcagaagaaggaagagcaccaagtttgggaagtaccctgtgctggaggtgatcatcgtggccgccatcacagctgtgattgccttccccaacccctacacccggctgaacaccagcgagctgatcaaggagctgttcacagactgtggccccctggagagcagcagcctgtgtgactacagaaatgacatgaatgccagcaagatcgtggatgacatcccagacaggcctgctggcatcggcgtgtacagcgccatctggcagctgtgcctggccctgatcttcaagatcatcatgaccgtcttcaccttcggcatcaaggtgcccagcggcctcttcatccccagcatggccatcggggccatcgccggccgcatcgtgggcattgctgtggagcagctggcctactaccaccacgactggttcatcttcaaggagtggtgtgaggtgggcgctgactgcatcaccccaggcctgtatgccatggtgggcgccgccgcctgcctgggcggcgtgaccaggatgacagtgtccctggtggtgattgtgtttgagctgactggaggcctggagtacatcgtgcccctgatggctgctgtgatgaccagcaagtgggtgggagatgccttcggccgggagggcatctatgaggcccacatccggctgaatggctaccccttcctggatgccaaggaggagttcacccacaccaccctggccgcagatgtgatgaggcccaggagaaatgacccccccctggccgtgctgacccaggacaacatgacagtggatgacatcgagaacatgatcaatgagaccagctacaacggcttccctgtgatcatgagcaaggagagccagaggctggtgggctttgccctgcggcgggacctgaccatcgccatcgagagcgccaggaagaagcaggagggcatcgtgggcagcagccgggtgtgctttgcccagcacacccccagcctgcctgctgagagcccccggcccctgaagctgcggagcatcctggacatgagccccttcaccgtgacagaccacacccccatggagatcgtggtggacatcttcaggaagctgggcctgcggcagtgcctggtgacccacaacggccgcctgctgggcatcatcaccaagaaggacatcctgcggcacatggcccagacagccaaccaggaccctgccagcatcatgttcaactag

SEQ ID NO: 147343 - DNA, 576 bp, Artificial Sequence
  Description of Artificial Sequence: Synthetic coding sequence
atggagagcgagcagctgttccaccggggctactacagaaattcctacaacagcatcaccagcgccagcagtgatgaggagctgctggatggagctggggtcatcatggacttccagaccagtgaagatgacaacctgctggatggagacacagctgtgggcacccactacaccatgaccaatggaggcagcatcaacagcagcacccacctgctggacctgctggatgagcccatccctggggtgggcacctatgatgacttccacaccatcgactgggtgcgggagaagtgcaaggaccgggagcggcaccggcgcatcaacagcaagaagaaggagagcgcctgggagatgaccaagagcctgtatgatgcctggagcggctggctggtggtgaccctgaccggcctggccagcggggccctggccggcctgattgatattgctgctgactggatgacagacctgaaggagggcatctgcctgagcgccctgtggtacaaccacgagcagtgctgctggggcagcaatgagaccacctttgagaagaagaagaagaagaagaagaaggcctag

SEQ ID NO: 147344 - DNA, 2190 bp, Artificial Sequence
  Description of Artificial Sequence: Synthetic coding sequence
atggtgaatgctggggccatgagcggcagcggcaacctgatggacttcctggatgagcccttcccagatgtgggcacctatgaggacttccacaccatcgactggctgcgggagaagagccgggacacagacagacacaggaagatcaccagcaagagcaaggagagcatctgggagttcatcaagagcctgctggatgcctggagcggctgggtggtgatgctgctgattggcctgctggccggcaccctggccggggtcatcgacctggccgtggactggatgacagacctgaaggagggcgtgtgcctgagcgccttctggtacagccatgagcagtgctgctggaccagcaatgagaccacctttgaggaccgggacaagtgccccctgtggcagaagtggagcgagctgctggtgaaccagagcgagggcgccagcgcctacatcctgaactacctgatgtacatcctgtgggccctgctgtttgccttcctggccgtgtccctggtgcgggtgtttgccccctatgcctgtggcagcggcatccctgagatcaagaccatcctgagcggcttcatcatccggggctacctgggcaagtggaccctgctgatcaagacagtgaccctggtgctggtggtgagcagcggcctgagcctgggcaaggagggccccctggtgcacgtggcctgctgctgcggcaacttcttcagcagcctcttcagcaagtacagcaagaatgaaggcaagaggcgggaggtgctgtctgctgctgctgctgctggggtgtctgtggccttcggggcccccatcggcggcgtgctcttcagcctggaggaggtgtcctactacttccccctgaagaccctgtggaggagcttctttgctgccctggtggccgccttcaccctgcggagcatcaacccctttggaaacagccggctggtgctcttctacgtggagtaccacaccccctggaggaggaagaccacccggctgggcaagtaccctgtgctggaggtgattgtggtgacagccatcacagccatcatcgcctaccccaacccctacacccggcagagcaccagcgagctgatcagcgagctgttcaatgactgtggggccctggagagcagccagctgtgtgactacatcaatgaccccaacatgaccaggcctgtggatgacatcccagacaggcctgctggggtgggcgtgtacacagccatgtggcagctggccctggccctgatcttcaagatcgtggtgaccatcttcaccttcggcatgaagatccccagcggcctcttcatccccagcatggctgtgggcgccatcgccggccgcatggtgggcatcggcgtggagcagctggcctaccaccaccacgactggatcatcttcaggaactggtgcaggcctggagctgactgtgtgaccccaggcctgtatgccatggtgggcgctgctgcctgcctgggcggcgtgaccaggatgacagtgtccctggtggtgatcatgtttgagctgaccggcggcctggagtacatcgtgcccctgatggctgctgctgtgaccagcaagtgggtggctgatgccttcggcaaggagggcatctatgaggcccacatccacctgaatggctaccccttcctggatgtgaaggatgagttcacccacaggaccctggccacagatgtgatgaggccccggcggggggagccccccctgtctgtgctgacccaggacagcatgacagtggaggatgtggagaccctcatcaaggagacagactacaacggcttccctgtggtggtgtcccgggacagcgagcggctgattggatttgcccagaggcgggagctgatcctggccatcaagaatgcccggcagaggcaggagggcatcgtgagcaacagcatcatgtacttcacagaggagcccccagagctgcctgccaacagcccccaccccctgaagctgcggcgcatcctgaacctgagccccttcaccgtgacagaccacacccccatggagaccgtggtggacatcttcaggaagctgggcctgcggcagtgcctggtgaccaggagcggccgcctgctgggcatcatcaccaagaaggatgtgctgcggcacatggcccagatggccaaccaggaccctgagagcatcatgttcaactag

SEQ ID NO: 147345 - DNA, 2283 bp, Artificial Sequence
  Description of Artificial Sequence: Synthetic coding sequence
atggtgaatgctggggccatgagcggcagcggcaacctgatggacttcctggatgagcccttcccagatgtgggcacctatgaggacttccacaccatcgactggctgcgggagaagagccgggacacagacagacacaggaagatcaccagcaagagcaaggagagcatctgggagttcatcaagagcctgctggatgcctggagcggctgggtggtgatgctgctgattggcctgctggccggcaccctggccggggtcatcgacctggccgtggactggatgacagacctgaaggagggcgtgtgcctgagcgccttctggtacagccatgagcagtgctgctggaccagcaatgagaccacctttgaggaccgggacaagtgccccctgtggcagaagtggagcgagctgctggtgaaccagagcgagggcgccagcgcctacatcctgaactacctgatgtacatcctgtgggccctgctgtttgccttcctggccgtgtccctggtgcgggtgtttgccccctatgcctgtggcagcggcatccctgagatcaagaccatcctgagcggcttcatcatccggggctacctgggcaagtggaccctgctgatcaagacagtgaccctggtgctggtggtgagcagcggcctgagcctgggcaaggagggccccctggtgcacgtggcctgctgctgcggcaacttcttcagcagcctcttcagcaagtacagcaagaatgaaggcaagaggcgggaggtgctgtctgctgctgctgctgctggggtgtctgtggccttcggggcccccatcggcggcgtgctcttcagcctggaggaggtgtcctactacttccccctgaagaccctgtggaggagcttctttgctgccctggtggccgccttcaccctgcggagcatcaacccctttggaaacagccggctggtgctcttctacgtggagtaccacaccccctggtacatggccgagctgttccccttcatcctgctgggcgtgtttggaggcctgtggggcaccctcttcatccgctgcaacatcgcctggtgcagaagaaggaagaccacccggctgggcaagtaccctgtgctggaggtgattgtggtgacagccatcacagccatcatcgcctaccccaacccctacacccggcagagcaccagcgagctgatcagcgagctgttcaatgactgtggggccctggagagcagccagctgtgtgactacatcaatgaccccaacatgaccaggcctgtggatgacatcccagacaggcctgctggggtgggcgtgtacacagccatgtggcagctggccctggccctgatcttcaagatcgtggtgaccatcttcaccttcggcatgaagatccccagcggcctcttcatccccagcatggctgtgggcgccatcgccggccgcatggtgggcattggagtggagcagctggcctaccaccaccacgactggatcatcttcaggaactggtgcaggcctggagctgactgtgtgaccccaggcctgtatgccatggtgggcgccgccgcctgcctgggcggcgtgaccaggatgacagtgtccctggtggtgatcatgtttgagctgactggaggcctggagtacatcgtgcccctgatggctgctgctgtgaccagcaagtgggtggctgatgccttcggcaaggagggcatctatgaggcccacatccacctgaatggctaccccttcctggatgtgaaggatgagttcacccacaggaccctggccacagatgtgatgaggcccaggagaggagagccccccctgtctgtgctgacccaggacagcatgacagtggaggatgtggagaccctcatcaaggagacagactacaacggcttccctgtggtggtgtcccgggacagcgagcggctcatcggctttgcccagaggcgggagctgatcctggccatcaagaatgcccggcagaggcaggagggcatcgtgagcaacagcatcatgtacttcacagaggagcccccagagctgcctgccaacagcccccaccccctgaagctgcggcgcatcctgaacctgagccccttcaccgtgacagaccacacccccatggagaccgtggtggacatcttcaggaagctgggcctgcggcagtgcctggtgaccaggagcggccgcctgctgggcatcatcaccaagaaggatgtgctgcggcacatggcccagatggccaaccaggaccctgagagcatcatgttcaactag

SEQ ID NO: 147346 - DNA, 2001 bp, Artificial Sequence
  Description of Artificial Sequence: Synthetic coding sequence
atgacagacctgaaggagggcgtgtgcctgagcgccttctggtacagccatgagcagtgctgctggaccagcaatgagaccacctttgaggaccgggacaagtgccccctgtggcagaagtggagcgagctgctggtgaaccagagcgagggcgccagcgcctacatcctgaactacctgatgtacatcctgtgggccctgctgtttgccttcctggccgtgtccctggtgcgggtgtttgccccctatgcctgtggcagcggcatccctgagatcaagaccatcctgagcggcttcatcatccggggctacctgggcaagtggaccctgctgatcaagacagtgaccctggtgctggtggtgagcagcggcctgagcctgggcaaggagggccccctggtgcacgtggcctgctgctgcggcaacttcttcagcagcctcttcagcaagtacagcaagaatgaaggcaagaggcgggaggtgctgtctgctgctgctgctgctggggtgtctgtggccttcggggcccccatcggcggcgtgctcttcagcctggaggaggtgtcctactacttccccctgaagaccctgtggaggagcttctttgctgccctggtggccgccttcaccctgcggagcatcaacccctttggaaacagccggctggtgctcttctacgtggagtaccacaccccctggtacatggccgagctgttccccttcatcctgctgggcgtgtttggaggcctgtggggcaccctcttcatccgctgcaacatcgcctggtgcagaagaaggaagaccacccggctgggcaagtaccctgtgctggaggtgattgtggtgacagccatcacagccatcatcgcctaccccaacccctacacccggcagagcaccagcgagctgatcagcgagctgttcaatgactgtggggccctggagagcagccagctgtgtgactacatcaatgaccccaacatgaccaggcctgtggatgacatcccagacaggcctgctggggtgggcgtgtacacagccatgtggcagctggccctggccctgatcttcaagatcgtggtgaccatcttcaccttcggcatgaagatccccagcggcctcttcatccccagcatggctgtgggcgccatcgccggccgcatggtgggcattggagtggagcagctggcctaccaccaccacgactggatcatcttcaggaactggtgcaggcctggagctgactgtgtgaccccaggcctgtatgccatggtgggcgccgccgcctgcctgggcggcgtgaccaggatgacagtgtccctggtggtgatcatgtttgagctgactggaggcctggagtacatcgtgcccctgatggctgctgctgtgaccagcaagtgggtggctgatgccttcggcaaggagggcatctatgaggcccacatccacctgaatggctaccccttcctggatgtgaaggatgagttcacccacaggaccctggccacagatgtgatgaggcccaggagaggagagccccccctgtctgtgctgacccaggacagcatgacagtggaggatgtggagaccctcatcaaggagacagactacaacggcttccctgtggtggtgtcccgggacagcgagcggctcatcggctttgcccagaggcgggagctgatcctggccatcaagaatgcccggcagaggcaggagggcatcgtgagcaacagcatcatgtacttcacagaggagcccccagagctgcctgccaacagcccccaccccctgaagctgcggcgcatcctgaacctgagccccttcaccgtgacagaccacacccccatggagaccgtggtggacatcttcaggaagctgggcctgcggcagtgcctggtgaccaggagcggccgcctgctgggcatcatcaccaagaaggatgtgctgcggcacatggcccagatggccaaccaggaccctgagagcatcatgttcaactag

SEQ ID NO: 147347 - DNA, 459 bp, Artificial Sequence
  Description of Artificial Sequence: Synthetic coding sequence
atggtgaatgctggggccatgagcggcagcggcaacctgatggacttcctggatgagcccttcccagatgtgggcacctatgaggacttccacaccatcgactggctgcgggagaagagccgggacacagacagacacaggaagatcaccagcaagagcaaggagagcatctgggagttcatcaagagcctgctggatgcctggagcggctgggtggtgatgctgctgattggcctgctggccggcaccctggccggggtcatcgacctggccgtggactggatgacagacctgaaggagggcgtgtgcctgagcgccttctggtacagccatgagcagtgctgctggaccagcaatgagaccacctttgaggaccgggacaagtgccccctgtggcagaagtggagcgagctgctggtgaaccagagcgaggtgctgtctgctgctgctgctgcctag

SEQ ID NO: 147348 - DNA, 2241 bp, Artificial Sequence
  Description of Artificial Sequence: Synthetic coding sequence
atggacttcctggaggagcccatccctggggtgggcacctatgatgacttcaacaccatcgactgggtgcgggagaagagccgggaccgggacagacaccgggagatcaccaacaagagcaaggagagcacctgggccctgatccacagcgtgtctgatgccttcagcggctggctgctgatgctgctgattggcctgctgagcggcagcctggccggcctgattgacatcagcgcccactggatgacagacctgaaggagggcatctgcacaggaggcttctggttcaaccacgagcactgctgctggaacagcgagcacgtgacctttgaggagcgggacaagtgcccagagtggaacagctggagccagctgatcatcagcacagatgagggcgcctttgcctacatcgtgaactacttcatgtatgtgctgtgggccctgctgtttgccttcctggccgtgtccctggtgaaggtgtttgccccctatgcctgtggcagcggcatccctgagatcaagaccatcctgagcggcttcatcatccggggctacctgggcaagtggaccctggtgatcaagaccatcaccctggtgctggccgtgagcagcggcctgagcctgggcaaggagggccccctggtgcacgtggcctgctgctgcggcaacatcctgtgccactgcttcaacaagtacaggaagaatgaggccaagagaagagaggtgctgtctgctgctgctgctgctggggtgtctgtggcctttggagcccccatcggcggcgtgctcttcagcctggaggaggtgtcctactacttccccctgaagaccctgtggaggagcttctttgctgccctggtggccgccttcaccctgcggagcatcaaccccttcggcaacagccggctggtgctcttctacgtggagttccacaccccctggcacctgtttgagctggtgcccttcatcctgctgggcatctttggaggcctgtggggcgccctcttcatccgcaccaacatcgcctggtgcaggaagaggaagaccacccagctgggcaagtaccctgtgattgaggtgctggtggtgacagccatcacagccatcctggccttccccaatgagtacaccaggatgagcaccagcgagctgatcagcgagctgttcaatgactgtggcctgctggacagcagcaagctgtgtgactatgagaaccgcttcaacaccagcaaaggaggagagctgcctgacaggcctgctggggtgggcgtgtacagcgccatgtggcagctggccctgaccctcatcctgaagatcgtcatcaccatcttcaccttcggcatgaagatccccagcggcctcttcatccccagcatggctgtgggcgccatcgccggccgcctgctgggcgtgggcatggagcagctggcctactaccaccaggagtggacagtgttcaacagctggtgcagccagggcgctgactgcatcaccccaggcctgtatgccatggtgggcgccgccgcctgcctgggcggcgtgaccaggatgacagtgtccctggtggtgatcatgtttgagctgactggaggcctggagtacatcgtgcccctgatggctgctgccatgaccagcaagtgggtggctgatgccctgggccgggagggcatctatgatgcccacatccggctgaatggctaccccttcctggaggccaaggaggagtttgcccacaagaccctggccatggatgtgatgaagcccaggagaaatgaccccctgctgactgtgctgacccaggacagcatgacagtggaggatgtggagaccatcatcagcgagaccacctacagcggcttccctgtggtggtgtcccgggagagccagaggctggtgggctttgtgctgcggcgggacctgatcatcagcattgaaaatgccaggaagaagcaggatggagtggtgtccaccagcatcatctacttcacagagcacagcccccccctgcccccctacaccccacccaccctgaagctgaggaacatcctggacctgagccccttcaccgtgacagacctgacccccatggagatcgtggtggacatcttcaggaagctgggcctgcggcagtgcctggtgacccacaacggccgcctgctgggcatcatcaccaagaaggatgtgctgaagcacatcgcccagatggccaaccaggaccctgacagcatcctcttcaactag

SEQ ID NO: 147349 - DNA, 2451 bp, Artificial Sequence
  Description of Artificial Sequence: Synthetic coding sequence
atggccatgtggcagggcgccatggacaacagaggcttccagcagggcagcttcagcagcttccagaacagcagcagtgatgaggacctgatggacatcccagccacagccatggacttctccatgagagatgatgtgccccccctggaccgggaggtgggggaggacaagagctacaacggcggcggcatcggcagcagcaaccgcatcatggacttcctggaggagcccatccctggggtgggcacctatgatgacttcaacaccatcgactgggtgcgggagaagagccgggaccgggacagacaccgggagatcaccaacaagagcaaggagagcacctgggccctgatccacagcgtgtctgatgccttcagcggctggctgctgatgctgctgattggcctgctgagcggcagcctggccggcctgattgacatcagcgcccactggatgacagacctgaaggagggcatctgcacaggaggcttctggttcaaccacgagcactgctgctggaacagcgagcacgtgacctttgaggagcgggacaagtgcccagagtggaacagctggagccagctgatcatcagcacagatgagggcgcctttgcctacatcgtgaactacttcatgtatgtgctgtgggccctgctgtttgccttcctggccgtgtccctggtgaaggtgtttgccccctatgcctgtggcagcggcatccctgagatcaagaccatcctgagcggcttcatcatccggggctacctgggcaagtggaccctggtgatcaagaccatcaccctggtgctggccgtgagcagcggcctgagcctgggcaaggagggccccctggtgcacgtggcctgctgctgcggcaacatcctgtgccactgcttcaacaagtacaggaagaatgaggccaagagaagagaggtgctgtctgctgctgctgctgctggggtgtctgtggcctttggagcccccatcggcggcgtgctcttcagcctggaggaggtgtcctactacttccccctgaagaccctgtggaggagcttctttgctgccctggtggccgccttcaccctgcggagcatcaaccccttcggcaacagccggctggtgctcttctacgtggagttccacaccccctggcacctgtttgagctggtgcccttcatcctgctgggcatctttggaggcctgtggggcgccctcttcatccgcaccaacatcgcctggtgcaggaagaggaagaccacccagctgggcaagtaccctgtgattgaggtgctggtggtgacagccatcacagccatcctggccttccccaatgagtacaccaggatgagcaccagcgagctgatcagcgagctgttcaatgactgtggcctgctggacagcagcaagctgtgtgactatgagaaccgcttcaacaccagcaaaggaggagagctgcctgacaggcctgctggggtgggcgtgtacagcgccatgtggcagctggccctgaccctcatcctgaagatcgtcatcaccatcttcaccttcggcatgaagatccccagcggcctcttcatccccagcatggctgtgggcgccatcgccggccgcctgctgggcgtgggcatggagcagctggcctactaccaccaggagtggacagtgttcaacagctggtgcagccagggcgctgactgcatcaccccaggcctgtatgccatggtgggcgccgccgcctgcctgggcggcgtgaccaggatgacagtgtccctggtggtgatcatgtttgagctgactggaggcctggagtacatcgtgcccctgatggctgctgccatgaccagcaagtgggtggctgatgccctgggccgggagggcatctatgatgcccacatccggctgaatggctaccccttcctggaggccaaggaggagtttgcccacaagaccctggccatggatgtgatgaagcccaggagaaatgaccccctgctgactgtgctgacccaggacagcatgacagtggaggatgtggagaccatcatcagcgagaccacctacagcggcttccctgtggtggtgtcccgggagagccagaggctggtgggctttgtgctgcggcgggacctgatcatcagcattgaaaatgccaggaagaagcaggatggagtggtgtccaccagcatcatctacttcacagagcacagcccccccctgcccccctacaccccacccaccctgaagctgaggaacatcctggacctgagccccttcaccgtgacagacctgacccccatggagatcgtggtggacatcttcaggaagctgggcctgcggcagtgcctggtgacccacaacggccgcctgctgggcatcatcaccaagaaggatgtgctgaagcacatcgcccagatggccaaccaggaccctgacagcatcctcttcaactag

SEQ ID NO: 147350 - DNA, 2451 bp, Artificial Sequence; identical to SEQ ID NO: 147349
  Description of Artificial Sequence: Synthetic coding sequence

SEQ ID NO: 147351 - DNA, 2241 bp, Artificial Sequence; identical to SEQ ID NO: 147348
  Description of Artificial Sequence: Synthetic coding sequence

SEQ ID NO: 147352 - DNA, 1947 bp, Artificial Sequence
  Description of Artificial Sequence: Synthetic coding sequence
atgaacatcgtggccggcaccctgtccatgagccccctgaagagggacaagtgcccagagtggaacagctggagccagctgatcatcagcacagatgagggcgcctttgcctacatcgtgaactacttcatgtatgtgctgtgggccctgctgtttgccttcctggccgtgtccctggtgaaggtgtttgccccctatgcctgtggcagcggcatccctgagatcaagaccatcctgagcggcttcatcatccggggctacctgggcaagtggaccctggtgatcaagaccatcaccctggtgctggccgtgagcagcggcctgagcctgggcaaggagggccccctggtgcacgtggcctgctgctgcggcaacatcctgtgccactgcttcaacaagtacaggaagaatgaggccaagagaagagaggtgctgtctgctgctgctgctgctggggtgtctgtggcctttggagcccccatcggcggcgtgctcttcagcctggaggaggtgtcctactacttccccctgaagaccctgtggaggagcttctttgctgccctggtggccgccttcaccctgcggagcatcaaccccttcggcaacagccggctggtgctcttctacgtggagttccacaccccctggcacctgtttgagctggtgcccttcatcctgctgggcatctttggaggcctgtggggcgccctcttcatccgcaccaacatcgcctggtgcaggaagaggaagaccacccagctgggcaagtaccctgtgattgaggtgctggtggtgacagccatcacagccatcctggccttccccaatgagtacaccaggatgagcaccagcgagctgatcagcgagctgttcaatgactgtggcctgctggacagcagcaagctgtgtgactatgagaaccgcttcaacaccagcaaaggaggagagctgcctgacaggcctgctggggtgggcgtgtacagcgccatgtggcagctggccctgaccctcatcctgaagatcgtcatcaccatcttcaccttcggcatgaagatccccagcggcctcttcatccccagcatggctgtgggcgccatcgccggccgcctgctgggcgtgggcatggagcagctggcctactaccaccaggagtggacagtgttcaacagctggtgcagccagggcgctgactgcatcaccccaggcctgtatgccatggtgggcgccgccgcctgcctgggcggcgtgaccaggatgacagtgtccctggtggtgatcatgtttgagctgactggaggcctggagtacatcgtgcccctgatggctgctgccatgaccagcaagtgggtggctgatgccctgggccgggagggcatctatgatgcccacatccggctgaatggctaccccttcctggaggccaaggaggagtttgcccacaagaccctggccatggatgtgatgaagcccaggagaaatgaccccctgctgactgtgctgacccaggacagcatgacagtggaggatgtggagaccatcatcagcgagaccacctacagcggcttccctgtggtggtgtcccgggagagccagaggctggtgggctttgtgctgcggcgggacctgatcatcagcattgaaaatgccaggaagaagcaggatggagtggtgtccaccagcatcatctacttcacagagcacagcccccccctgcccccctacaccccacccaccctgaagctgaggaacatcctggacctgagccccttcaccgtgacagacctgacccccatggagatcgtggtggacatcttcaggaagctgggcctgcggcagtgcctggtgacccacaacggccgcctgctgggcatcatcaccaagaaggatgtgctgaagcacatcgcccagatggccaaccaggaccctgacagcatcctcttcaactag

SEQ ID NO: 147353 - DNA, 1062 bp, Artificial Sequence
  Description of Artificial Sequence: Synthetic coding sequence
atggccggctgccggggcagcctgtgctgctgctgccgctggtgctgctgctgcggggagcgggagaccaggaccccagaggagctgaccatcctgggggagacccaggaggaggaggatgagatcctgcccaggaaggactatgagagcctggactatgaccgctgcatcaatgacccctacctggaggtgctggagaccatggacaacaagaagggccgccgctatgaggccgtgaagtggatggtggtgtttgccatcggcgtgtgcaccggcctggtgggcctgtttgtggacttctttgtgcggctcttcacccagctgaagtttggagtggtgcagacctctgtggaggagtgcagccagaagggctgcctggccctgagcctgctggagctgctgggcttcaacctgacctttgtgttcctggccagcctgctggtgctgattgagcctgtggccgccggcagcggcatccctgaggtgaagtgctacctgaatggagtgaaggtgcccggcatcgtgcggctgcggaccctgctgtgcaaggtgctgggcgtgctcttctctgtggccggcggcctgtttgtggagaaggagggccccatgatccacagcggctctgtggtgggcgccggcctgccccagttccagagcatcagcctgaggaagatccagttcaacttcccctacttcagaagtgaccgggacaagagggactttgtgtctgctggagctgctgctggggtggccgccgccttcggggcccccatcggcggcaccctcttcagcctggaggagggcagcagcttctggaaccagggcctgacctggaaggtgctcttctgcagcatgtctgccaccttcaccctgaacttcttccgcagcggcatccagtttggctcctggggcagcttccagctgcccggcctgctgaactttggagagttcaagagcctgcgggagcccccctgtgtgtctggcaaccaccggggcggcgtgtgtggcctggatggagtgcggaggatgcccacagatgtgctgtttgagagcaacagatag

SEQ ID NO: 147354 - DNA, 2610 bp, Artificial Sequence
  Description of Artificial Sequence: Synthetic coding sequence
atggccggctgccggggcagcctgtgctgctgctgccgctggtgctgctgctgcggggagcgggagaccaggaccccagaggagctgaccatcctgggggagacccaggaggaggaggatgagatcctgcccaggaaggactatgagagcctggactatgaccgctgcatcaatgacccctacctggaggtgctggagaccatggacaacaagaagggccgccgctatgaggccgtgaagtggatggtggtgtttgccatcggcgtgtgcaccggcctggtgggcctgtttgtggacttctttgtgcggctcttcacccagctgaagtttggagtggtgcagacctctgtggaggagtgcagccagaagggctgcctggccctgagcctgctggagctgctgggcttcaacctgacctttgtgttcctggccagcctgctggtgctgattgagcctgtggccgccggcagcggcatccctgaggtgaagtgctacctgaatggagtgaaggtgcccggcatcgtgcggctgcggaccctgctgtgcaaggtgctgggcgtgctcttctctgtggccggcggcctgtttgtggagaaggagggccccatgatccacagcggctctgtggtgggcgccggcctgccccagttccagagcatcagcctgaggaagatccagttcaacttcccctacttcagaagtgaccgggacaagagggactttgtgtctgctggagctgctgctggggtggccgccgccttcggggcccccatcggcggcaccctcttcagcctggaggagggcagcagcttctggaaccagggcctgacctggaaggtgctcttctgcagcatgtctgccaccttcaccctgaacttcttccgcagcggcatccagtttggctcctggggcagcttccagctgcccggcctgctgaactttggagagttcaagtgcagcgacagcgacaagaagtgccacctgtggacagccatggacctgggcttctttgtggtgatgggcgtgattggaggcctgctgggcgccaccttcaactgcctgaacaagaggctggccaagtacaggatgagaaatgtgcaccccaagcccaagctggtgcgggtgctggagagcctgctggtgtccctggtgaccaccgtggtggtgtttgtggcctccatggtgctgggggagtgccggcagatgagcagcagcagccagattggaaatgacagcttccagctgcaggtgacagaagatgtgaacagcagcatcaagaccttcttctgccccaatgacacctacaatgacatggccaccctcttcttcaacccccaggagagcgccatcctgcagctgttccaccaggacggcaccttcagccctgtgaccctggccctcttctttgtgctgtacttcctgctggcctgctggacctacggcatctctgtgcccagcggcctgtttgtgcccagcctgctgtgtggggccgccttcggccgcctggtggccaacgtgctgaagagctacatcggcctgggccacatctacagcggcacctttgccctgattggagctgctgccttcctgggcggcgtggtgaggatgaccatcagcctgaccgtcatcctgattgagagcaccaatgagatcacctacggcctgcccatcatggtgaccctgatggtggccaagtggacaggagacttcttcaacaagggcatctatgacatccacgtgggcctgcggggcgtgcccctgctggagtgggagacagaggtggagatggacaagctgcgggccagtgacatcatggagcccaacctgacctacgtgtacccccacacccgcatccagagcctggtgtccatcctgcggaccaccgtgcaccacgccttccctgtggtgacagagaacagaggaaatgagaaggagttcatgaagggcaaccagctgatcagcaacaacatcaagttcaagaagagcagcatcctgacccgggccggggagcagaggaagaggagccagagcatgaagagctaccccagcagcgagctgaggaacatgtgtgatgagcacatcgccagcgaggagcctgctgagaaggaggacctgctgcagcagatgctggagcggcgctacaccccctaccccaacctgtacccagaccagagccccagcgaggactggaccatggaggagcgcttccggcccctgaccttccacggcctcatcctgcggagccagctggtgaccctgctggtgcggggcgtgtgctacagcgagagccagagcagcgccagccagccccggctgtcctatgcagagatggccgaggactacccccgctacccagacatccatgacctggacctgaccctgctgaaccccaggatgattgtggatgtgaccccctacatgaaccccagccccttcaccgtgagccccaacacccacgtgtcccaggtgttcaacctcttccgcaccatgggcctgcggcacctgcctgtggtgaatgctgtgggggagatcgtgggcatcatcaccaggcacaacctgacctatgagttcctgcaggcccggctgcggcagcactaccagaccatctag

SEQ ID NO: 147355 - DNA, 2544 bp, Artificial Sequence
  Description of Artificial Sequence: Synthetic coding sequence
atggccggctgccggggcagcctgtgctgctgctgccgctggtgctgctgctgcggggagcgggagaccaggaccccagaggagctgaccatcctgggggagacccaggaggaggaggatgagatcctgcccaggaaggactatgagaagggccgccgctatgaggccgtgaagtggatggtggtgtttgccatcggcgtgtgcaccggcctggtgggcctgtttgtggacttctttgtgcggctcttcacccagctgaagtttggagtggtgcagacctctgtggaggagtgcagccagaagggctgcctggccctgagcctgctggagctgctgggcttcaacctgacctttgtgttcctggccagcctgctggtgctgattgagcctgtggccgccggcagcggcatccctgaggtgaagtgctacctgaatggagtgaaggtgcccggcatcgtgcggctgcggaccctgctgtgcaaggtgctgggcgtgctcttctctgtggccggcggcctgtttgtggagaaggagggccccatgatccacagcggctctgtggtgggcgccggcctgccccagttccagagcatcagcctgaggaagatccagttcaacttcccctacttcagaagtgaccgggacaagagggactttgtgtctgctggagctgctgctggggtggccgccgccttcggggcccccatcggcggcaccctcttcagcctggaggagggcagcagcttctggaaccagggcctgacctggaaggtgctcttctgcagcatgtctgccaccttcaccctgaacttcttccgcagcggcatccagtttggctcctggggcagcttccagctgcccggcctgctgaactttggagagttcaagtgcagcgacagcgacaagaagtgccacctgtggacagccatggacctgggcttctttgtggtgatgggcgtgattggaggcctgctgggcgccaccttcaactgcctgaacaagaggctggccaagtacaggatgagaaatgtgcaccccaagcccaagctggtgcgggtgctggagagcctgctggtgtccctggtgaccaccgtggtggtgtttgtggcctccatggtgctgggggagtgccggcagatgagcagcagcagccagattggaaatgacagcttccagctgcaggtgacagaagatgtgaacagcagcatcaagaccttcttctgccccaatgacacctacaatgacatggccaccctcttcttcaacccccaggagagcgccatcctgcagctgttccaccaggacggcaccttcagccctgtgaccctggccctcttctttgtgctgtacttcctgctggcctgctggacctacggcatctctgtgcccagcggcctgtttgtgcccagcctgctgtgtggggccgccttcggccgcctggtggccaacgtgctgaagagctacatcggcctgggccacatctacagcggcacctttgccctgattggagctgctgccttcctgggcggcgtggtgaggatgaccatcagcctgaccgtcatcctgattgagagcaccaatgagatcacctacggcctgcccatcatggtgaccctgatggtggccaagtggacaggagacttcttcaacaagggcatctatgacatccacgtgggcctgcggggcgtgcccctgctggagtgggagacagaggtggagatggacaagctgcgggccagtgacatcatggagcccaacctgacctacgtgtacccccacacccgcatccagagcctggtgtccatcctgcggaccaccgtgcaccacgccttccctgtggtgacagagaacagaggaaatgagaaggagttcatgaagggcaaccagctgatcagcaacaacatcaagttcaagaagagcagcatcctgacccgggccggggagcagaggaagaggagccagagcatgaagagctaccccagcagcgagctgaggaacatgtgtgatgagcacatcgccagcgaggagcctgctgagaaggaggacctgctgcagcagatgctggagcggcgctacaccccctaccccaacctgtacccagaccagagccccagcgaggactggaccatggaggagcgcttccggcccctgaccttccacggcctcatcctgcggagccagctggtgaccctgctggtgcggggcgtgtgctacagcgagagccagagcagcgccagccagccccggctgtcctatgcagagatggccgaggactacccccgctacccagacatccatgacctggacctgaccctgctgaaccccaggatgattgtggatgtgaccccctacatgaaccccagccccttcaccgtgagccccaacacccacgtgtcccaggtgttcaacctcttccgcaccatgggcctgcggcacctgcctgtggtgaatgctgtgggggagatcgtgggcatcatcaccaggcacaacctgacctatgagttcctgcaggcccggctgcggcagcactaccagaccatctag

SEQ ID NO: 147356 - DNA, 963 bp, Artificial Sequence
  Description of Artificial Sequence: Synthetic coding sequence
atggccggctgccggggcagcctgtgctgctgctgccgctggtgctgctgctgcggggagcgggagaccaggaccccagaggagctgaccatcctgggggagacccaggaggaggaggatgagatcctgcccaggaaggactatgagagcctggactatgaccgctgcatcaatgacccctacctggaggtgctggagaccatggacaacaagaagggccgccgctatgaggccgtgaagtggatggtggtgtttgccatcggcgtgtgcaccggcctggtgggcctgtttgtggacttctttgtgcggctcttcacccagctgaagtttggagtggtgcagacctctgtggaggagtgcagccagaagggctgcctggccctgagcctgctggagctgctgggcttcaacctgacctttgtgttcctggccagcctgctggtgctgattgagcctgtggccgccggcagcggcatccctgaggtgaagtgctacctgaatggagtgaaggtgcccggcatcgtgcggctgcggaccctgctgtgcaaggtgctgggcgtgctcttctctgtggccggcggcctgtttgtggagaaggagggccccatgatccacagcggctctgtggtgggcgccggcctgccccagttccagagcatcagcctgaggaagatccagttcaacttcccctacttcagaagtgacagatatggcaagaggcaggagcggctgtgcatcagccgcagcggctgctggagctgctgcagcttccggggggccaacagaggctacctggtgcagagccggggcggctttgtgctgctggagccccgggcccacgtggagagcgccctgctcttccacgtgtgccacctgcacccccagctgctgcccttctgggacagcgtgtggaagctgggcttcctgcctgccccctggattgctgagctgtggagggtgtag

SEQ ID NO: 147357 - DNA, 927 bp, Artificial Sequence
  Description of Artificial Sequence: Synthetic coding sequence
atggccggctgccggggcagcctgtgctgctgctgccgctggtgctgctgctgcggggagcgggagaccaggaccccagaggagctgaccatcctgggggagacccaggaggaggaggatgagatcctgcccaggaaggactatgagagcctggactatgaccgctgcatcaatgacccctacctggaggtgctggagaccatggacaacaagaagggccgccgctatgaggccgtgaagtggatggtggtgtttgccatcggcgtgtgcaccggcctggtgggcctgtttgtggacttctttgtgcggctcttcacccagctgaagtttggagtggtgcagacctctgtggaggagtgcagccagaagggctgcctggccctgagcctgctggagctgctgggcttcaacctgacctttgtgttcctggccagcctgctggtgctgattgagcctgtggccgccggcagcggcatccctgaggtgaagtgctacctgaatggagtgaaggtgcccggcatcgtgcggctgcggaccctgctgtgcaaggtgctgggcgtgctcttctctgtggccggcggcctgtttgtggagaaggagggccccatgatccacagcggctctgtggtgggcgccggcctgccccagttccagagcatcagcctgaggaagatccagttcaacttcccctacttcagaagtgacagaagtggctgctggagctgctgcagcttccggggggccaacagaggctacctggtgcagagccggggcggctttgtgctgctggagccccgggcccacgtggagagcgccctgctcttccacgtgtgccacctgcacccccagctgctgcccttctgggacagcgtgtggaagctgggcttcctgcctgccccctggattgctgagctgtggagggtgtag

SEQ ID NO: 147358 - DNA, 1062 bp, Artificial Sequence; identical to SEQ ID NO: 147353
  Description of Artificial Sequence: Synthetic coding sequence

SEQ ID NO: 147359 - DNA, 2862 bp, Artificial Sequence
  Description of Artificial Sequence: Synthetic coding sequence
atggccggctgccggggcagcctgtgctgctgctgccgctggtgctgctgctgcggggagcgggagaccaggaccccagaggagctgaccatcctgggggagacccaggaggaggaggatgagatcctgcccaggaaggactatgagagcctggactatgaccgctgcatcaatgacccctacctggaggtgctggagaccatggacaacaagaagggccgccgctatgaggccgtgaagtggatggtggtgtttgccatcggcgtgtgcaccggcctggtgggcctgtttgtggacttctttgtgcggctcttcacccagctgaagtttggagtggtgcagacctctgtggaggagtgcagccagaagggctgcctggccctgagcctgctggagctgctgggcttcaacctgacctttgtgttcctggccagcctgctggtgctgattgagcctgtggccgccggcagcggcatccctgaggtgaagtgctacctgaatggagtgaaggtgcccggcatcgtgcggctgcggaccctgctgtgcaaggtgctgggcgtgctcttctctgtggccggcggcctgtttgtggagaaggagggccccatgatccacagcggctctgtggtgggcgccggcctgccccagttccagagcatcagcctgaggaagatccagttcaacttcccctacttcagaagtgaccgggacaagagggactttgtgtctgctggagctgctgctggggtggccgccgccttcggggcccccatcggcggcaccctcttcagcctggaggagggcagcagcttctggaaccagggcctgacctggaaggtgctcttctgcagcatgtctgccaccttcaccctgaacttcttccgcagcggcatccagtttggctcctggggcagcttccagctgcccggcctgctgaactttggagagttcaagtgcagcgacagcgacaagaagtgccacctgtggacagccatggacctgggcttctttgtggtgatgggcgtgattggaggcctgctgggcgccaccttcaactgcctgaacaagaggctggccaagtacaggatgagaaatgtgcaccccaagcccaagctggtgcgggtgctggagagcctgctggtgtccctggtgaccaccgtggtggtgtttgtggcctccatggtgctgggggagtgccggcagatgagcagcagcagccagattggaaatgacagcttccagctgcaggtgacagaagatgtgaacagcagcatcaagaccttcttctgccccaatgacacctacaatgacatggccaccctcttcttcaacccccaggagagcgccatcctgcagctgttccaccaggacggcaccttcagccctgtgaccctggccctcttctttgtgctgtacttcctgctggcctgctggacctacggcatctctgtgcccagcggcctgtttgtgcccagcctgctgtgtggggccgccttcggccgcctggtggccaacgtgctgaagagctacatcggcctgggccacatctacagcggcacctttgccctgattggagctgctgccttcctgggcggcgtggtgaggatgaccatcagcctgaccgtcatcctgattgagagcaccaatgagatcacctacggcctgcccatcatggtgaccctgatggtggccaagtggacaggagacttcttcaacaagggcatctatgacatccacgtgggcctgcggggcgtgcccctgctggagtgggagacagaggtggagatggacaagctgcgggccagtgacatcatggagcccaacctgacctacgtgtacccccacacccgcatccagagcctggtgtccatcctgcggaccaccgtgcaccacgccttccctgtggtgacagagaacagaggaaatgagaaggagttcatgaagggcaaccagctgatcagcaacaacatcaagttcaagaagagcagcatcctgacccgggccggggagcagaggaagaggagccagagcatgaagagctaccccagcagcgagctgaggaacatgtgtgatgagcacatcgccagcgaggagcctgctgagaaggaggacctgctgcagcagatgctggagcggcgctacaccccctaccccaacctgtacccagaccagagccccagcgaggactggaccatggaggagcgcttccggcccctgaccttccacggcctcatcctgcggagccagctggtgaccctgctggtgcggggcgtgtgctacagcgagagccagagcagcgccagccagccccggctgtcctatgcagagatggccgaggactacccccgctacccagacatccatgacctggacctgaccctgctgaaccccaggatgattgtggatgtgaccccctacatgaaccccagccccttcaccgtgagccccaacacccacgtgtcccaggtgttcaacctcttccgcaccatgggcctgcggcacctgcctgtggtgaatgctgtgggggaggtgtctgaggccccagccctgcccccacccctgcgggaggaccccctggcccgctgctgcctgtgcacccaggccagccaccagaagagaagacaccccaccaggagaggagaatgtggccccaccctggccctgaacccagcccggctgccctgcacccgggaccccttcccctgcctgcctgcagatggcacctctgtgcccctggccgtgctgagcagccagagccgggccagcacccggctgtgcctgcccccagagatgctgctcttcaccccctaccactggtgcagcctggtgctgcacctgcggcgggacctgcgcatcagatag

SEQ ID NO: 147360 - DNA, 369 bp, Artificial Sequence
  Description of Artificial Sequence: Synthetic coding sequence
atggccggctgccggggcagcctgtgctgctgctgccgctggtgctgctgctgcggggagcgggagaccaggaccccagaggagctgaccatcctgggggagacccaggaggaggaggatgagatcctgcccaggaaggactatgagagcctggactatgaccgctgcatcaatgacccctacctggaggtgctggagaccatggacaacaagaagggccgccgctatgaggccgtgaagtggatggtggtgtttgccatcggcgtgtgcaccggcctggtgggcctgtttgtggacttctttgtgcggctcttcacccagctgaagtttggagtggtgcagacctacaagttccagatgaagatgtag

SEQ ID NO: 147361 - DNA, 2277 bp, Artificial Sequence
  Description of Artificial Sequence: Synthetic coding sequence
agccccaggtctgccctcttccgggtgggccacatgagctctgtggagctggatgatgagctgctggaccctgacatggaccccccccaccccttccccaaggagatcccccacaatgagaagctgctgagcctgaagtatgagagcctggactatgacaacagcgagaaccagctgttcctggaggaggagcggcgcatcaaccacacagccttcagaacagtggagatcaagcgctgggtgatctgtgccctgattggcatcctgaccggcctggtggcctgcttcattgatattgtggtggagaacctggccggcctgaagtacagagtcatcaagggcaacatcgacaagttcacagagaagggcggcctgtccttcagcctgctgctgtgggccaccctgaatgctgcctttgtgctggtgggcagcgtcatcgtggccttcatcgagcctgtggccgccggcagcggcatcccccagatcaagtgcttcctgaatggagtgaagatcccccacgtggtgcggctgaagaccctggtgatcaaggtgtctggagtcatcctgtctgtggtgggcggcctggccgtgggcaaggagggccccatgatccacagcggctctgtgattgctgctggcatcagccagggccgcagcaccagcctgaagagggacttcaagatctttgagtacttcagaagagacacagagaagagggactttgtgtctgctggagctgctgctggggtgtctgctgccttcggggcccctgtgggcggcgtgctcttcagcctggaggagggcgccagcttctggaaccagttcctgacctggaggatcttctttgcctccatgatcagcaccttcaccctgaactttgtgctgagcatctaccacggcaacatgtgggacctgagcagccctggcctcatcaactttggccgctttgacagcgagaagatggcctacaccatccacgagatccctgtgttcatcgccatgggcgtggtgggcggcgtgctgggcgctgtgttcaatgccctgaactactggctgaccatgttccgcatccgctacatccaccggccctgcctgcaggtgattgaggccgtgctggtggccgctgtgacagccaccgtggcctttgtgctgatctacagcagccgggactgccagcccctgcagggcggctccatgagctaccccctgcagctgttctgtgctgatggagagtacaacagcatggctgctgccttcttcaacaccccagagaagtctgtggtgtccctcttccatgaccccccaggcagctacaaccccctgaccctgggcctcttcaccctggtgtacttcttcctggcctgctggacctacggcctgactgtgtctgctggggtcttcatccccagcctgctgattggagctgcctggggccgcctgtttggcatcagcctgagctacctgactggagctgccatctgggccgaccccgggaagtatgccctgatgggcgccgccgcccagctgggcggcatcgtgaggatgaccctgagcctgaccgtcatcatgatggaggccaccagcaatgtgacctacggcttccccatcatgctggtgctgatgacagccaagatcgtgggagatgtgttcatcgagggcctgtatgacatgcacatccagctgcagagcgtgcccttcctgcactgggaggcccctgtgaccagccacagcctgacagcccgggaggtgatgagcacccctgtgacctgcctgcggcggcgggagaaggtgggcgtcatcgtggatgtgctgagtgacacagccagcaaccacaacggcttccctgtggtggagcacgcagatgacacccagcctgcccggctgcagggcctcatcctgcggagccagctgattgtgctgctgaagcacaaggtgtttgtggagaggagcaacctgggcctggtgcagaggcggctgcggctgaaggacttcagagatgcctacccccgcttcccccccatccagagcatccacgtgtcccaggatgaaagagaatgtaccatggacctgtctgagttcatgaaccccagcccctacacagtgccccaggaggccagcctgcccagggtcttcaagctgttccgggccctgggcctgcggcacctggtggtggtggacaacagaaaccaggtggtgggcctggtgaccaggaaggacctggcccgctaccgcctgggcaagaggggcctggaggagctgagcctggcccagacctag

SEQ ID NO: 147362 - DNA, 2418 bp, Artificial Sequence
  Description of Artificial Sequence: Synthetic coding sequence
atggccaacgtgtccaagaaggtgtcctggagcggccgggacagagatgatgaggaggccgcccccctgctgcggaggacagcccggcctgggggcggcacccccctgctgaatggagctggccctggggccgcccggcagagccccaggtctgccctcttccgggtgggccacatgagctctgtggagctggatgatgagctgctggaccctgacatggaccccccccaccccttccccaaggagatcccccacaatgagaagctgctgagcctgaagtatgagagcctggactatgacaacagcgagaaccagctgttcctggaggaggagcggcgcatcaaccacacagccttcagaacagtggagatcaagcgctgggtgatctgtgccctgattggcatcctgaccggcctggtggcctgcttcatcgacatcgtggtggagaacctggccggcctgaagtacagagtcatcaagggcaacatcgacaagttcacagagaagggcggcctgtccttcagcctgctgctgtgggccaccctgaatgctgcctttgtgctggtgggctctgtgattgtggccttcatcgagcctgtggccgccggcagcggcatcccccagatcaagtgcttcctgaatggagtgaagatcccccacgtggtgcggctgaagaccctggtgatcaaggtgtctggagtcatcctgtctgtggtgggcggcctggccgtgggcaaggagggccccatgatccacagcggctctgtgattgctgctggcatcagccagggccgcagcaccagcctgaagagggacttcaagatctttgagtacttccggcgggacacagagaagagggactttgtgtctgctggagctgctgctggggtgtctgctgcctttggagcccctgtgggcggcgtgctcttcagcctggaggagggcgccagcttctggaaccagttcctgacctggaggatcttctttgcctccatgatcagcaccttcaccctgaactttgtgctgagcatctaccacggcaacatgtgggacctgagcagccctggcctcatcaactttggccgctttgattctgagaagatggcctacaccatccacgagatccctgtgttcatcgccatgggcgtggtgggcggcgtgctgggcgctgtgttcaatgccctgaactactggctgaccatgttccgcatccgctacatccaccggccctgcctgcaggtgattgaagctgtgctggtggccgctgtgacagccaccgtggcctttgtgctgatctacagcagccgggactgccagcccctgcagggcggctccatgagctaccccctgcagctgttctgtgctgatggagagtacaacagcatggccgccgccttcttcaacaccccagagaagtctgtggtgtccctcttccatgaccccccaggcagctacaaccccctgaccctgggcctcttcaccctggtgtacttcttcctggcctgctggacctacggcctgactgtgtctgctggggtcttcatccccagcctgctgattggagctgcctggggccgcctgtttggcatcagcctgagctacctgaccggggccgccatctgggccgaccccgggaagtatgccctgatgggcgctgctgcccagctgggcggcatcgtgaggatgaccctgagcctgaccgtcatcatgatggaggccaccagcaatgtgacctacggcttccccatcatgctggtgctgatgacagccaagatcgtgggagatgtgttcatcgagggcctgtatgacatgcacatccagctgcagagcgtgcccttcctgcactgggaggcccctgtgaccagccacagcctgacagcccgggaggtgatgagcacccctgtgacctgcctgcggcggcgggagaaggtgggcgtgattgtggatgtgctgagtgacacagccagcaaccacaacggcttccctgtggtggagcacgcagatgacacccagcctgcccggctgcagggcctcatcctgcggagccagctgattgtgctgctgaagcacaaggtgtttgtggagaggagcaacctgggcctggtgcagaggcggctgcggctgaaggacttcagagatgcctacccccgcttcccccccatccagagcatccacgtgtcccaggatgagcgggagtgcaccatggacctgtctgagttcatgaaccccagcccctacacagtgccccaggaggccagcctgcccagggtcttcaagctgttccgggccctgggcctgcggcacctggtggtggtggacaacagaaaccaggtggtgggcctggtgaccaggaaggacctggcccgctaccgcctgggcaagaggggcctggaggagctgagcctggcccagacctag

SEQ ID NO: 147363 - DNA, 2244 bp, Artificial Sequence
  Description of Artificial Sequence: Synthetic coding sequence
atgagctctgtggagctggatgatgagctgctggaccctgacatggaccccccccaccccttccccaaggagatcccccacaatgagaagctgctgagcctgaagtatgagagcctggactatgacaacagcgagaaccagctgttcctggaggaggagcggcgcatcaaccacacagccttcagaacagtggagatcaagcgctgggtgatctgtgccctgattggcatcctgaccggcctggtggcctgcttcatcgacatcgtggtggagaacctggccggcctgaagtacagagtcatcaagggcaacatcgacaagttcacagagaagggcggcctgtccttcagcctgctgctgtgggccaccctgaatgctgcctttgtgctggtgggctctgtgattgtggccttcatcgagcctgtggccgccggcagcggcatcccccagatcaagtgcttcctgaatggagtgaagatcccccacgtggtgcggctgaagaccctggtgatcaaggtgtctggagtcatcctgtctgtggtgggcggcctggccgtgggcaaggagggccccatgatccacagcggctctgtgattgctgctggcatcagccagggccgcagcaccagcctgaagagggacttcaagatctttgagtacttccggcgggacacagagaagagggactttgtgtctgctggagctgctgctggggtgtctgctgcctttggagcccctgtgggcggcgtgctcttcagcctggaggagggcgccagcttctggaaccagttcctgacctggaggatcttctttgcctccatgatcagcaccttcaccctgaactttgtgctgagcatctaccacggcaacatgtgggacctgagcagccctggcctcatcaactttggccgctttgattctgagaagatggcctacaccatccacgagatccctgtgttcatcgccatgggcgtggtgggcggcgtgctgggcgctgtgttcaatgccctgaactactggctgaccatgttccgcatccgctacatccaccggccctgcctgcaggtgattgaagctgtgctggtggccgctgtgacagccaccgtggcctttgtgctgatctacagcagccgggactgccagcccctgcagggcggctccatgagctaccccctgcagctgttctgtgctgatggagagtacaacagcatggccgccgccttcttcaacaccccagagaagtctgtggtgtccctcttccatgaccccccaggcagctacaaccccctgaccctgggcctcttcaccctggtgtacttcttcctggcctgctggacctacggcctgactgtgtctgctggggtcttcatccccagcctgctgattggagctgcctggggccgcctgtttggcatcagcctgagctacctgaccggggccgccatctgggccgaccccgggaagtatgccctgatgggcgctgctgcccagctgggcggcatcgtgaggatgaccctgagcctgaccgtcatcatgatggaggccaccagcaatgtgacctacggcttccccatcatgctggtgctgatgacagccaagatcgtgggagatgtgttcatcgagggcctgtatgacatgcacatccagctgcagagcgtgcccttcctgcactgggaggcccctgtgaccagccacagcctgacagcccgggaggtgatgagcacccctgtgacctgcctgcggcggcgggagaaggtgggcgtgattgtggatgtgctgagtgacacagccagcaaccacaacggcttccctgtggtggagcacgcagatgacacccagcctgcccggctgcagggcctcatcctgcggagccagctgattgtgctgctgaagcacaaggtgtttgtggagaggagcaacctgggcctggtgcagaggcggctgcggctgaaggacttcagagatgcctacccccgcttcccccccatccagagcatccacgtgtcccaggatgagcgggagtgcaccatggacctgtctgagttcatgaaccccagcccctacacagtgccccaggaggccagcctgcccagggtcttcaagctgttccgggccctgggcctgcggcacctggtggtggtggacaacagaaaccaggtggtgggcctggtgaccaggaaggacctggcccgctaccgcctgggcaagaggggcctggaggagctgagcctggcccagacctag

SEQ ID NO: 147364 - DNA, 2346 bp, Artificial Sequence
  Description of Artificial Sequence: Synthetic coding sequence
atggccaacgtgtccaagaaggtgtcctggagcggccgggacagagatgatgaggaggccgcccccctgctgcggaggacagcccggcctgggggcggcacccccctgctgaatggagctggccctggggccgcccggcaggacatggaccccccccaccccttccccaaggagatcccccacaatgagaagctgctgagcctgaagtatgagagcctggactatgacaacagcgagaaccagctgttcctggaggaggagcggcgcatcaaccacacagccttcagaacagtggagatcaagcgctgggtgatctgtgccctgattggcatcctgaccggcctggtggcctgcttcatcgacatcgtggtggagaacctggccggcctgaagtacagagtcatcaagggcaacatcgacaagttcacagagaagggcggcctgtccttcagcctgctgctgtgggccaccctgaatgctgcctttgtgctggtgggctctgtgattgtggccttcatcgagcctgtggccgccggcagcggcatcccccagatcaagtgcttcctgaatggagtgaagatcccccacgtggtgcggctgaagaccctggtgatcaaggtgtctggagtcatcctgtctgtggtgggcggcctggccgtgggcaaggagggccccatgatccacagcggctctgtgattgctgctggcatcagccagggccgcagcaccagcctgaagagggacttcaagatctttgagtacttccggcgggacacagagaagagggactttgtgtctgctggagctgctgctggggtgtctgctgcctttggagcccctgtgggcggcgtgctcttcagcctggaggagggcgccagcttctggaaccagttcctgacctggaggatcttctttgcctccatgatcagcaccttcaccctgaactttgtgctgagcatctaccacggcaacatgtgggacctgagcagccctggcctcatcaactttggccgctttgattctgagaagatggcctacaccatccacgagatccctgtgttcatcgccatgggcgtggtgggcggcgtgctgggcgctgtgttcaatgccctgaactactggctgaccatgttccgcatccgctacatccaccggccctgcctgcaggtgattgaagctgtgctggtggccgctgtgacagccaccgtggcctttgtgctgatctacagcagccgggactgccagcccctgcagggcggctccatgagctaccccctgcagctgttctgtgctgatggagagtacaacagcatggccgccgccttcttcaacaccccagagaagtctgtggtgtccctcttccatgaccccccaggcagctacaaccccctgaccctgggcctcttcaccctggtgtacttcttcctggcctgctggacctacggcctgactgtgtctgctggggtcttcatccccagcctgctgattggagctgcctggggccgcctgtttggcatcagcctgagctacctgaccggggccgccatctgggccgaccccgggaagtatgccctgatgggcgctgctgcccagctgggcggcatcgtgaggatgaccctgagcctgaccgtcatcatgatggaggccaccagcaatgtgacctacggcttccccatcatgctggtgctgatgacagccaagatcgtgggagatgtgttcatcgagggcctgtatgacatgcacatccagctgcagagcgtgcccttcctgcactgggaggcccctgtgaccagccacagcctgacagcccgggaggtgatgagcacccctgtgacctgcctgcggcggcgggagaaggtgggcgtgattgtggatgtgctgagtgacacagccagcaaccacaacggcttccctgtggtggagcacgcagatgacacccagcctgcccggctgcagggcctcatcctgcggagccagctgattgtgctgctgaagcacaaggtgtttgtggagaggagcaacctgggcctggtgcagaggcggctgcggctgaaggacttcagagatgcctacccccgcttcccccccatccagagcatccacgtgtcccaggatgagcgggagtgcaccatggacctgtctgagttcatgaaccccagcccctacacagtgccccaggaggccagcctgcccagggtcttcaagctgttccgggccctgggcctgcggcacctggtggtggtggacaacagaaaccaggtggtgggcctggtgaccaggaaggacctggcccgctaccgcctgggcaagaggggcctggaggagctgagcctggcccagacctag

SEQ ID NO: 147365 - DNA, 1545 bp, Artificial Sequence
  Description of Artificial Sequence: Synthetic coding sequence
atggtgctggacctggacctcttccgggtggacaagggcggggaccctgccctgatccgggagacccaggagaagcgcttcaaggaccccggcctggtggaccagctggtgaaggctgacagcgagtggaggcgctgccgcttccgggctgacaacctgaacaagctgaagaacctgtgcagcaagaccatcggggagaagatgaagaagaaggagcctgtgggagatgatgaatctgtgcctgaaaatgtgctgagctttgatgacctgacagcagatgccctggccaacctgaaggtgtcccagatcaagaaggtgcggctgctgattgatgaggccatcctgaagtgtgatgctgagcgcatcaagctggaggccgagagatttgagaacctgcgggagatcggcaacctgctgcaccccagcgtgcccatcagcaatgatgaagatgtggacaacaaggtggagcgcatctggggagactgcaccgtgaggaagaagtacagccacgtggacctggtggtgatggtggatggctttgaaggagagaagggagctgtggtggccggcagccggggctacttcctgaagggcgtgctggtgttcctggagcaggccctgatccagtatgccctgcggaccctgggcagccggggctacatccccatctacacccccttcttcatgaggaaggaggtgatgcaggaggtggcccagctgagccagtttgatgaggagctgtacaaggtgattggaaaaggaagtgagaagagtgatgacaacagctatgatgagaagtacctgattgccaccagcgagcagcccatcgccgccctgcacagagatgagtggctgcggcctgaggacctgcccatcaagtatgccggcctgagcacctgcttccggcaggaggtgggcagccacggccgggacacccggggcatcttccgggtgcaccagtttgagaagattgagcagtttgtgtacagcagcccccatgacaacaagtcctgggagatgtttgaggagatgatcaccacagctgaggagttctaccagagcctgggcatcccctaccacatcgtgaacatcgtgtctggcagcctgaaccacgccgccagcaagaagctggacctggaggcctggttccctggcagcggggccttccgggagctggtgtcctgcagcaactgcacagactaccaggcccggcggctgcgcatccgctatggccagaccaagaagatgatggacaaggtggagtttgtgcacatgctgaatgccaccatgtgtgccaccaccaggaccatctgtgccatcctggagaactaccagacagagaagggcatcaccgtgcctgagaagctgaaggagttcatgcctcctggcctgcaggagctgatcccctttgtgaagccagcccccatcgagcaggagcccagcaagaagcagaagaagcagcacgagggcagcaagaagaaggccgccgccagagatgtgaccctggagaaccggctgcagaacatggaggtgacagatgcctag

SEQ ID NO: 147366 - DNA, 2745 bp, Artificial Sequence
  Description of Artificial Sequence: Synthetic coding sequence
atgggccccttcaagagctctgtgttcatcctgatcctgcacctgctggagggcgccctgagcaacagcctcatccagctgaacaacaacggctatgagggcatcgtggtggccatcgaccccaacgtgcctgaagatgagaccctcatccagcagatcaaggacatggtgacccaggccagcctgtacctgctggaggccaccgggaagcgcttctacttcaagaatgtggccatcctgatccctgagacctggaagaccaaggctgactatgtgcggcccaagctggagacctacaagaatgctgatgtgctggtggccgagagcaccccacctggaaatgatgagccctacacagagcagatgggcaactgtggggagaagggggagcgcatccacctgaccccagacttcatcgccggcaagaagctggccgagtatggcccccagggccgggcctttgtgcatgagtgggcccacctgcgctggggcgtgtttgatgagtacaacaatgatgagaagttctacctgagcaatggccgcatccaggccgtgcgctgcagcgctggcatcaccggcaccaacgtggtgaagaagtgccagggcggcagctgctacaccaagcgctgcaccttcaacaaggtgacaggcctgtatgagaagggctgtgaatttgtgctgcagagccggcagacagagaaggccagcatcatgtttgcccagcacgtggacagcatcgtggagttctgcacagagcagaaccacaacaaggaggcccccaacaagcagaaccagaagtgcaacctgcggagcacctgggaggtgatccgggacagcgaggacttcaagaagaccacccccatgaccacccagccccccaaccccaccttcagcctgctgcagatcggccagagaattgtgtgcctggtgctggacaagagcggctccatggccactggaaaccggctgaaccggctgaaccaggccggccagctgttcctgctgcagacagtggagctgggctcctgggtgggcatggtgacctttgattctgctgcccacgtgcagaatgaactcatccagatcaacagcggcagtgaccgggacaccctggccaagaggctgcctgctgctgccagcggcggcaccagcatctgcagcggcctgcggagcgccttcaccgtcatcaggaagaagtaccccacagatggcagcgagatcgtgctgctgacagatggagaggacaacaccatcagcggctgcttcaatgaggtgaagcagagcggggccatcatccacacagtggccctgggccccagcgctgcccaggagctggaggagctgagcaagatgactggaggcctgcagacctacgccagtgaccaggtgcagaacaacggcctgattgatgccttcggggccctgagcagtggaaatggagctgtgtcccagaggagcatccagctggagagcaagggcctgaccctgcagaacagccagtggatgaatggaacagtgattgtggacagcacagtgggcaaggacaccctcttcctgatcacctggaccatgcagcccccccagatcctgctgtgggaccccagcggccagaagcagggcggctttgtggtggacaagaacaccaagatggcctacctgcagatccctggcatcgccaaggtgggcacctggaagtacagcctgcaggccagcagccagaccctgaccctgactgtgaccagccgggccagcaatgccaccctgccccccatcaccgtgaccagcaagaccaacaaggacaccagcaagttccccagccccctggtggtgtatgccaacatccggcagggcgccagccccatcctgcgggcctctgtgacagccctgattgagagcgtgaatggcaagacagtgaccctggagctgctggacaatggagctggagcagatgccaccaaggatgatggagtgtacagccgctacttcaccacctatgacaccaacggccgctacagcgtgaaggtgcgggccctgggcggcgtgaatgctgcccggcggcgggtcatcccccagcagagcggggccctgtacatccctggctggattgaaaatgatgagatccagtggaacccccccaggcctgagatcaacaaggatgatgtgcagcacaagcaggtgtgcttcagcaggaccagcagcggcggcagctttgtggccagtgatgtgcccaatgcccccatcccagacctcttccccccaggccagatcacagacctgaaggccgagatccacggcggcagcctcatcaacctgacctggacagcccctggagatgattatgaccacggcacagcccacaagtacatcatccgcatcagcaccagcatcctggacctgcgggacaagttcaatgaaagcctgcaggtgaacaccacagccctgatccccaaggaggccaacagcgaggaggtgttcctgttcaagccagagaacatcacctttgaaaatggaacagacctcttcatcgccatccaggccgtggacaaggtggacctgaagtctgagatcagcaacatcgcccgggtgtccctcttcatccccccccagaccccacctgagacccccagcccagatgagaccagcgccccctgccccaacatccacatcaacagcaccatccctggcatccacatcctgaagatcatgtggaagtggattggagagctgcagctgagcatcgcctag

SEQ ID NO: 147367 - DNA, 987 bp, Artificial Sequence
  Description of Artificial Sequence: Synthetic coding sequence
atgaccacccagccccccaaccccaccttcagcctgctgcagatcggccagagaattgtgtgcctggtgctggacaagagcggctccatggccaccggcaaccggctgaaccggctgaaccaggccggccagctgttcctgctgcagacagtggagctgggctcctgggtgggcatggtgacctttgacagcgctgcccacgtgcagaatgagctgatccagatcaacagcggcagtgaccgggacaccctggccaagaggctgcctgctgctgccagcggcggcaccagcatctgcagcggcctgcggagcgccttcaccgtcatcaggaagaagtaccccacagatggcagcgagatcgtgctgctgacagatggagaggacaacaccatcagcggctgcttcaatgaggtgaagcagagcggggccatcatccacacagtggccctgggccccagcgctgcccaggagctggaggagctgagcaagatgactggaggcctgcagacctacgccagtgaccaggtgcagaacaacggcctgattgatgcctttggagccctgagcagtggaaatggagctgtgtcccagaggagcatccagctggagagcaagggcctgaccctgcagaacagccagtggatgaatggcaccgtcatcgtggacagcacagtgggcaaggacaccctcttcctgatcacctggaccatgcagcccccccagatcctgctgtgggaccccagcggccagaagcagggcggctttgtggtggacaagaacaccaagatggcctacctgcagatccctggcatcgccaaggtgggcacctggaagtacagcctgcaggccagcagccagaccctgaccctgactgtgaccagccgggccagcaatgccaccctgccccccatcaccgtgaccagcaagaccaacaaggacaccagcaacctgcccaacagccagggccagtgccacagcccagactag

SEQ ID NO: 147368 - DNA, 2064 bp, Artificial Sequence
  Description of Artificial Sequence: Synthetic coding sequence
atggaggagctggtgggcctgcgggagggcttcagcggggaccctgtgaccctgcaggagctgtggggcccctgcccccacatcagaagagccatccagggcggcctggagtggctgaagcagaaggtgttccggctgggggaggactggtacttcctgatgaccctgggcgtgctgatggccctggtgtcctatgccatgaactttgccatcggctgtgtggtgcgggcccaccagtggctgtaccgggagattggagacagccacctgctgcgctacctgtcctggacagtgtaccctgtggccctggtgtccttcagcagcggcttcagccagagcatcacccccagcagcggcggcagcggcatccctgagctgaagaccatgctggccggggtcatcctggaggactacctggacatcaagaactttggagccaaggtggtgggcctgagctgcaccctggccaccggcagcaccctcttcctgggcaaggtgggcccctttgtgcacctgtctgtgatgattgctgcctacctgggccgggtgaggaccaccaccatcggggagcctgagaacaagagcaagcagaatgagatgctggtggccgctgctgctgtgggcgtggccaccgtgtttgctgcccccttcagcggcgtgctcttcagcattgaggtgatgagcagccacttctctgtgcgggactactggaggggcttctttgctgccacctgtggggccttcatcttccggctgctggccgtgttcaacagcgagcaggagaccatcaccagcctgtacaagaccagcttccgggtggatgtgccctttgacctgcctgagatcttcttctttgtggccctgggcggcatctgtggggtgctgagctgtgcctacctgttctgccagaggaccttcctgtccttcatcaagaccaaccgctacagcagcaagctgctggccaccagcaagcctgtgtacagcgccctggccaccctgctgctggccagcatcacctacccacctggggtgggccacttcctggccagccggctgtccatgaagcagcacctggacagcctgtttgacaaccacagctgggccctgatgacccagaacagcagccccccctggccagaggagctggacccccagcacctgtggtgggagtggtaccacccccgcttcaccatcttcggcaccctggccttcttcctggtgatgaagttctggatgctgatcctggccaccaccatccccatgcctgctggctacttcatgcccatcttcatcctgggcgccgccatcggccgcctgctgggggaggccctggccgtggccttccctgagggcatcgtgactggaggagtgaccaaccccatcatgcctgggggctacgccctggccggggccgccgccttctctggagctgtgacccacaccatcagcacagccctgctggcctttgagctgaccggccagatcgtgcacgccctgcctgtgctgatggctgtgctggccgccaatgccatcgcccagagctgccagcccagcttctatgatggcaccatcatcgtgaagaagctgccctacctgccccgcatcctgggcaggaacatcggcagccaccacgtgcgggtggagcacttcatgaaccacagcatcaccaccctggccaaggacacccccctggaggaggtggtgaaggtggtgaccagcacagatgtgacagagtaccccctggtggagagcacagagagccagatcctggtgggcatcgtgcagagggcccagctggtgcaggccctgcaggccgagccccccagccgggcccctggccaccagcagtgcctgcaggacatcctggcccggggctgccccacagagcctgtgaccctgaccctcttcagcgagaccaccctgcaccaggcccagaacctcttcaagctgctgaacctgcagagcctgtttgtgaccagccggggccgggctgtgggctgtgtgtcctgggtggagatgaagaaggccatcagcaacctgaccaaccccccagcccccaagtag

SEQ ID NO: 147369 - DNA, 2061 bp, Artificial Sequence
  Description of Artificial Sequence: Synthetic coding sequence
atggaggagctggtgggcctgcgggagggcttcagcggggaccctgtgaccctgcaggagctgtggggcccctgcccccacatcagaagagccatccagggcggcctggagtggctgaagcagaaggtgttccggctgggggaggactggtacttcctgatgaccctgggcgtgctgatggccctggtgtcctatgccatgaactttgccatcggctgtgtggtgcgggcccaccagtggctgtaccgggagattggagacagccacctgctgcgctacctgtcctggacagtgtaccctgtggccctggtgtccttcagcagcggcttcagccagagcatcacccccagcagcggcggcagcggcatccctgagctgaagaccatgctggccggggtcatcctggaggactacctggacatcaagaactttggagccaaggtggtgggcctgagctgcaccctggccaccggcagcaccctcttcctgggcaaggtgggcccctttgtgcacctgtctgtgatgattgctgcctacctgggccgggtgaggaccaccaccatcggggagcctgagaacaagagcaagcagaatgagatgctggtggccgctgctgctgtgggcgtggccaccgtgtttgctgcccccttcagcggcgtgctcttcagcattgaggtgatgagcagccacttctctgtgcgggactactggaggggcttctttgctgccacctgtggggccttcatcttccggctgctggccgtgttcaacagcgagcaggagaccatcaccagcctgtacaagaccagcttccgggtggatgtgccctttgacctgcctgagatcttcttctttgtggccctgggcggcatctgtggggtgctgagctgtgcctacctgttctgccagaggaccttcctgtccttcatcaagaccaaccgctacagcagcaagctgctggccaccagcaagcctgtgtacagcgccctggccaccctgctgctggccagcatcacctacccacctggggtgggccacttcctggccagccggctgtccatgaagcagcacctggacagcctgtttgacaaccacagctgggccctgatgacccagaacagcagccccccctggccagaggagctggacccccagcacctgtggtgggagtggtaccacccccgcttcaccatcttcggcaccctggccttcttcctggtgatgaagttctggatgctgatcctggccaccaccatccccatgcctgctggctacttcatgcccatcttcatcctgggcgccgccatcggccgcctgctgggggaggccctggccgtggccttccctgagggcatcgtgactggaggagtgaccaaccccatcatgcctgggggctacgccctggccggggccgccgccttctctggagctgtgacccacaccatcagcacagccctgctggcctttgagctgaccggccagatcgtgcacgccctgcctgtgctgatggctgtgctggccgccaatgccatcgcccagagctgccagcccagcttctatgatggcaccatcatcgtgaagaagctgccctacctgccccgcatcctgggcaggaacatcggcagccaccacgtgcgggtggagcacttcatgaaccacagcatcaccaccctggccaaggacacccccctggaggaggtggtgaaggtggtgaccagcacagatgtgacagagtaccccctggtggagagcacagagagccagatcctggtgggcatcgtgcagagggcccagctggtgcaggccctgcaggccgagccccccagccgggcccctggccaccagtgcctgcaggacatcctggcccggggctgccccacagagcctgtgaccctgaccctcttcagcgagaccaccctgcaccaggcccagaacctcttcaagctgctgaacctgcagagcctgtttgtgaccagccggggccgggctgtgggctgtgtgtcctgggtggagatgaagaaggccatcagcaacctgaccaaccccccagcccccaagtag

SEQ ID NO: 147370 - DNA, 2061 bp, Artificial Sequence; identical to SEQ ID NO: 147369
  Description of Artificial Sequence: Synthetic coding sequence

SEQ ID NO: 147371 - DNA, 1935 bp, Artificial Sequence
  Description of Artificial Sequence: Synthetic coding sequence
atggaggagctggtgggcctgcgggagggcttcagcggggaccctgtgaccctgcaggagctgtggggcccctgcccccacatcagaagagccatccagggcggcctggagtggctgaagcagaaggtgttccggctgggggaggactggtacttcctgatgaccctgggcgtgctgatggccctggtgtcctatgccatgaactttgccatcggctgtgtggtgcggggcagcggcatccctgagctgaagaccatgctggccggggtcatcctggaggactacctggacatcaagaactttggagccaaggtggtgggcctgagctgcaccctggccaccggcagcaccctcttcctgggcaaggtgggcccctttgtgcacctgtctgtgatgattgctgcctacctgggccgggtgaggaccaccaccatcggggagcctgagaacaagagcaagcagaatgagatgctggtggccgctgctgctgtgggcgtggccaccgtgtttgctgcccccttctctggagtgctcttcagcattgaggtgatgagcagccacttctctgtgcgggactactggaggggcttctttgctgccacctgtggggccttcatcttccggctgctggccgtgttcaacagcgagcaggagaccatcaccagcctgtacaagaccagcttccgggtggatgtgccctttgacctgcctgagatcttcttctttgtggccctgggcggcatctgtggggtgctgagctgtgcctacctgttctgccagaggaccttcctgtccttcatcaagaccaaccgctacagcagcaagctgctggccaccagcaagcctgtgtacagcgccctggccaccctgctgctggccagcatcacctacccacctggggtgggccacttcctggccagccggctgtccatgaagcagcacctggacagcctgtttgacaaccacagctgggccctgatgacccagaacagcagccccccctggccagaggagctggacccccagcacctgtggtgggagtggtaccacccccgcttcaccatcttcggcaccctggccttcttcctggtgatgaagttctggatgctgatcctggccaccaccatccccatgcctgctggctacttcatgcccatcttcatcctgggcgccgccatcggccgcctgctgggggaggccctggccgtggccttccctgagggcatcgtgactggaggagtgaccaaccccatcatgcctgggggctacgccctggccggggctgctgccttcagcggggctgtgacccacaccatcagcacagccctgctggcctttgagctgaccggccagatcgtgcacgccctgcctgtgctgatggctgtgctggccgccaatgccatcgcccagagctgccagcccagcttctatgatggcaccatcatcgtgaagaagctgccctacctgccccgcatcctgggcagaaatattggcagccaccacgtgcgggtggagcacttcatgaaccacagcatcaccaccctggccaaggacacccccctggaggaggtggtgaaggtggtgaccagcacagatgtgacagagtaccccctggtggagagcacagagagccagatcctggtgggcatcgtgcagagggcccagctggtgcaggccctgcaggccgagccccccagccgggcccctggccaccagcagtgcctgcaggacatcctggcccggggctgccccacagagcctgtgaccctgaccctcttcagcgagaccaccctgcaccaggcccagaacctcttcaagctgctgaacctgcagagcctgtttgtgaccagccggggccgggctgtgggctgtgtgtcctgggtggagatgaagaaggccatcagcaacctgaccaaccccccagcccccaagtag

SEQ ID NO: 147372 - DNA, 1389 bp, Artificial Sequence
  Description of Artificial Sequence: Synthetic coding sequence
atggaggagtttgtgggcctgcgggagggcagcagcggcaaccctgtgaccctgcaggagctgtggggcccctgcccccgcatcagaagaggcatccggggcggcctggagtggctgaagcagaagctgttccggctgggggaggactggtacttcctgatgaccctgggcgtgctgatggccctggtgtcctgtgccatggacctggccgtggagagcgtggtgcgggcccaccagtggctgtaccgggagattggagacagccacctgctgcgctacctgtcctggacagtgtaccctgtggccctggtgtccttcagcagcggcttcagccagagcatcacccccagcagcggcggcagcggcatccctgaggtgaagaccatgctggccggcgtggtgctggaggactacctggacatcaagaactttggagccaaggtggtgggcctgagctgcaccctggcctgtggcagcaccctcttcctgggcaaggtgggcccctttgtgcacctgtctgtgatgatggccgcctacctgggccgggtgaggaccaccaccatcggggagcctgagaacaagagcaagcctgtgtacagcgccctggccaccctggtgctggccagcatcacctacccaccttctgctggccgcttcctggccagccggctgtccatgaagcagcacctggacagcctgtttgacaaccacagctgggccctgatgacccagaacagcagccccccctggccagaggagctggacccccagcacctgtggtgggagtggtaccacccccgcttcaccatcttcggcaccctggccttcttcctggtgatgaagttctggatgctgatcctggccaccaccatccccatgcctgctggctacttcatgcccatctttgtgtatggagctgccatcggccgcctgtttggagagaccctgtccttcatcttccctgagggcatcgtggccggcggcatcaccaaccccatcatgcctgggggctacgccctggccggggccgccgccttctctggagctgtgacccacaccatcagcacagccctgctggcctttgaggtgacaggccagatcgtgcacgccctgcctgtgctgatggctgtgctggccgccaatgccatcgcccagagctgccagcccagcttctatgatggcaccgtgattgtgaagaagctgccctacctgccccgcatcctgggcaggaacatcggcagccaccgggtgcgggtggagcacttcatgaaccacagcatcaccaccctggccatcaccctgatgaatgatgaaattggagtgcactgccaccagggccaggcccagatgcccagcggcgtggtgtggttccctgtgcggggcagctag

SEQ ID NO: 147373 - DNA, 1554 bp, Artificial Sequence
  Description of Artificial Sequence: Synthetic coding sequence
atgccctgcccccccctgctgtctgtgcctgtgcgggccgccggggagcaggaccgctgggtgcgggaggaggtgacctggggcggcggccccaccgtgactggaggctggggctggagggcccacctgcggtctgtgagccccccaggagtgctcttcagcattgaggtgatgagcagccacttctctgtgtgggactactggaggggcttctttgctgccacctgtggggccttcatgttccggctgctggccgtgttcaacagcgagcaggagaccatcaccagcctgtacaagaccagcttccgggtggatgtgccctttgacctgcctgagatcttcttctttgtggccctgggcggcctgtgtggcatcctgggcagcgcctacctgttctgccagaggatcttcttcggcttcatccggaacaaccgcttcagcagcaagctgctggccaccagcaagcctgtgtacagcgccctggccaccctggtgctggccagcatcacctacccacccagcgctggccgcttcctggccagccggctgtccatgaagcagcacctggacagcctgtttgacaaccacagctgggccctgatgacccagaacagcagccccccctggccagaggagctggacccccagcacctgtggtgggagtggtaccacccccgcttcaccatcttcggcaccctggccttcttcctggtgatgaagttctggatgctgatcctggccaccaccatccccatgcctgctggctacttcatgcccatctttgtgtatggagctgccatcggccgcctgtttggagagaccctgtccttcatcttccctgagggcatcgtggccggcggcatcaccaaccccatcatgcctgggggctacgccctggccggggctgctgccttcagcggggctgtgacccacaccatcagcacagccctgctggcctttgaggtgacaggccagatcgtgcacgccctgcctgtgctgatggctgtgctggccgccaatgccatcgcccagagctgccagcccagcttctatgatggcaccgtcatcgtgaagaagctgccctacctgccccgcatcctgggcagaaatattggcagccaccgggtgcgggtggagcacttcatgaaccacagcatcaccaccctggccaaggacatgcccctggaggaggtggtgaaggtggtgaccagcacagatgtggccaagtaccccctggtggagagcacagagagccagatcctggtgggcatcgtgcggcgggcccagctggtgcaggccctgaaggccgagccccccagctgggcccctggccaccagtgcctgcaggacatcctggccgccggctgccccacagagcctgtgaccctgaagctgagccctgagaccagcctgcacgaggcccacaacctgtttgagctgctgaacctgcacagcctgtttgtgaccagccggggccgggctgtgggctgtgtgtcctgggtggagatgaagaaggccatcagcaacctgaccaaccccccagcccccaagtag

SEQ ID NO: 147374 - DNA, 468 bp, Artificial Sequence
  Description of Artificial Sequence: Synthetic coding sequence
atggctgtgctggccgccaatgccatcgcccagagctgccagcccagcttctatgatggcaccgtgattgtgaagaagctgccctacctgccccgcatcctgggcaggaacatcggcagccaccgggtgcgggtggagcacttcatgaaccacagcatcaccaccctggccaaggacatgcccctggaggaggtggtgaaggtggtgaccagcacagatgtggccaagtaccccctggtggagagcacagagagccagatcctggtgggcatcgtgagaagagcccagctggtgcaggccctgaaggccgagcccccatcctgggcccctggccaccagtgcctgcaggacatcctggccgccggctgccccacagagcctgtgaccctgaagctgagccctgagaccagcctgcacgaggcccagatgcccagcggcgtggtgtggttccctgtgcggggcagctag

SEQ ID NO: 147375 - DNA, 2064 bp, Artificial Sequence
  Description of Artificial Sequence: Synthetic coding sequence
atggaggagtttgtgggcctgcgggagggcagcagcggcaaccctgtgaccctgcaggagctgtggggcccctgcccccgcatcagaagaggcatccggggcggcctggagtggctgaagcagaagctgttccggctgggggaggactggtacttcctgatgaccctgggcgtgctgatggccctggtgtcctgtgccatggacctggccgtggagagcgtggtgcgggcccaccagtggctgtaccgggagattggagacagccacctgctgcgctacctgtcctggacagtgtaccctgtggccctggtgtccttcagcagcggcttcagccagagcatcacccccagcagcggcggcagcggcatccctgaggtgaagaccatgctggccggcgtggtgctggaggactacctggacatcaagaactttggagccaaggtggtgggcctgagctgcaccctggcctgtggcagcaccctcttcctgggcaaggtgggcccctttgtgcacctgtctgtgatgatggccgcctacctgggccgggtgaggaccaccaccatcggggagcctgagaacaagagcaagcagaatgagatgctggtggccgctgctgctgtgggcgtggccaccgtgtttgctgcccccttcagcggcgtgctcttcagcattgaggtgatgagcagccacttctctgtgtgggactactggaggggcttctttgctgccacctgtggggccttcatgttccggctgctggccgtgttcaacagcgagcaggagaccatcaccagcctgtacaagaccagcttccgggtggatgtgccctttgacctgcctgagatcttcttctttgtggccctgggcggcctgtgtggcatcctgggcagcgcctacctgttctgccagaggatcttcttcggcttcatccggaacaaccgcttcagcagcaagctgctggccaccagcaagcctgtgtacagcgccctggccaccctggtgctggccagcatcacctacccaccttctgctggccgcttcctggccagccggctgtccatgaagcagcacctggacagcctgtttgacaaccacagctgggccctgatgacccagaacagcagccccccctggccagaggagctggacccccagcacctgtggtgggagtggtaccacccccgcttcaccatcttcggcaccctggccttcttcctggtgatgaagttctggatgctgatcctggccaccaccatccccatgcctgctggctacttcatgcccatctttgtgtatggagctgccatcggccgcctgtttggagagaccctgtccttcatcttccctgagggcatcgtggccggcggcatcaccaaccccatcatgcctgggggctacgccctggccggggccgccgccttctctggagctgtgacccacaccatcagcacagccctgctggcctttgaggtgacaggccagatcgtgcacgccctgcctgtgctgatggctgtgctggccgccaatgccatcgcccagagctgccagcccagcttctatgatggcaccgtgattgtgaagaagctgccctacctgccccgcatcctgggcaggaacatcggcagccaccgggtgcgggtggagcacttcatgaaccacagcatcaccaccctggccaaggacatgcccctggaggaggtggtgaaggtggtgaccagcacagatgtggccaagtaccccctggtggagagcacagagagccagatcctggtgggcatcgtgagaagagcccagctggtgcaggccctgaaggccgagcccccatcctgggcccctggccaccagcagtgcctgcaggacatcctggccgccggctgccccacagagcctgtgaccctgaagctgagccctgagaccagcctgcacgaggcccacaacctgtttgagctgctgaacctgcacagcctgtttgtgaccagccggggccgggctgtgggctgtgtgtcctgggtggagatgaagaaggccatcagcaacctgaccaaccccccagcccccaagtag

SEQ ID NO: 147376 - DNA, 441 bp, Artificial Sequence
  Description of Artificial Sequence: Synthetic coding sequence
gcccagagctgccagcccagcttctatgatggcaccgtcatcgtgaagaagctgccctacctgccccgcatcctgggcagaaatattggcagccaccgggtgcgggtggagcacttcatgaaccacagcatcaccaccctggccaaggacatgcccctggaggaggtggtgaaggtggtgaccagcacagatgtggccaagtaccccctggtggagagcacagagagccagatcctggtgggcatcgtgcggcgggcccagctggtgcaggccctgaaggccgagccccccagctgggcccctggccaccagtgcctgcaggacatcctggccgccggctgccccacagagcctgtgaccctgaagctgagccctgagaccagcctgcacgaggcccagatgcccagcggcgtggtgtggttccctgtgcggggcagctag

SEQ ID NO: 147377 - DNA, 2646 bp, Artificial Sequence
  Description of Artificial Sequence: Synthetic coding sequence
atggctgctgctgctgctgaggagggcatggagccccgggccctgcagtatgagcagaccctgatgtatggccgctacacccaggacctgggcgcctttgccaaggaggaggccgcccgcatccggctgggcggccctgagccctggaagggcccccccagcagcagagctgcccctgagctgctggagtatggccgcagccgctgtgcccgctgccgggtgtgcagcgtgcgctgccacaagttcctggtgtcccgggtgggggaggactggatcttcctggtgctgctgggcctgctgatggccctggtgtcctgggtgatggactatgccatcgccgcctgcctgcaggcccagcagtggatgagccggggcctgaacaccagcatcctgctgcagtacctggcctgggtgacctaccctgtggtgctgatcaccttctctgctggcttcacccagatcctggccccccaggccgtgggcagcggcatccctgagatgaagaccatcctgcggggcgtggtgctgaaggagtacctgaccctgaagaccttcatcgccaaggtgattggcctgacctgtgccctgggcagcggcatgcccctgggcaaggagggcccctttgtgcacatcgcctccatgtgtgccgccctgctgagcaagttcctgagcctgtttggaggcatctatgaaaatgaaagcaggaacacagagatgctggccgccgcctgtgctgtgggcgtgggctgctgctttgctgcccccatcggcggcgtgctcttcagcattgaggtgaccagcaccttctttgctgtgaggaactactggaggggcttctttgctgccaccttcagcgccttcatcttccgggtgctggccgtgtggaacagagatgaggagaccatcacagccctcttcaagacccgcttccggctggacttcccctttgacctgcaggagctgcctgcctttgctgtgattggaattgccagcggctttggaggagccctgtttgtgtacctgaacaggaagatcgtgcaggtgatgaggaagcagaagaccatcaaccgcttcctgatgaggaagaggctgctcttccctgccctggtgaccctgctgatcagcaccctgaccttccccccaggcttcggccagttcatggccggccagctgagccagaaggagaccctggtgaccctgtttgacaacagaacctgggtgcggcagggcctggtggaggagctggagccccccagcaccagccaggcctggaaccccccccgggccaacgtgttcctgaccctggtgatcttcatcctgatgaagttctggatgtctgccctggccaccaccatccctgtgccctgtggggccttcatgcctgtgtttgtgattgatggcatccacacagacagcagcacctacagaattgtgcctgggggctatgctgtggtgggcgccgccgccctggccggggctgtgacccacacagtgtccacagctgtgattgtgtttgagctgaccggccagatcgcccacatcctgcctgtgatgattgctgtgatcctggccaatgctgtggcccagagcctgcagcccagcctgtatgacagcatcatccgcatcaagaagctgccctacctgcctgagctgggctggggccgccaccagcagtacagagtgcgggtggaggacatcatggtgagagatgtgccccacgtggccctgagctgcaccttccgggacctgcggctggccctgcacaggaccaagggccgcatgctggccctggtggagagccctgagagcatgatcctgctgggcagcattgaaagaagccaggtggtggccctgctgggcgcccagctgagccctgcccggcggcggcagcacatgcaggagcggcgggccacccagaccagccccctgagtgaccaggagggcccccccaccccagaggcctctgtgtgcttccaggtgaacacagaagattctgccttccctgctgcccggggggagacccacaagcccctgaagccagccctgaagaggggccccagcgtgaccaggaacctgggggagagccccactggatctgctgagagcgctggcatcgccctgcggagcctcttctgtggcagccccccacctgaggccgccagcgagaagctggagagctgtgagaagaggaagctgaagagggtgcgcatcagcctggccagtgatgctgacctggagggggagatgagccctgaggagatcctggagtgggaggagcagcagctggatgagcctgtgaacttcagtgactgcaagattgatcctgcccccttccagctggtggagaggaccagcctgcacaagacccacaccatcttcagcctgctgggcgtggaccacgcctacgtgaccagcatcggccgcctcatcggcatcgtgaccctgaaggagctgaggaaggccatcgagggctctgtgacagcccagggcgtgaaggtgcggccccccctggccagcttccgggacagcgccaccagcagcagtgacacagagaccacagaggtgcacgccctgtggggcccccacagcagacatggcctgccccgggagggcagccccagcgacagtgatgacaagtgccagtag

SEQ ID NO: 147378 - DNA, 2565 bp, Artificial Sequence
  Description of Artificial Sequence: Synthetic coding sequence
atggctgctgctgctgctgaggagggcatggagccccgggccctgcagtatgagcagaccctgatgtatggccgctacacccaggacctgggcgcctttgccaaggaggaggccgcccgcatccggctgggcggccctgagccctggaagggcccccccagcagcagagctgcccctgagctgctggagtatggccgcagccgctgtgcccgctgccgggcccagcagtggatgagccggggcctgaacaccagcatcctgctgcagtacctggcctgggtgacctaccctgtggtgctgatcaccttctctgctggcttcacccagatcctggccccccaggccgtgggcagcggcatccctgagatgaagaccatcctgcggggcgtggtgctgaaggagtacctgaccctgaagaccttcatcgccaaggtgattggcctgacctgtgccctgggcagcggcatgcccctgggcaaggagggcccctttgtgcacatcgcctccatgtgtgccgccctgctgagcaagttcctgagcctgtttggaggcatctatgaaaatgaaagcaggaacacagagatgctggccgccgcctgtgctgtgggcgtgggctgctgctttgctgcccccatcggcggcgtgctcttcagcattgaggtgaccagcaccttctttgctgtgaggaactactggaggggcttctttgctgccaccttcagcgccttcatcttccgggtgctggccgtgtggaacagagatgaggagaccatcacagccctcttcaagacccgcttccggctggacttcccctttgacctgcaggagctgcctgcctttgctgtgattggaattgccagcggctttggaggagccctgtttgtgtacctgaacaggaagatcgtgcaggtgatgaggaagcagaagaccatcaaccgcttcctgatgaggaagaggctgctcttccctgccctggtgaccctgctgatcagcaccctgaccttccccccaggcttcggccagttcatggccggccagctgagccagaaggagaccctggtgaccctgtttgacaacagaacctgggtgcggcagggcctggtggaggagctggagccccccagcaccagccaggcctggaaccccccccgggccaacgtgttcctgaccctggtgatcttcatcctgatgaagttctggatgtctgccctggccaccaccatccctgtgccctgtggggccttcatgcctgtgtttgtgattggagctgccttcggccgcctggtgggggagagcatggccgcctggttcccagatggcatccacacagacagcagcacctaccgcatcgtgcctgggggctatgctgtggtgggcgctgctgccctggccggggctgtgacccacacagtgtccacagctgtgattgtgtttgagctgaccggccagatcgcccacatcctgcctgtgatgattgctgtgatcctggccaatgctgtggcccagagcctgcagcccagcctgtatgacagcatcatccgcatcaagaagctgccctacctgcctgagctgggctggggccgccaccagcagtacagagtgcgggtggaggacatcatggtgagagatgtgccccacgtggccctgagctgcaccttccgggacctgcggctggccctgcacaggaccaagggccgcatgctggccctggtggagagccctgagagcatgatcctgctgggcagcattgaaagaagccaggtggtggccctgctgggcgcccagctgagccctgcccggcggcggcagcacatgcaggagcggcgggccacccagaccagccccctgagtgaccaggagggcccccccaccccagaggcctctgtgtgcttccaggtgaacacagaggacagcgccttccctgctgcccggggggagacccacaagcccctgaagccagccctgaagaggggccccagcgtgaccaggaacctgggggagagccccaccggcagcgctgagagcgctggcatcgccctgcggagcctcttctgtggcagccccccacctgaggccgccagcgagaagctggagagctgtgagaagaggaagctgaagagggtgcgcatcagcctggccagtgatgctgacctggagggggagatgagccctgaggagatcctggagtgggaggagcagcagctggatgagcctgtgaacttcagtgactgcaagattgatcctgcccccttccagctggtggagaggaccagcctgcacaagacccacaccatcttcagcctgctgggcgtggaccacgcctacgtgaccagcatcggccgcctgattggaattgtgaccctgaaggagctgaggaaggccatcgagggctctgtgacagcccagggcgtgaaggtgcggccccccctggccagcttccgggacagcgccaccagcagcagtgacacagagaccacagaggtgcacgccctgtggggcccccacagccgccacggcctgccccgggagggcagccccagcgacagtgatgacaagtgccagtag

SEQ ID NO: 147379 - DNA, 2610 bp, Artificial Sequence
  Description of Artificial Sequence: Synthetic coding sequence
atggctgctgctgctgctgaggagggcatggagccccgggccctgcagtatgagcagaccctgatgtatggccgctacacccaggacctgggcgcctttgccaaggaggaggccgcccgcatccggctgggcggccctgagccctggaagggcccccccagcagcagagctgcccctgagctgctggagtatggccgcagccgctgtgcccgctgccgggtgtgcagcgtgcgctgccacaagttcctggtgtcccgggtgggggaggactggatcttcctggtgctgctgggcctgctgatggccctggtgtcctgggtgatggactatgccatcgccgcctgcctgcaggcccagcagtggatgagccggggcctgaacaccagcatcctgctgcagtacctggcctgggtgacctaccctgtggtgctgatcaccttctctgctggcttcacccagatcctggccccccaggccgtgggcagcggcatccctgagatgaagaccatcctgcggggcgtggtgctgaaggagtacctgaccctgaagaccttcatcgccaaggtgattggcctgacctgtgccctgggcagcggcatgcccctgggcaaggagggcccctttgtgcacatcgcctccatgtgtgccgccctgctgagcaagttcctgagcctgtttggaggcatctatgaaaatgaaagcaggaacacagagatgctggccgccgcctgtgctgtgggcgtgggctgctgctttgctgcccccatcggcggcgtgctcttcagcattgaggtgaccagcaccttctttgctgtgaggaactactggaggggcttctttgctgccaccttcagcgccttcatcttccgggtgctggccgtgtggaacagagatgaggagaccatcacagccctcttcaagacccgcttccggctggacttcccctttgacctgcaggagctgcctgcctttgctgtgattggaattgccagcggctttggaggagccctgtttgtgtacctgaacaggaagatcgtgcaggtgatgaggaagcagaagaccatcaaccgcttcctgatgaggaagaggctgctcttccctgccctggtgaccctgctgatcagcaccctgaccttccccccaggcttcggccagttcatggccggccagctgagccagaaggagaccctggtgaccctgtttgacaacagaacctgggtgcggcagggcctggtggaggagctggagccccccagcaccagccaggcctggaaccccccccgggccaacgtgttcctgaccctggtgatcttcatcctgatgaagttctggatgtctgccctggccaccaccatccctgtgccctgtggggccttcatgcctgtgtttgtgattggagctgccttcggccgcctggtgggggagagcatggccgcctggttcccagatggcatccacacagacagcagcacctaccgcatcgtgcctgggggctatgctgtggtgggcgctgctgccctggccggggctgtgacccacacagtgtccacagctgtgattgtgtttgagctgaccggccagatcgcccacatcctgcctgtgatgattgctgtgatcctggccaatgctgtggcccagagcctgcagcccagcctgtatgacagcatcatccgcatcaagaagctgccctacctgcctgagctgggctggggccgccaccagcagtacagagtgcgggtggaggacatcatggtgagagatgtgccccacgtggccctgagctgcaccttccgggacctgcggctggccctgcacaggaccaagggccgcatgctggccctggtggagagccctgagagcatgatcctgctgggcagcattgaaagaagccaggtggtggccctgctgggcgcccagctgagccctgcccggcggcggcagcacatgcaggagcggcgggccacccagaccagccccctgagtgaccaggagggcccccccaccccagaggcctctgtgtgcttccaggtgaacacagaggacagcgccttccctgctgcccggggggagacccacaagcccctgaagccagccctgaagaggggccccagcgtgaccaggaacctgggggagagccccaccggcagcgctgagagcgctggcatcgccctgcggagcctcttctgtggcagccccccacctgaggccgccagcgagaagctggagagctgtgagaagaggaagctgaagagggtgcgcatcagcctggccagtgatgctgacctggagggggagatgagccctgaggagatcctggagtgggaggagcagcagctggatgagcctgtgaacttcagtgactgcaagattgatcctgcccccttccagctggtggagaggaccagcctgcacaagctgaggaaggccatcgagggctctgtgacagcccagggcgtgaaggtgcggccccccctggccagcttccgggacagcgccaccagcagcagtgacacagagaccacagaggtgcacgccctgtggggcccccacagcagacatggcctgccccgggagggcagccccagcgacagtgatgacaagtgccagtag

SEQ ID NO: 147380 - DNA, 714 bp, Artificial Sequence
  Description of Artificial Sequence: Synthetic coding sequence
atgtccttcctgaagagcttccccccacctggccctgctgagggcctgctgcggcagcagcctgacacagaagctgtgctgaatggcaagggcctgggcaccggcaccctgtacatcgccgagagccggctgtcctggctggatggcagcggcctgggcttcagcctggagtaccccaccatcagcctgcacgccctgagccgggacagaagtgactgcctgggggagcacctgtatgtgatggtgaatgccaagtttgaggaggagagcaaggagcctgtggctgatgaggaggaggaggacagtgatgatgatgtggagcccatcacagagttccgctttgtgcccagcgacaagagcgccctggaggccatgttcaccgccatgtgtgagtgccaggccctgcacccagaccctgaagatgaggacagtgatgattatgatggagaggagtatgatgtggaggcccacgagcagggccagggcgacatccccaccttctacacctatgaggagggcctgagccacctgacagctgagggccaggccaccctggagcggctggagggcatgctgagccagagcgtgagcagccagtacaacatggccggcgtgaggacagaggacagcatccgggactatgaagatggcatggaggtggacaccacccccaccgtggccggccagtttgaagatgctgatgtggaccactag

SEQ ID NO: 147381 - DNA, 714 bp, Artificial Sequence; identical to SEQ ID NO: 147380
  Description of Artificial Sequence: Synthetic coding sequence

SEQ ID NO: 147382 - DNA, 504 bp, Artificial Sequence
  Description of Artificial Sequence: Synthetic coding sequence
atggtgctgctgctgaagggcgtgcccttcaccctgaccaccgtggacacccggcgcagcccagatgtgctgaaggactttgcccctggcagccagctgcccatcctgctgtatgacagtgatgccaagacagacaccctgcagatcgaggacttcctggaggagaccctgggccccccagacttccccagcctggccccccgctaccgggagagcaacacagctggaaatgatgtgttccacaagttcagcgccttcatcaagaaccctgtgcctgcccaggatgaggccctgtaccagcagctgctgcgggccctggcccggctggacagctacctgcgggcccccctggagcacgagctggccggggagccccagctgcgggagagcagaagacgcttcctggatggagaccggctgaccctggccgactgcagcctgctgcccaagctgcacatcgtggacacagtgtgtgcccacttccggcaggcccccatcccctag

SEQ ID NO: 147383 - DNA, 711 bp, Artificial Sequence
  Description of Artificial Sequence: Synthetic coding sequence
atggccgagaccaagctgcagctgtttgtgaaggcctctgaagatggagagagcgtgggccactgccccagctgccagaggctcttcatggtgctgctgctgaagggcgtgcccttcaccctgaccaccgtggacaccaggaggagcccagatgtgctgaaggactttgcccctggcagccagctgcccatcctgctgtatgacagtgatgccaagacagacaccctgcagatcgaggacttcctggaggagaccctgggccccccagacttccccagcctggccccccgctaccgggagagcaacacagctggaaatgatgtgttccacaagttcagcgccttcatcaagaaccctgtgcctgcccaggatgaggccctgtaccagcagctgctgcgggccctggcccggctggacagctacctgcgggcccccctggagcacgagctggccggggagccccagctgcgggagagcagaagacgcttcctggatggagaccggctgaccctggccgactgcagcctgctgcccaagctgcacatcgtggacacagtgtgtgcccacttccggcaggcccccatcccagctgagctgcggggcgtgcggcgctacctggacagcgccatgcaggagaaggagttcaagtacacctgcccccacagcgctgagatcctggccgcctacagacctgctgtgcaccccaggtag

SEQ ID NO: 147384 - DNA, 348 bp, Artificial Sequence
  Description of Artificial Sequence: Synthetic coding sequence
atgaacagcggcgtgtgcctgtgtgtgctgatggctgtgctggccgccggggccctgacccagcctgtgcccccagctgaccctgctggcagcggcctgcagagagctgaggaggccccccggcggcagctgcgggtgtcccagaggacagatggagagagccgggcccacctgggcgccctgctggcccgctacatccagcaggccaggaaggcccccagcggccgcatgagcatcgtgaagaacctgcagaacctggaccccagccaccgcatcagtgaccgggactacatgggctggatggactttggaagaagatctgctgaggagtatgagtaccccagctag

SEQ ID NO: 147385 - DNA, 348 bp, Artificial Sequence; identical to SEQ ID NO: 147384
  Description of Artificial Sequence: Synthetic coding sequence

SEQ ID NO: 147386 - DNA, 348 bp, Artificial Sequence; identical to SEQ ID NO: 147384
  Description of Artificial Sequence: Synthetic coding sequence

SEQ ID NO: 147387 - DNA, 1287 bp, Artificial Sequence
  Description of Artificial Sequence: Synthetic coding sequence
atggatgtggtggacagcctgctggtgaatggcagcaacatcaccccaccctgtgagctgggcctggagaatgagaccctcttctgcctggaccagccccggcccagcaaggagtggcagcctgctgtgcagatcctgctgtacagcctcatcttcctgctgtctgtgctgggcaacaccctggtgatcaccgtgctgatccggaacaagaggatgaggacagtgaccaacatcttcctgctgagcctggccgtgtctgacctgatgctgtgcctcttctgcatgcccttcaacctgatccccaacctgctgaaggacttcatctttggatctgctgtgtgcaagaccaccacctacttcatgggcacctctgtgtctgtgtccaccttcaacctggtggccatcagcctggagcgctacggggccatctgcaagcccctgcagagccgggtgtggcagaccaagagccacgccctgaaggtgattgctgccacctggtgcctgtccttcaccatcatgaccccctaccccatctacagcaacctggtgcccttcaccaagaacaacaaccagacagccaacatgtgccgcttcctgctgcccaatgatgtgatgcagcagagctggcacaccttcctgctgctgatcctcttcctgatccctggcatcgtgatgatggtggcctacggcctcatcagcctggagctgtaccagggcatcaagtttgaggccagccagaagaagagcgccaaggagaggaagcccagcaccaccagcagcggcaagtatgaggacagtgatggctgctacctgcagaagacccggccccccaggaagctggagctgcggcagctgagcacaggcagcagcagccgggccaaccgcatccgcagcaacagcagcgctgccaacctgatggccaagaagagggtcatccgcatgctgattgtcatcgtggtgctcttcttcctgtgctggatgcccatcttcagcgccaatgcctggagggcctatgacacagccagcgctgagcggcggctgagcggcacccccatctccttcatcctgctgctgagctacaccagcagctgtgtgaaccccatcatctactgcttcatgaacaagcgcttccggctgggcttcatggccaccttcccctgctgccccaaccctggccccccaggggcccggggggaggtgggggaggaggaggagggcggcaccactggagccagcctgagccgcttctcctacagccacatgtctgcctctgtgcccccccagtag

SEQ ID NO: 147388 - DNA, 1344 bp, Artificial Sequence
  Description of Artificial Sequence: Synthetic coding sequence
atggagctgctgaagctgaacagatctgtgcagggcactggacctggccctggggccagcctgtgcaggcctggggcccccctgctgaacagcagctctgtgggcaacctgagctgtgagcccccacgcatcagaggagctggcacccgggagctggagctggccatccgcatcaccctgtatgctgtgatcttcctgatgtctgtgggcggcaacatgctgatcatcgtggtgctgggcctgagccggcggctgaggacagtgaccaatgccttcctgctgagcctggccgtgtctgacctgctgctggccgtggcctgcatgcccttcaccctgctgcccaacctgatgggcaccttcatcttcggcaccgtcatctgcaaggctgtgtcctacctgatgggcgtgtctgtgtctgtgtccaccctgagcctggtggccatcgccctggagcgctacagcgccatctgccggcccctgcaggcccgggtgtggcagaccaggagccatgctgcccgggtgattgtggccacctggctgctgagcggcctgctgatggtgccctaccctgtgtacacagtggtgcagcctgtgggcccccgggtgctgcagtgtgtgcaccgctggcccagcgcccgggtgcggcagacctggagcgtgctgctgctgctgctgctcttcttcatccctggggtggtgatggctgtggcctacggcctcatcagccgggagctgtacctgggcctgcgctttgatggagacagcgacagcgacagccagagccgggtgaggaaccagggcggcctgcccggggctgtgcaccagaatggccgctgcaggcctgagactggagctgtgggggaggacagtgatggctgctacgtgcagctgcccaggagcaggcctgccctggagctgacagccctgacagcccctggccctggcagcggcagccggcccacccaggccaagctgctggccaagaagagggtggtgaggatgctgctggtgattgtggtgctcttcttcctgtgctggctgcctgtgtacagcgccaacacctggagggcctttgatggccctggggcccaccgggccctgagcggggcccccatctccttcatccacctgctgtcctatgccagcgcctgtgtgaaccccctggtgtactgcttcatgcaccggcgcttccggcaggcctgcctggagacctgtgcccgctgctgcccccggcccccccgggcccggccccgggccctgcctgatgaagatcctcccacccccagcatcgccagcctgagccggctgagctacaccaccatcagcaccctgggccctggatag

SEQ ID NO: 147389 - DNA, 1551 bp, Artificial Sequence
  Description of Artificial Sequence: Synthetic coding sequence
atggagctgctgaagctgaacagatctgtgcagggcactggacctggccctggggccagcctgtgcaggcctggggcccccctgctgaacagcagctctgtgggcaacctgagctgtgagcccccacgcatcagaggagctggcacccgggagctggagctggccatccgcatcaccctgtatgctgtgatcttcctgatgtctgtgggcggcaacatgctgatcatcgtggtgctgggcctgagccggcggctgaggacagtgaccaatgccttcctgctgagcctggccgtgtctgacctgctgctggccgtggcctgcatgcccttcaccctgctgcccaacctgatgggcaccttcatcttcggcaccgtcatctgcaaggctgtgtcctacctgatgggcgtgtctgtgtctgtgtccaccctgagcctggtggccatcgccctggagcgctacagcgccatctgccggcccctgcaggcccgggtgtggcagaccaggagccatgctgcccgggtgattgtggccacctggctgctgagcggcctgctgatggtgccctaccctgtgtacacagtggtgcagcctgtgggcccccgggtgctgcagtgtgtgcaccgctggcccagcgcccgggtgcggcagacctggagcgtgctgctgctgctgctgctcttcttcatccctggggtggtgatggctgtggcctacggcctcatcagccgggagctgtacctgggcctgcgctttgatggagacagcgacagcgacagccagagccgggtgaggaaccagggcggcctgcccggcggggccggcccccgggagcagaacctgggggaggccgagctgtggagggccactggacctgctggggtgggcggcacagagatgaaggtgcgggtgcggaggaagctggagatggagctgtcctgggagaggagaagtggaggagactgggccggggactggggagacagccccttcagcctgacagcccaccccctgtgcagcggggctgtgcaccagaatggccgctgcaggcctgagaccggggctgtgggagaagattctgatggctgctacgtgcagctgcccaggagcaggcctgccctggagctgacagccctgacagcccctggccctggcagcggcagccggcccacccaggccaagctgctggccaagaagagggtggtgaggatgctgctggtgattgtggtgctcttcttcctgtgctggctgcctgtgtacagcgccaacacctggagggcctttgatggccctggggcccaccgggccctgagcggggcccccatctccttcatccacctgctgtcctatgccagcgcctgtgtgaaccccctggtgtactgcttcatgcaccggcgcttccggcaggcctgcctggagacctgtgcccgctgctgccccaggcctccccgggcccggccccgggccctgcctgatgaggacccccccacccccagcatcgccagcctgagccggctgagctacaccaccatcagcaccctgggccctggatag

SEQ ID NO: 147390 - DNA, 819 bp, Artificial Sequence
  Description of Artificial Sequence: Synthetic coding sequence
atgagctgccacaactgcagcgacccccaggtgctgtgcagcagcggccagctgttcctgcagcccctgtgggaccacctgcgctcctgggaggccctgctgcagagccccttcttccctgtgatcttcagcatcaccacctacgtgggcttctgcctgccctttgtggtgctggacatcctgtgctcctgggtgcctgccctgcggcgctacaagatccacccagacttcagccccagcgcccagcagctgctgccctgcctgggccagaccctgtaccagcacgtgatgtttgtgtttcctgtgaccctgctgcactgggcccggagccctgccctgctgccccatgaggcccctgagctgctgctgctgctgcaccacatcctcttctgcctgctgctgtttgacatggagttctttgtgtggcacctgctgcaccacaaggtgccctggctgtaccgcaccttccacaaggtgcaccaccagaacagcagcagctttgccctggccacccagtacatgtctgtgtgggagctgttcagcctgggcttctttgacatgatgaatgtgaccctgctgggctgccaccccctgaccaccctgaccttccacgtggtgaacatctggctgtctgtggaggaccacagcggctacaacttcccctggagcacccaccggctggtgcccttcggctggtatggaggagtggtgcaccacgacctgcaccacagccacttcaactgcaactttgccccctacttcacccactgggacaagatcctgggcaccctgaggacagcctctgtgcctgccaggtag

SEQ ID NO: 147391 - DNA, 1482 bp, Artificial Sequence
  Description of Artificial Sequence: Synthetic coding sequence
atgctggccgccaccgtgctgaccctggccctgctgggcaatgcccacgcctgcagcaagggcaccagccatgaggccggcatcgtgtgccgcatcaccaagccagccctgctggtgctgaaccacgagacagccaaggtgatccagacagccttccagagggccagctacccagacatcactggagagaaggccatgatgctgctgggccaggtgaagtatggcctgcacaacatccagatcagccacctgagcatcgccagcagccaggtggagctggtggaggccaagagcattgatgtgtccatccagaatgtgtctgtggtgttcaagggcaccctgaagtatggctacaccacagcctggtggctgggcatcgaccagagcattgactttgaaattgacagcgccatcgacctgcagatcaacacccagctgacctgtgacagcggccgggtgaggacagatgccccagactgctacctgtccttccacaagctgctgctgcacctgcagggcgagcgggagcccggctggatcaagcagctgttcaccaacttcatctccttcaccctgaagctggtgctgaagggccagatctgcaaggagatcaacgtcatcagcaacatcatggctgactttgtgcagaccagggctgccagcatcctgagtgatggagacatcggcgtggacatcagcctgactggagaccccgtcatcacagccagctacctggagagccaccacaagggccacttcatctacaagaatgtgtctgaggacctgcccctgcccaccttcagccccaccctgctgggggacagcaggatgctgtacttctggttcagcgagagggtcttccacagcctggccaaggtggccttccaggacggccgcctgatgctgagcctgatgggagatgagttcaaggctgtgctggagacctggggcttcaacaccaaccaggagatcttccaggaggtggtgggcggcttccccagccaggcccaggtgacagtgcactgcctgaagatgcccaagatcagctgccagaacaagggcgtggtggtgaacagctctgtgatggtgaagttcctgttccccaggccagaccagcagcacagcgtggcctacacctttgaggaggacatcgtgaccaccgtgcaggccagctacagcaagaagaagctgttcctgagcctgctggacttccagatcacccccaagacagtgagcaacctgacagagagcagcagcgagagcgtgcagagcttcctgcagagcatgatcacagctgtgggcatccctgaggtgatgagccggctggaggtggtgttcaccgccctgatgaacagcaaaggagtgtccctgtttgacatcatcaaccctgagatcatcaccagagatggcttcctgctgctgcagatggactttggcttccctgagcacctgctggtggacttcctgcagagcctgtcctag

SEQ ID NO: 147392 - DNA, 1302 bp, Artificial Sequence
  Description of Artificial Sequence: Synthetic coding sequence
atgctggccgccaccgtgctgaccctggccctgctgggcaatgcccacgcctgcagcaagggcaccagccatgaggccggcatcgtgtgccgcatcaccaagccagccctgctggtgctgaaccacgagacagccaaggtgatccagacagccttccagagggccagctacccagacatcactggagagaaggccatgatgctgctgggccaggtgaagtatggcctgcacaacatccagatcagccacctgagcatcgccagcagccaggtggagctggtggaggccaagagcattgatgtgtccatccagaatgtgtctgtggtgttcaagggcaccctgaagtatggctacaccacagcctggtggctgggcatcgaccagagcattgactttgaaattgacagcgccatcgacctgcagatcaacacccagctgacctgtgacagcggccgggtgaggacagatgccccagactgctacctgtccttccacaagctgctgctgcacctgcagggcgagcgggagcccggctggatcaagcagctgttcaccaacttcatctccttcaccctgaagctggtgctgaagggccagatctgcaaggagatcaacgtcatcagcaacatcatggctgactttgtgcagaccagggctgccagcatcctgagtgatggagacatcggcgtggacatcagcctgactggagaccccgtcatcacagccagctacctggagagccaccacaaggctgtgctggagacctggggcttcaacaccaaccaggagatcttccaggaggtggtgggcggcttccccagccaggcccaggtgacagtgcactgcctgaagatgcccaagatcagctgccagaacaagggcgtggtggtgaacagctctgtgatggtgaagttcctgttccccaggccagaccagcagcacagcgtggcctacacctttgaggaggacatcgtgaccaccgtgcaggccagctacagcaagaagaagctgttcctgagcctgctggacttccagatcacccccaagacagtgagcaacctgacagagagcagcagcgagagcgtgcagagcttcctgcagagcatgatcacagctgtgggcatccctgaggtgatgagccggctggaggtggtgttcaccgccctgatgaacagcaaaggagtgtccctgtttgacatcatcaaccctgagatcatcaccagagatggcttcctgctgctgcagatggactttggcttccctgagcacctgctggtggacttcctgcagagcctgtcctag

SEQ ID NO: 147393 - DNA, 1374 bp, Artificial Sequence
  Description of Artificial Sequence: Synthetic coding sequence
atgaagaccaagttctgcacaggaggagaggccgagcccagccccctgggcctgctgctgagctgtggcagcggcagcgctgccccagcccctggggtgggccagcagagagatgctgccagtgacctggagagcaagcagctgggcggccagcagccccccctggccctgcccccacctccacccctgcccctgcccctgcccctgccccagcccccaccaccccagcccccagcagatgagcagcctgagcccaggaccaggagaagagcctacctgtggtgcaaggagttcctgcccggggcctggaggggcctgcgggaggatgagttccacatcagcgtcatccggggcggcctgagcaacatgctgttccagtgcagcctgcctgacaccacagccaccctgggagatgagcccaggaaggtgctgctgcggctgtatggagccatcctgcagatgaggagctgcaacaaggagggcagcgagcaggcccagaaggaaaatgagttccagggcgctgaggccatggtgctggagagcgtgatgtttgccatcctggccgagaggagcctgggccccaagctgtatggcatcttcccccagggccgcctggagcagttcatccccagccggcggctggacacagaggagctgagcctgcctgacatctctgctgagattgctgagaagatggccaccttccacggcatgaagatgcccttcaacaaggagcccaagtggctgtttggcaccatggagaagtacctgaaggaggtgctgcgcatcaagttcacagaggagagccgcatcaagaagctgcacaagctgctgagctacaacctgcccctggagctggagaacctgcggagcctgctggagagcacccccagccctgtggtgttctgccacaatgactgccaggagggcaacatcctgctgctggagggcagagaaaattctgagaagcagaagctgatgctgattgactttgagtacagcagctacaactaccggggctttgatattggcaaccacttctgtgagtggatgtatgactacagctatgagaagtaccccttcttccgggccaacatcaggaagtaccccaccaagaagcagcagctgcacttcatcagcagctacctgcctgccttccagaatgactttgagaacctgagcacagaggagaagagcatcatcaaggaggagatgctgctggaggtgaacagatttgccctggccagccacttcctgtggggcctgtggagcatcgtgcaggccaagatcagcagcattgaatttggctacatggactatgcccaggccaggtttgatgcctacttccaccagaagaggaagctgggcgtgtag

SEQ ID NO: 147394 - DNA, 1320 bp, Artificial Sequence
  Description of Artificial Sequence: Synthetic coding sequence
atgaagaccaagttctgcacaggaggagaggccgagcccagccccctgggcctgctgctgagctgtggcagcggcagcgctgccccagcccctggggtgggccagcagagagatgctgccagtgacctggagagcaagcagctgggcggccagcagccccccctggccctgcccccacctccacccctgcccctgcccctgcccctgccccagcccccaccaccccagcccccagcagatgagcagcctgagcccaggaccaggagaagagcctacctgtggtgcaaggagttcctgcccggggcctggaggggcctgcgggaggatgagttccacatcagcgtcatccggggcggcctgagcaacatgctgttccagtgcagcctgcctgacaccacagccaccctgggagatgagcccaggaaggtgctgctgcggctgtatggagccatcctgcagatgggcgctgaggccatggtgctggagagcgtgatgtttgccatcctggccgagaggagcctgggccccaagctgtatggcatcttcccccagggccgcctggagcagttcatccccagccggcggctggacacagaggagctgagcctgcctgacatctctgctgagattgctgagaagatggccaccttccacggcatgaagatgcccttcaacaaggagcccaagtggctgtttggcaccatggagaagtacctgaaggaggtgctgcgcatcaagttcacagaggagagccgcatcaagaagctgcacaagctgctgagctacaacctgcccctggagctggagaacctgcggagcctgctggagagcacccccagccctgtggtgttctgccacaatgactgccaggagggcaacatcctgctgctggagggcagagaaaattctgagaagcagaagctgatgctgattgactttgagtacagcagctacaactaccggggctttgatattggcaaccacttctgtgagtggatgtatgactacagctatgagaagtaccccttcttccgggccaacatcaggaagtaccccaccaagaagcagcagctgcacttcatcagcagctacctgcctgccttccagaatgactttgagaacctgagcacagaggagaagagcatcatcaaggaggagatgctgctggaggtgaacagatttgccctggccagccacttcctgtggggcctgtggagcatcgtgcaggccaagatcagcagcattgaatttggctacatggactatgcccaggccaggtttgatgcctacttccaccagaagaggaagctgggcgtgtag

SEQ ID NO: 147395 - DNA, 1188 bp, Artificial Sequence
  Description of Artificial Sequence: Synthetic coding sequence
atggctgctgaggccacagctgtggccggcagcggggctgtgggcggctgcctggccaaggatggcctgcagcagagcaaatgtcctgacaccacccccaagagaagaagagccagcagcctgagcagagatgctgagcggcgggcctaccagtggtgccgggagtacctgggcggggcctggaggagagtgcagcctgaggagctgcgggtgtaccctgtgtctgggggcctgagcaacctgctcttccgctgcagcctgcctgaccacctgcccagcgtgggggaggagccccgggaggtgctgctgcggctgtatggagccatcctgcagggcgtggacagcctggtgctggagagcgtgatgtttgccatcctggccgagaggagcctgggcccccagctgtatggagtcttccctgagggccgcctggagcagtacatccccagccggcccctgaagacccaggagctgcgggagcctgtgctgtctgctgccatcgccaccaagatggcccagttccacggcatggagatgcccttcaccaaggagccccactggctgtttggcaccatggagcgctacctgaagcagatccaggacctgcccccaacaggcctgcctgagatgaacctgctggagatgtacagcctgaaggatgagatgggcaacctgaggaagctgctggagagcacccccagccctgtggtgttctgccacaatgacatccaggagggcaacatcctgctgctgtctgagccagaaaatgctgacagcctgatgctggtggactttgagtacagcagctacaactaccggggctttgatattggcaaccacttctgtgagtgggtgtatgactacacccatgaggagtggcccttctacaaggcccggcccacagactaccccacccaggagcagcagctgcacttcatccgccactacctggccgaggccaagaagggggagaccctgagccaggaggagcagaggaagctggaggaggacctgctggtggaggtgagccgctatgccctggccagccacttcttctggggcctgtggagcatcctgcaggcctccatgagcaccatcgagtttggctacctggactatgcccagagccgcttccagttctacttccagcagaagggccagctgacctctgtgcacagcagcagctag

SEQ ID NO: 147396 - DNA, 2247 bp, Artificial Sequence
  Description of Artificial Sequence: Synthetic coding sequence
atgggcctgaggacagccaagaagaggggcctgggcggcggcggcaagtggaagcgggaggagggcggcggcacccggggccggcgggaggtgcggcctgcctgcttcctgcagagcggcggccgcggggaccctggagatgtgggcggccctgctggcaaccctggctgcagcccccaccccagggctgccacccggcccccacccctgcctgcccacaccccagcccacaccccagagtggtgtggggccgccagcgctgaggccgctgagcccaggagagctggcccccacctgtgcatcccagcccctggcctgaccaagacccccatcctggagaaggtgcccaggaagatggccgccaagacccccagcagcgaggagagcggcctgcccaagctgcctgtgccccccctgcagcagaccctggccacctacctgcagtgcatgaggcacctggtgtctgaggagcagttcaggaagagccaggccatcgtgcagcagtttggagcccctgggggcctgggggagaccctgcagcagaagctgctggagcggcaggagaagacagccaactgggtgtctgagtactggctgaatgacatgtacctgaacaaccggctggccctgcctgtgaacagcagccctgctgtgatctttgcccggcagcacttccctggaacagatgaccagctgcgctttgctgccagcctcatcagcggcgtgctgagctacaaggccctgctggacagccacagcatccccacagactgtgccaagggccagctgagcggccagcccctgtgcatgaagcagtactacggcctcttcagcagctaccgcctgcccggccacacccaggacaccctggtggcccagaacagcagcatcatgcctgagcctgagcacgtgattgtggcctgctgcaaccagttctttgtgctggatgtggtgatcaacttccggcggctgtctgagggggacctcttcacccagctgaggaagatcgtgaagatggccagcaatgaagatgagcggctgccccccatcggcctgctgaccagtgatggccgctctgagtgggccgaggccaggacagtgctggtgaaggacagcaccaacagagacagcctggacatgattgagcgctgcatctgcctggtgtgcctggatgcccctggaggagtggagctgagtgacacccaccgggccctgcagctgctgcatggaggcggctacagcaagaatggagccaaccgctggtatgacaagagcctgcagtttgtggtgggcagagatggcacctgtggggtggtgtgtgagcacagcccctttgatggcatcgtgctggtgcagtgcacagagcacctgctgaagcacgtgacccagagcagcaggaagctgatccgggctgacagcgtgtctgagctgcctgccccccggcggctgcgctggaagtgcagccctgagatccagggccacctggccagcagcgctgagaagctgcagagaattgtgaagaacctggacttcatcgtgtacaagtttgacaactacggcaagaccttcatcaagaagcagaagtgcagcccagatgccttcatccaggtggccctgcagctggccttctaccgcctgcaccggcggctggtgcccacctatgagagcgccagcatccgccgcttccaggagggccgggtggacaacatccgcagcgccaccccagaggccctggcctttgtgcgggctgtgacagaccacaaggctgctgtgcctgccagcgagaagctgctgctgctgaaggatgccatccgggcccagacagcctacacagtgatggccatcaccggcatggccatcgacaaccacctgctggccctgcgggagctggcccgggccatgtgcaaggagctgcctgagatgttcatggatgagacctacctgatgagcaacagatttgtgctgagcaccagccaggtgcccaccaccacagagatgttctgctgctacggccctgtggtgcccaacggctacggggcctgctacaacccccagcctgagaccatcctcttctgcatcagcagcttccacagctgcaaggagaccagcagcagcaagtttgccaaggctgtggaggagagcctgattgacatgagggacctgtgcagcctgctgcccccaacagagagcaagcccctggccaccaaggagaaggccacccggcccagccagggccaccagccctag

SEQ ID NO: 147397 - DNA, 1893 bp, Artificial Sequence
  Description of Artificial Sequence: Synthetic coding sequence
atggccgccaagacccccagcagcgaggagagcggcctgcccaagctgcctgtgccccccctgcagcagaccctggccacctacctgcagtgcatgaggcacctggtgtctgaggagcagttcaggaagagccaggccatcgtgcagcagtttggagcccctgggggcctgggggagaccctgcagcagaagctgctggagcggcaggagaagacagccaactgggtgtctgagtactggctgaatgacatgtacctgaacaaccggctggccctgcctgtgaacagcagccctgctgtgatctttgcccggcagcacttccctggaacagatgaccagctgcgctttgctgccagcctcatcagcggcgtgctgagctacaaggccctgctggacagccacagcatccccacagactgtgccaagggccagctgagcggccagcccctgtgcatgaagcagtactacggcctcttcagcagctaccgcctgcccggccacacccaggacaccctggtggcccagaacagcagcatcatgcctgagcctgagcacgtgattgtggcctgctgcaaccagttctttgtgctggatgtggtgatcaacttccggcggctgtctgagggggacctcttcacccagctgaggaagatcgtgaagatggccagcaatgaagatgagcggctgccccccatcggcctgctgaccagtgatggccgctctgagtgggccgaggccaggacagtgctggtgaaggacagcaccaacagagacagcctggacatgattgagcgctgcatctgcctggtgtgcctggatgcccctggaggagtggagctgagtgacacccaccgggccctgcagctgctgcatggaggcggctacagcaagaatggagccaaccgctggtatgacaagagcctgcagtttgtggtgggcagagatggcacctgtggggtggtgtgtgagcacagcccctttgatggcatcgtgctggtgcagtgcacagagcacctgctgaagcacgtgacccagagcagcaggaagctgatccgggctgacagcgtgtctgagctgcctgccccccggcggctgcgctggaagtgcagccctgagatccagggccacctggccagcagcgctgagaagctgcagagaattgtgaagaacctggacttcatcgtgtacaagtttgacaactacggcaagaccttcatcaagaagcagaagtgcagcccagatgccttcatccaggtggccctgcagctggccttctaccgcctgcaccggcggctggtgcccacctatgagagcgccagcatccgccgcttccaggagggccgggtggacaacatccgcagcgccaccccagaggccctggcctttgtgcgggctgtgacagaccacaaggctgctgtgcctgccagcgagaagctgctgctgctgaaggatgccatccgggcccagacagcctacacagtgatggccatcaccggcatggccatcgacaaccacctgctggccctgcgggagctggcccgggccatgtgcaaggagctgcctgagatgttcatggatgagacctacctgatgagcaacagatttgtgctgagcaccagccaggtgcccaccaccacagagatgttctgctgctacggccctgtggtgcccaacggctacggggcctgctacaacccccagcctgagaccatcctcttctgcatcagcagcttccacagctgcaaggagaccagcagcagcaagtttgccaaggctgtggaggagagcctgattgacatgagggacctgtgcagcctgctgcccccaacagagagcaagcccctggccaccaaggagaaggccacccggcccagccagggccaccagccctag

SEQ ID NO: 147398 - DNA, 1893 bp, Artificial Sequence; identical to SEQ ID NO: 147397
  Description of Artificial Sequence: Synthetic coding sequence

SEQ ID NO: 147399 - DNA, 1893 bp, Artificial Sequence; identical to SEQ ID NO: 147397
  Description of Artificial Sequence: Synthetic coding sequence

SEQ ID NO: 147400 - DNA, 2001 bp, Artificial Sequence
  Description of Artificial Sequence: Synthetic coding sequence
atgtggccagagtgcagagatgaggccctgagcacagtgggcccccacctgtgcatcccagcccctggcctgaccaagacccccatcctggagaaggtgcccaggaagatggccgccaagacccccagcagcgaggagagcggcctgcccaagctgcctgtgccccccctgcagcagaccctggccacctacctgcagtgcatgaggcacctggtgtctgaggagcagttcaggaagagccaggccatcgtgcagcagtttggagcccctgggggcctgggggagaccctgcagcagaagctgctggagcggcaggagaagacagccaactgggtgtctgagtactggctgaatgacatgtacctgaacaaccggctggccctgcctgtgaacagcagccctgctgtgatctttgcccggcagcacttccctggaacagatgaccagctgcgctttgctgccagcctcatcagcggcgtgctgagctacaaggccctgctggacagccacagcatccccacagactgtgccaagggccagctgagcggccagcccctgtgcatgaagcagtactacggcctcttcagcagctaccgcctgcccggccacacccaggacaccctggtggcccagaacagcagcatcatgcctgagcctgagcacgtgattgtggcctgctgcaaccagttctttgtgctggatgtggtgatcaacttccggcggctgtctgagggggacctcttcacccagctgaggaagatcgtgaagatggccagcaatgaagatgagcggctgccccccatcggcctgctgaccagtgatggccgctctgagtgggccgaggccaggacagtgctggtgaaggacagcaccaacagagacagcctggacatgattgagcgctgcatctgcctggtgtgcctggatgcccctggaggagtggagctgagtgacacccaccgggccctgcagctgctgcatggaggcggctacagcaagaatggagccaaccgctggtatgacaagagcctgcagtttgtggtgggcagagatggcacctgtggggtggtgtgtgagcacagcccctttgatggcatcgtgctggtgcagtgcacagagcacctgctgaagcacgtgacccagagcagcaggaagctgatccgggctgacagcgtgtctgagctgcctgccccccggcggctgcgctggaagtgcagccctgagatccagggccacctggccagcagcgctgagaagctgcagagaattgtgaagaacctggacttcatcgtgtacaagtttgacaactacggcaagaccttcatcaagaagcagaagtgcagcccagatgccttcatccaggtggccctgcagctggccttctaccgcctgcaccggcggctggtgcccacctatgagagcgccagcatccgccgcttccaggagggccgggtggacaacatccgcagcgccaccccagaggccctggcctttgtgcgggctgtgacagaccacaaggctgctgtgcctgccagcgagaagctgctgctgctgaaggatgccatccgggcccagacagcctacacagtgatggccatcaccggcatggccatcgacaaccacctgctggccctgcgggagctggcccgggccatgtgcaaggagctgcctgagatgttcatggatgagacctacctgatgagcaacagatttgtgctgagcaccagccaggtgcccaccaccacagagatgttctgctgctacggccctgtggtgcccaacggctacggggcctgctacaacccccagcctgagaccatcctcttctgcatcagcagcttccacagctgcaaggagaccagcagcagcaagtttgccaaggctgtggaggagagcctgattgacatgagggacctgtgcagcctgctgcccccaacagagagcaagcccctggccaccaaggagaaggccacccggcccagccagggccaccagccctag

SEQ ID NO: 147401 - DNA, 1638 bp, Artificial Sequence
  Description of Artificial Sequence: Synthetic coding sequence
atggccgccaagacccccagcagcgaggagagcggcctgcccaagctgcctgtgccccccctgcagcagaccctggccacctacctgcagtgcatgaggcacctggtgtctgaggagcagttcaggaagagccaggccatcgtgcagcagtttggagcccctgggggcctgggggagaccctgcagcagaagctgctggagcggcaggagaagacagccaactgggtgtctgagtactggctgaatgacatgtacctgaacaaccggctggccctgcctgtgaacagcagccctgctgtgatctttgcccggcagcacttccctggaacagatgaccagctgcgctttgctgccagcctcatcagcggcgtgctgagctacaaggccctgctggacagccacagcatccccacagactgtgccaagggccagctgagcggccagcccctgtgcatgaagcagtactacggcctcttcagcagctaccgcctgcccggccacacccaggacaccctggtggcccagaacagcagcatcatgcctgagcctgagcacgtgattgtggcctgctgcaaccagttctttgtgctggatgtggtgatcaacttccggcggctgtctgagggggacctcttcacccagctgaggaagatcgtgaagatggccagcaatgaagatgagcggctgccccccatcggcctgctgaccagtgatggccgctctgagtgggccgaggccaggacagtgctggtgaaggacagcaccaacagagacagcctggacatgattgagcgctgcatctgcctggtgtgcctggatgcccctggaggagtggagctgagtgacacccaccgggccctgcagctgctgcatggaggcggctacagcaagaatggagccaaccgctggtatgacaagagcctgcagtttgtggtgggcagagatggcacctgtggggtggtgtgtgagcacagcccctttgatggcatcgtgctggtgcagtgcacagagcacctgctgaagcacgtgacccagagcagcaggaagctgatccgggctgacagcgtgtctgagctgcctgccccccggcggctgcgctggaagtgcagccctgagatccagggccacctggccagcagcgctgagaagctgcagagaattgtgaagaacctggacttcatcgtgtacaagtttgacaactacggcaagaccttcatcaagaagcagaagtgcagcccagatgccttcatccaggtggccctgcagctggccttctaccgcctgcaccggcggctggtgcccacctatgagagcgccagcatccgccgcttccaggagggccgggtggacaacatccgcagcgccaccccagaggccctggcctttgtgcgggctgtgacagaccacaaggctgctgtgcctgccagcgagaagctgctgctgctgaaggatgccatccgggcccagacagcctacacagtgatggccatcaccggcatggccatcgacaaccacctgctggccctgcgggagctggcccgggccatgtgcaaggagctgcctgagatgttcatggatgagacctacctgatgagcaacagatttgtgctgagcaccagccagctgtgctggccctag

SEQ ID NO: 147402 - DNA, 1383 bp, Artificial Sequence
  Description of Artificial Sequence: Synthetic coding sequence
atgaacaccagcgcccccccagctgtgagccccaacatcaccgtgctggcccctgggaagggcccctggcaggtggccttcatcggcatcaccaccggcctgctgagcctggccaccgtgactggaaacctgctggtgctgatctccttcaaggtgaacacagagctgaagacagtgaacaactacttcctgctgagcctggcctgtgccgacctgatcatcggcaccttctccatgaacctgtacaccacctacctgctgatgggccactgggccctgggcaccctggcctgtgacctgtggctggccctggactatgtggccagcaatgcctctgtgatgaacctgctgctgatcagctttgaccgctacttctctgtgacccggcccctgagctaccgggccaagaggaccccccggcgggccgccctgatgattggcctggcctggctggtgtcctttgtgctgtgggccccagccatcctcttctggcagtacctggtgggggagaggacagtgctggccggccagtgctacatccagttcctgagccagcccatcatcaccttcggcacagccatggccgccttctacctgcctgtgacagtgatgtgcaccctgtactggaggatctaccgggagacagagaacagagcccgggagctggccgccctgcagggcagcgagaccccaggaaaaggaggcggcagcagcagcagcagcgagaggagccagcccggggctgagggcagccctgagaccccacctggccgctgctgccgctgctgccgggccccccggctgctgcaggcctacagctggaaggaggaggaggaggaggatgagggctccatggagagcctgaccagcagcgagggggaggagcccggcagcgaggtggtgatcaagatgcccatggtggaccctgaggcccaggcccccaccaagcagccccccaggagcagccccaacacagtgaagaggcccaccaagaagggccgggacagagctgggaagggccagaagccccggggcaaggagcagctggccaagaggaagaccttcagcctggtgaaggagaagaaggccgcccggaccctgagcgccatcctgctggccttcatcctgacctggaccccctacaacatcatggtgctggtgtccaccttctgcaaggactgtgtgcctgagaccctgtgggagctgggctactggctgtgctacgtgaacagcaccatcaaccccatgtgctacgccctgtgcaacaaggccttccgggacaccttccggctgctgctgctgtgccgctgggacaagaggcgctggaggaagatccccaagaggcctggctctgtgcacaggacccccagccggcagtgctag

SEQ ID NO: 147403 - DNA, 405 bp, Artificial Sequence
  Description of Artificial Sequence: Synthetic coding sequence
atgaacaccagcgcccccccagctgtgagccccaacatcaccgtgctggcccctgggaagggcccctggcaggtggccttcatcggcatcaccaccggcctgctgagcctggccaccgtgactggaaacctgctggtgctgatctccttcaaggtgaacacagagctgaagacagtgaacaactacttcctgctgagcctggcctgtgccgacctgatcatcggcaccttctccatgaacctgtacaccacctacctgctgatgggccactgggccctgggcaccctggcctgtgacctgtggctggccctggactatgtggccagcaatgcctctgtgatgaacctgctgctgatcagctttgaccgctacttctctgtgacccggcccctgagctacagatag

SEQ ID NO: 147404 - DNA, 1365 bp, Artificial Sequence
  Description of Artificial Sequence: Synthetic coding sequence
atgaacaccagcgcccccccagctgtgagccccaacatcaccgtgctggcccctgggaagggcccctggcaggtggccttcatcggcatcaccaccggcctgctgagcctggccaccgtgactggaaacctgctggtgctgatctccttcaaggtgaacacagagctgaagacagtgaacaactacttcctgctgagcctggcctgtgccgacctgatcatcggcaccttctccatgaacctgtacaccacctacctgctgatgggccactgggccctgggcaccctggcctgtgacctgtggctggccctggactatgtggccagcaatgcctctgtgatgaacctgctgctgatcagctttgaccgctacttctctgtgacccggcccctgagctaccgggccaagaggaccccccggcgggccgccctgatgattggcctggcctggctggtgtcctttgtgctgtgggccccagccatcctcttctggcagtacctggtgggggagaggacagtgctggccggccagtgctacatccagttcctgagccagcccatcatcaccttcggcacagccatggccgccttctacctgcctgtgacagtgatgtgcaccctgtactggaggatctaccgggagacagagaacagagcccgggagctggccgccctgcagggcagcgagaccccaggaaaaggaggcggcagcagcagcagcagcgagaggagccagcccggggctgagggcagccctgagaccccacctggccgctgctgccgctgctgccgggccccccggctgctgcaggcctacagctggaaggaggaggaggaggaggatgagggctccatggagagcctgaccagcagcgagggggaggagcccggcagcgaggtggtgatcaagatgcccatggtggaccctgaggcccaggcccccaccaagcagccccccaggagcagccccaacacagtgaagaggcccaccaagaagggccgggacagagctgggaagggccagaagccccggggcaaggagcagctggccaagaggaagaccttcagcctggtgaaggagaagaaggccgcccggaccctgagcgccatcctgctggccttcatcctgacctggaccccctacaacatcatggtgctggtgtccaccttctgcaaggactgtgtgcctgagaccctgtgggagctgggctactggctgtgctacgtgaacagcaccatcaaccccatgtgctacgccctgtgcaacaaggccttccgggacaccttccggctgctgctgctgtgccgctgggacaagaggcgctggaggaagatccccaagaggcctggctctgtgcacaggtag

SEQ ID NO: 147405 - DNA, 1401 bp, Artificial Sequence
  Description of Artificial Sequence: Synthetic coding sequence
atgaacaacagcaccaacagcagcaacaacagcctggccctgaccagcccctacaagacctttgaggtggtgttcatcgtgctggtggccggcagcctgagcctggtgaccatcatcggcaacatcctggtgatggtgtccatcaaggtgaacagacacctgcagacagtgaacaactacttcctgttcagcctggcctgtgccgacctgatcatcggggtcttctccatgaacctgtacaccctgtacaccgtcatcggctactggcccctgggccctgtggtgtgtgacctgtggctggccctggactatgtggtgtccaatgcctctgtgatgaacctgctgatcatcagctttgaccgctacttctgtgtgaccaagcccctgacctaccctgtgaagaggaccaccaagatggccggcatgatgattgctgctgcctgggtgctgtccttcatcctgtgggccccagccatcctcttctggcagttcatcgtgggcgtgaggacagtggaggatggagagtgctacatccagttcttcagcaatgctgctgtgaccttcggcacagccatcgccgccttctacctgcccgtcatcatcatgacagtgctgtactggcacatcagccgggccagcaagagccgcatcaagaaggacaagaaggagcctgtggccaaccaggaccctgtgagccccagcctggtgcagggccgcatcgtgaagcccaacaacaacaacatgcccagcagtgatgatggcctggagcacaacaagatccagaatggcaaggccccccgggaccctgtgacagagaactgtgtgcagggcgaggagaaggagagcagcaatgacagcacctctgtgtctgctgtggccagcaacatgagagatgatgagatcacccaggatgaaaatacagtgtccaccagcctgggccacagcaaggatgagaacagcaagcagacctgcatcagaattggcaccaagacccccaagagtgacagctgcacccccaccaacaccaccgtggaggtggtgggcagcagcggccagaatggagatgagaagcagaacatcgtggccaggaagatcgtgaagatgaccaagcagcctgccaagaagaagcccccacccagccgggagaagaaggtgaccaggaccatcctggccatcctgctggccttcatcatcacctgggccccctacaacgtgatggtgctgatcaacaccttctgtgccccctgcatccccaacacagtgtggaccatcggctactggctgtgctacatcaacagcaccatcaacccagcctgctacgccctgtgcaatgccaccttcaagaagaccttcaagcacctgctgatgtgccactacaagaacatcggggccaccaggtag

SEQ ID NO: 147406 - DNA, 1401 bp, Artificial Sequence; identical to SEQ ID NO: 147405
  Description of Artificial Sequence: Synthetic coding sequence

SEQ ID NO: 147407 - DNA, 1401 bp, Artificial Sequence; identical to SEQ ID NO: 147405
  Description of Artificial Sequence: Synthetic coding sequence

SEQ ID NO: 147408 - DNA, 1401 bp, Artificial Sequence; identical to SEQ ID NO: 147405
  Description of Artificial Sequence: Synthetic coding sequence

SEQ ID NO: 147409 - DNA, 1401 bp, Artificial Sequence; identical to SEQ ID NO: 147405
  Description of Artificial Sequence: Synthetic coding sequence

SEQ ID NO: 147410 - DNA, 1401 bp, Artificial Sequence; identical to SEQ ID NO: 147405
  Description of Artificial Sequence: Synthetic coding sequence

SEQ ID NO: 147411 - DNA, 1773 bp, Artificial Sequence
  Description of Artificial Sequence: Synthetic coding sequence
atgaccctgcacaacaacagcaccaccagccccctcttccccaacatcagcagctcctggatccacagccccagtgatgctggcctgcccccaggcaccgtgacccacttcggcagctacaacgtgtccagagctgctggcaacttcagcagcccagatggcaccacagatgaccccctgggcggccacacagtgtggcaggtggtgttcatcgccttcctgaccggcatcctggccctggtgaccatcatcggcaacatcctggtgattgtgtccttcaaggtgaacaagcagctgaagacagtgaacaactacttcctgctgagcctggcctgtgccgacctgatcattggagtcatctccatgaacctcttcaccacctacatcatcatgaaccgctgggccctgggcaacctggcctgtgacctgtggctggccattgattatgtggccagcaatgcctctgtgatgaacctgctggtgatcagctttgaccgctacttcagcatcacccggcccctgacctaccgggccaagaggaccaccaagagagctggggtgatgattggcctggcctgggtgatcagctttgtgctgtgggccccagccatcctcttctggcagtactttgtgggcaagaggacagtgcccccaggagagtgcttcatccagttcctgtctgagcccaccatcacctttggaacagccatcgccgccttctacatgcctgtgaccatcatgaccatcctgtactggaggatctacaaggagacagagaagaggaccaaggagctggccggcctgcaggccagcggcacagaagctgagacagagaactttgtgcaccccaccggcagcagccgcagctgcagcagctatgagctgcagcagcagagcatgaagaggagcaacagaagaaaatatggccgctgccacttctggttcaccaccaagtcctggaagcccagcagcgagcagatggaccaggaccacagcagcagtgacagctggaacaacaatgatgctgctgccagcctggagaacagcgccagcagtgatgaagaagatattggcagcgagacccgggccatctacagcatcgtgctgaagctgcccggccacagcaccatcctgaacagcaccaagctgcccagcagtgacaacctgcaggtgcctgaggaggagctgggcatggtggacctggagaggaaggctgacaagctgcaggcccagaagtctgtggatgatggcggcagcttccccaagagcttcagcaagctgcccatccagctggagagcgctgtggacacagccaagaccagtgatgtgaacagctctgtgggcaagagcacagccaccctgcccctgtccttcaaggaggccaccctggccaagagatttgccctgaagaccaggagccagatcaccaagaggaagaggatgagcctggtgaaggagaagaaggccgcccagaccctgagcgccatcctgctggccttcatcatcacctggaccccctacaacatcatggtgctggtgaacaccttctgtgacagctgcatccccaagaccttctggaacctgggctactggctgtgctacatcaacagcacagtgaaccctgtgtgctacgccctgtgcaacaagaccttccgcaccaccttcaagatgctgctgctgtgccagtgtgacaagaagaagaggaggaagcagcagtaccagcagaggcagagcgtcatcttccacaagagggcccctgagcaggccctgtag

SEQ ID NO: 147412 - DNA, 333 bp, Artificial Sequence
  Description of Artificial Sequence: Synthetic coding sequence
atgaccctgcacaacaacagcaccaccagccccctcttccccaacatcagcagctcctggatccacagccccagtgatgctggcctgcccccaggcaccgtgacccacttcggcagctacaacgtgtccagagctgctggcaacttcagcagcccagatggcaccacagatgaccccctgggcggccacacagtgtggcaggtggtgttcatcgccttcctgaccggcatcctggccctggtgaccatcatcggcaacatcctggtgattgtgtccttcaaggtgaacaagcagctgaagacagtgaacaactacttcctgctgagcctgtag

SEQ ID NO: 147413 - DNA, 1440 bp, Artificial Sequence
  Description of Artificial Sequence: Synthetic coding sequence
atggccaacttcacccctgtgaatggcagcagcggcaaccagagcgtgcggctggtgaccagcagcagccacaacagatatgaaacagtggagatggtgttcatcgccaccgtgacaggcagcctgagcctggtgacagtggtgggcaacatcctggtgatgctgagcatcaaggtgaaccggcagctgcagacagtgaacaactacttcctgttcagcctggcctgtgccgacctgatcattggagccttctccatgaacctgtacacagtgtacatcatcaagggctactggcccctgggcgctgtggtgtgtgacctgtggctggccctggactatgtggtgtccaatgcctctgtgatgaacctgctgatcatcagctttgaccgctacttctgtgtgaccaagcccctgacctacccagcccggaggaccaccaagatggccggcctgatgattgctgctgcctgggtgctgagctttgtgctgtgggccccagccatcctcttctggcagtttgtggtgggcaagaggacagtgcctgacaaccagtgcttcatccagttcctgagcaacccagctgtgacctttggaacagccatcgccgccttctacctgcctgtggtgatcatgacagtgctgtacatccacatcagcctggccagccgcagccgggtgcacaagcacaggcctgagggccccaaggagaagaaggccaagaccctggccttcctgaagagccccctgatgaagcagagcgtgaagaagcccccacctggagaggccgcccgggaggagctgagaaatggcaagctggaggaggcccctcctccagccctgcccccaccacccaggcctgtggccgacaaggacaccagcaatgaaagcagcagcggcagcgccacccagaacaccaaggagaggcctgccacagagctgagcaccacagaggccaccaccccagccatgcctgccccacccctgcagccccgggccctgaacccagccagccgctggagcaagatccagatcgtgaccaagcagacaggaaatgaatgtgtgacagccattgaaattgtgcctgccaccccagctggcatgaggcctgctgccaacgtggccaggaagtttgccagcatcgccaggaaccaggtgaggaagaagaggcagatggccgcccgggagaggaaggtgaccaggaccatctttgccatcctgctggccttcatcctgacctggaccccctacaacgtgatggtgctggtgaacaccttctgccagagctgcatcccagacacagtgtggagcatcggctactggctgtgctacgtgaacagcaccatcaacccagcctgctacgccctgtgcaatgccaccttcaagaagaccttccgccacctgctgctgtgccagtacagaaatattggaacagccaggtag

SEQ ID NO: 147414 - DNA, 1599 bp, Artificial Sequence
  Description of Artificial Sequence: Synthetic coding sequence
atggagggggacagctaccacaatgccaccaccgtgaatggcacccctgtgaaccaccagcccctggagcggcaccggctgtgggaggtgatcaccatcgctgctgtgacagctgtggtgtccctcatcaccatcgtgggcaatgtgctggtgatgatctccttcaaggtgaacagccagctgaagacagtgaacaactactacctgctgagcctggcctgtgccgacctgatcatcggcatcttctccatgaacctgtacaccacctacatcctgatgggccgctgggccctgggcagcctggcctgtgacctgtggctggccctggactatgtggccagcaatgcctctgtgatgaacctgctggtgatcagctttgaccgctacttcagcatcacccggcccctgacctaccgggccaagaggacccccaagagagctggcatcatgattggcctggcctggctgatctccttcatcctgtgggccccagccatcctgtgctggcagtacctggtgggcaagaggacagtgcccctggatgagtgccagatccagttcctgtctgagcccaccatcacctttggaacagccatcgccgccttctacatccctgtgtctgtgatgaccatcctgtactgccgcatctaccgggagacagagaagaggaccaaggacctggccgacctgcagggcagtgacagcgtgaccaaggccgagaagaggaagccagcccaccgggccctcttccgcagctgcctgcgctgcccccggcccaccctggcccagcgggagaggaaccaggcctcctggagcagcagcagaagaagcaccagcaccaccgggaagcccagccaggccaccggccccagcgccaactgggccaaggccgagcagctgaccacctgcagcagctaccccagcagtgaagatgaggacaagccagccacagatcctgtgctgcaggtggtgtacaagagccagggcaaggagagccctggagaggagttctctgctgaggagacagaggagacctttgtgaaggccgagacagagaagagtgactatgacacccccaactacctgctgagccctgctgctgcccaccggcccaagagccagaagtgtgtggcctacaagttccggctggtggtgaaggcagatggcaaccaggagaccaacaacggctgccacaaggtgaagatcatgccctgccccttccctgtggccaaggagcccagcaccaagggcctgaaccccaaccccagccaccagatgaccaagaggaagagggtggtgctggtgaaggagaggaaggccgcccagaccctgagcgccatcctgctggccttcatcatcacctggaccccctacaacatcatggtgctggtgtccaccttctgtgacaagtgtgtgcctgtgaccctgtggcacctgggctactggctgtgctacgtgaacagcacagtgaaccccatctgctacgccctgtgcaacagaaccttcaggaagaccttcaagatgctgctgctgtgccgctggaagaagaagaaggtggaggagaagctgtactggcagggcaacagcaagctgccctag

SEQ ID NO: 147415 - DNA, 1599 bp, Artificial Sequence; identical to SEQ ID NO: 147414
  Description of Artificial Sequence: Synthetic coding sequence

SEQ ID NO: 147416 - DNA, 69 bp, Artificial Sequence
  Description of Artificial Sequence: Synthetic coding sequence
atggagggggacagctaccacaatgccaccaccgtgaatggcacccctgtgaaccaccagcccctgtag

SEQ ID NO: 147417 - DNA, 1449 bp, Artificial Sequence
  Description of Artificial Sequence: Synthetic coding sequence
atggagccctggcccctgctgctgctcttcagcctgtgcagcgctggcctggtgctgggcagcgagcacgagacccggctggtggccaagctgttcaaggactacagctctgtggtgcggcctgtggaggaccaccggcaggtggtggaggtgacagtgggcctgcagctgatccagctgatcaacgtggatgaggtgaaccagatcgtgaccaccaacgtgcggctgaagcagggcgacatggtggacctgccccggcccagctgtgtgaccctgggcgtgcccctcttcagccacctgcagaatgagcagtgggtggactacaacctgaagtggaacccagatgattatggaggagtgaagaagatccacatccccagcgagaagatctggaggccagacctggtgctgtacaacaatgctgatggagactttgccatcgtgaagttcaccaaggtgctgctgcagtacacaggccacatcacctggaccccaccagccatcttcaagagctactgtgagatcatcgtgacccacttcccctttgatgagcagaactgcagcatgaagctgggcacctggacctatgatggctctgtggtggccatcaaccctgagagtgaccagcctgacctgagcaacttcatggagagcggggagtgggtgatcaaggagagccggggctggaagcacagcgtgacctacagctgctgcccagacaccccctacctggacatcacctaccactttgtgatgcagaggctgcccctgtacttcatcgtgaatgtcatcatcccctgcctgctcttctccttcctgaccggcctggtgttctacctgcccacagacagcggggagaagatgaccctgagcatctctgtgctgctgagcctgactgtgttcctgctggtgattgtggagctgatccccagcaccagcagcgctgtgcccctgattggcaagtacatgctgttcaccatggtgtttgtgattgccagcatcatcatcaccgtgattgtcatcaacacccaccacaggagccccagcacccacgtgatgcccaactgggtgaggaaggtgttcatcgacaccatccccaacatcatgttcttcagcaccatgaagaggcccagccgggagaagcaggacaagaagatcttcacagaagatattgacatcagtgacatcagcggcaagccaggccccccacccatgggcttccacagccccctcatcaagcaccctgaggtgaagagcgccatcgagggcatcaagtacatcgccgagaccatgaagagtgaccaggagagcaacaatgctgctgctgagtggaagtatgtggccatggtgatggaccacatcctgctgggcgtcttcatgctggtgtgcatcatcggcaccctggccgtgtttgctggccgcctcatcgagctgaaccagcagggctag

SEQ ID NO: 147418 - DNA, 1374 bp, Artificial Sequence
  Description of Artificial Sequence: Synthetic coding sequence
atggagccctggcccctgctgctgctcttcagcctgtgcagcgctggcctggtgctgggcagcgagcacgagacccggctggtggccaagctgttcaaggactacagctctgtggtgcggcctgtggaggaccaccggcaggtggtggaggtgacagtgggcctgcagctgatccagctgatcaacgtggatgaggtgaaccagatcgtgaccaccaacgtgcggctgaagcagcagtgggtggactacaacctgaagtggaacccagatgattatggaggagtgaagaagatccacatccccagcgagaagatctggaggccagacctggtgctgtacaacaatgctgatggagactttgccatcgtgaagttcaccaaggtgctgctgcagtacacaggccacatcacctggaccccaccagccatcttcaagagctactgtgagatcatcgtgacccacttcccctttgatgagcagaactgcagcatgaagctgggcacctggacctatgatggctctgtggtggccatcaaccctgagagtgaccagcctgacctgagcaacttcatggagagcggggagtgggtgatcaaggagagccggggctggaagcacagcgtgacctacagctgctgcccagacaccccctacctggacatcacctaccactttgtgatgcagaggctgcccctgtacttcatcgtgaatgtcatcatcccctgcctgctcttctccttcctgaccggcctggtgttctacctgcccacagattctggagagaagatgaccctgagcatctctgtgctgctgagcctgaccgtcttcctgctggtgattgtggagctgatccccagcaccagcagcgctgtgcccctcatcggcaagtacatgctgttcaccatggtgtttgtgattgccagcatcatcatcaccgtcatcgtcatcaacacccaccacaggagccccagcacccacgtgatgcccaactgggtgaggaaggtgttcatcgacaccatccccaacatcatgttcttcagcaccatgaagaggcccagccgggagaagcaggacaagaagatcttcacagaggacatcgacatcagtgacatcagcggcaagccaggccccccacccatgggcttccacagccccctcatcaagcaccctgaggtgaagagcgccatcgagggcatcaagtacatcgccgagaccatgaagagtgaccaggagagcaacaatgctgctgctgagtggaagtatgtggccatggtgatggaccacatcctgctgggcgtcttcatgctggtgtgcatcatcggcaccctggccgtgtttgctggccgcctgattgagctgaaccagcagggctag

SEQ ID NO: 147419 - DNA, 1353 bp, Artificial Sequence
  Description of Artificial Sequence: Synthetic coding sequence
atgggcctgcggagccaccacctgagcctgggcctgctgctgctcttcctgctgcctgcagaatgtctgggcgctgagggccgcctggccctgaagctgttccgggacctgtttgccaactacaccagcgccctgcggcctgtggccgacacagaccagaccctgaatgtgaccctggaggtgaccctgagccagatcatcgacatggatgagaggaaccaggtgctgaccctgtacctgtggatccggcaggagtggacagatgcctacctgcgctgggaccccaatgcctacggcggcctggatgccatccgcatccccagcagcctggtgtggaggccagacatcgtgctgtacaacaaggcagatgcccagcccccaggcagcgccagcaccaacgtggtgctgcggcatgatggagctgtgcgctgggatgccccagccatcaccaggagcagctgccgggtggatgtggccgccttcccctttgatgcccagcactgcggcctgaccttcggctcctggacccatggaggccaccagctggatgtgcggcccagaggagctgctgccagcctggccgactttgtggagaatgtggagtggagggtgctgggcatgcctgccaggagaagagtgctgacctacggctgctgcagcgagccctacccagatgtgaccttcaccctgctgctgcggcggcgggctgctgcctacgtgtgcaacctgctgctgccctgtgtgctgatcagcctgctggcccccctggccttccacctgcctgctgacagcggggagaaggtgtccctgggcgtgacagtgctgctggccctgactgtgttccagctgctgctggccgagagcatgcccccagctgagagcgtgcccctcatcggcaagtactacatggccaccatgaccatggtgaccttcagcacagccctgaccatcctgatcatgaacctgcactactgcggccccagcgtgcggcctgtgcctgcctgggcccgggccctgctgctgggccacctggcccggggcctgtgtgtgcgggagcggggggagccctgtggccagagccggcccccagagctgagccccagcccccagagccctgagggcggggccggccccccagctggcccctgccacgagccccgctgcctgtgccggcaggaggccctgctgcaccacgtggccaccatcgccaacaccttccgcagccacagagctgcccagcgctgccacgaggactggaagaggctggcccgggtgatggaccgcttcttcctggccatcttcttctccatggccctggtgatgagcctgctggtgctggtgcaggccctgtag

SEQ ID NO: 147420 - DNA, 1590 bp, Artificial Sequence
  Description of Artificial Sequence: Synthetic coding sequence
atgggccccagctgccctgtgttcctgtccttcaccaagctgagcctgtggtggctgctgctgaccccagctggaggagaggaggccaagaggcccccaccccgggcccctggggaccccctgagcagccccagccccacagccctgccccagggcggcagccacacagaaacagaagatagactcttcaagcacctgttccggggctacaaccgctgggcccggcctgtgcccaacaccagtgatgtggtgattgtgcgcttcggcctgagcatcgcccagctgattgatgtggatgagaagaaccagatgatgaccaccaacgtgtggctgaagcaggagtggagcgactacaagctgcgctggaaccccacagactttggaaacatcaccagcctgcgggtgcccagcgagatgatctggatcccagacatcgtgctgtacaacaatgctgatggagaatttgctgtgacccacatgaccaaggcccacctgttcagcacaggcaccgtgcactgggtgcccccagccatctacaagagcagctgcagcattgatgtgaccttcttcccctttgaccagcagaactgcaagatgaagtttggctcctggacctatgacaaggccaagattgacctggagcagatggagcagacagtggacctgaaggactactgggagagcggggagtgggccatcgtgaatgccaccggcacctacaacagcaagaagtatgactgctgtgccgagatctacccagatgtgacctacgcctttgtgatccggcggctgcccctcttctacaccatcaacctgatcatcccctgcctgctgatcagctgcctgactgtgctggtgttctacctgcccagcgactgtggggagaagatcaccctgtgcatctctgtgctgctgagcctgaccgtcttcctgctgctgatcacagagatcatccccagcaccagcctggtgatccccctcatcggggagtacctgctcttcaccatgatctttgtgaccctgagcatcgtcatcaccgtgtttgtgctgaatgtgcaccacaggagccccagcacccacaccatgccccactgggtgcggggggccctgctgggctgtgtgccccgctggctgctgatgaacagacctcctcctcctgtggagctgtgccaccccctgcggctgaagctgagccccagctaccactggctggagagcaatgtggatgctgaggagcgggaggtggtggtggaggaggaggaccgctgggcctgtgccggccacgtggcccccagcgtgggcaccctgtgcagccacggccacctgcacagcggggccagcggccccaaggccgaggccctgctgcaggagggggagctgctgctgagcccccacatgcagaaggccctggagggcgtgcactacatcgctgaccacctgcggagtgaagatgctgacagctctgtgaaggaggactggaagtatgtggccatggtgattgaccgcatcttcctgtggctgttcatcatcgtgtgcttcctgggcaccatcggcctcttcctgccccccttcctggccggcatgatctag

SEQ ID NO: 147421 - DNA, 1590 bp, Artificial Sequence; identical to SEQ ID NO: 147420
  Description of Artificial Sequence: Synthetic coding sequence

SEQ ID NO: 147422 - DNA, 1518 bp, Artificial Sequence
  Description of Artificial Sequence: Synthetic coding sequence
atgggcagcggccccctgagcctgcccctggccctgagccccccccggctgctgctgctgctgctgctgagcctgctgcctgtggcccgggccagcgaggccgagcaccggctgtttgagcggctgtttgaggactacaatgagatcatccggcctgtggccaacgtgtctgaccctgtgatcatccactttgaggtgtccatgagccagctggtgaaggtggatgaggtgaaccagatcatggagaccaacctgtggctgaagcagatctggaatgactacaagctgaagtggaaccccagcgactatggaggagctgagttcatgagggtgcctgcccagaagatctggaagccagacatcgtgctgtacaacaatgctgtgggggacttccaggtggatgacaagaccaaggccctgctgaagtacaccggggaggtgacctggatccccccagccatcttcaagagcagctgcaagattgatgtgacctacttcccctttgactaccagaactgcaccatgaagtttggctcctggagctatgacaaggccaagattgacctggtgctgattggcagctccatgaacctgaaggactactgggagagcggggagtgggccatcatcaaggcccctggctacaagcatgacatcaagtacaactgctgtgaggagatctacccagacatcacctacagcctgtacatccggcggctgcccctcttctacaccatcaacctgatcatcccctgcctgctgatctccttcctgactgtgctggtgttctacctgcccagcgactgtggggagaaggtgaccctgtgcatctctgtgctgctgagcctgaccgtcttcctgctggtgatcacagagaccatccccagcaccagcctggtgatccccctcatcggggagtacctgctcttcaccatgatctttgtgaccctgagcatcgtcatcaccgtgtttgtgctgaatgtgcactaccgcacccccaccacccacaccatgcccagctgggtgaagacagtgttcctgaacctgctgccccgggtgatgttcatgacccggcccaccagcaatgaaggaaatgcccagaagccccggcccctgtatggagctgagctgagcaacctgaactgcttcagcagagctgagagcaagggctgcaaggagggctacccctgccaggacggcatgtgtggctactgccaccaccggcgcatcaagatcagcaacttcagcgccaacctgaccaggagcagcagcagcgagagcgtggatgctgtgctgagcctgagcgccctgagccctgagatcaaggaggccatccagagcgtgaagtacatcgccgagaacatgaaggcccagaatgaggccaaggagatccaggatgactggaagtatgtggccatggtgattgaccgcatcttcctgtgggtgttcaccctggtgtgcatcctgggcacagctggcctcttcctgcagcccctgatggccagagaagatgcctag

SEQ ID NO: 147423 - DNA, 939 bp, Artificial Sequence
  Description of Artificial Sequence: Synthetic coding sequence
accaaggccctgctgaagtacaccggggaggtgacctggatccccccagccatcttcaagagcagctgcaagattgatgtgacctacttcccctttgactaccagaactgcaccatgaagtttggctcctggagctatgacaaggccaagattgacctggtgctgattggcagctccatgaacctgaaggactactgggagagcggggagtgggccatcatcaaggcccctggctacaagcatgacatcaagtacaactgctgtgaggagatctacccagacatcacctacagcctgtacatccggcggctgcccctcttctacaccatcaacctgatcatcccctgcctgctgatctccttcctgactgtgctggtgttctacctgcccagcgactgtggggagaaggtgaccctgtgcatctctgtgctgctgagcctgaccgtcttcctgctggtgatcacagagaccatccccagcaccagcctggtgatccccctcatcggggagtacctgctcttcaccatgatctttgtgaccctgagcatcgtcatcaccgtgtttgtgctgaatgtgcactaccgcacccccaccacccacaccatgcccagctgggtgaagacagtgttcctgaacctgctgccccgggtgatgttcatgacccggcccaccagcaatgaaggaaatgcccagaagccccggcccctgtatggagccagccccaaggccgcccggcgggagatcaaggaggccatccagagcgtgaagtacatcgccgagaacatgaaggcccagaatgaggccaaggagatccaggatgactggaagtatgtggccatggtgattgaccgcatcttcctgtgggtgttcaccctggtgtgcatcctgggcacagctggcctcttcctgcagcccctgatggcccgggaggatgcctag

SEQ ID NO: 147424 - DNA, 1470 bp, Artificial Sequence
  Description of Artificial Sequence: Synthetic coding sequence
atgggcagcggccccctgagcctgcccctggccctgagccccccccggctgctgctgctgctgctgctgagcctgctgcctgtggcccgggccagcgaggccgagcaccggctgtttgagcggctgtttgaggactacaatgagatcatccggcctgtggccaacgtgtctgaccctgtgatcatccactttgaggtgtccatgagccagctggtgaaggtggatgaggtgaaccagatcatggagaccaacctgtggctgaagcagatctggaatgactacaagctgaagtggaaccccagcgactatggaggagctgagttcatgagggtgcctgcccagaagatctggaagccagacatcgtgctgtacaacaatgctgtgggggacttccaggtggatgacaagaccaaggccctgctgaagtacaccggggaggtgacctggatccccccagccatcttcaagagcagctgcaagattgatgtgacctacttcccctttgactaccagaactgcaccatgaagtttggctcctggagctatgacaaggccaagattgacctggtgctgattggcagctccatgaacctgaaggactactgggagagcggggagtgggccatcatcaaggcccctggctacaagcatgacatcaagtacaactgctgtgaggagatctacccagacatcacctacagcctgtacatccggcggctgcccctcttctacaccatcaacctgatcatcccctgcctgctgatctccttcctgactgtgctggtgttctacctgcccagcgactgtggggagaaggtgaccctgtgcatctctgtgctgctgagcctgaccgtcttcctgctggtgatcacagagaccatccccagcaccagcctggtgatccccctcatcggggagtacctgctcttcaccatgatctttgtgaccctgagcatcgtcatcaccgtgtttgtgctgaatgtgcactaccgcacccccaccacccacaccatgcccagctgggtgaagacagtgttcctgaacctgctgccccgggtgatgttcatgacccggcccaccagcaatgaaggaaatgcccagaagccccggcccctgtatggagctgagctgagcaacctgaactgcttcagcagagctgagagcaagggctgcaaggagggctacccctgccaggacggcatgtgtggctactgccaccaccggcgcatcaagatcagcaacttcagcgccaacctgaccaggagcagcagcagcgagagcgtggatgctgtgctgagcctgagcgccctgagccctgagatcaaggaggccatccagagcgtgaagtacatcgccgagaacatgaaggcccagaatgaggccaaggaggagcagaaggcccaggagatccagcagctgaagaggaaggagaagagcacagagaccagtgaccaggagcccggcctgtag

SEQ ID NO: 147425 - DNA, 1518 bp, Artificial Sequence; identical to SEQ ID NO: 147422
  Description of Artificial Sequence: Synthetic coding sequence

SEQ ID NO: 147426 - DNA, 1602 bp, Artificial Sequence
  Description of Artificial Sequence: Synthetic coding sequence
gcccctgagcccggggaggccccccggctggaccgggcccaccctggctgtgcctgtgccgagctgagcctgctgtggctgtgctgctgcaccttcaccagcgcagatggagactttgctgtgacccacctgaccaaggcccacctgttccatgatggccgggtgcagtggaccccaccagccatctacaagagcagctgcagcattgatgtgaccttcttcccctttgaccagcagaactgcaccatgaagtttggctcctggacctatgacaaggccaagattgacctggtgaacatgcacagccgggtggaccagctggacttctgggagagcggggagtgggtgattgtggatgctgtgggcacctacaacaccaggaaatatgagtgctgtgccgagatctacccagacatcacctacgcctttgtgatccggcggctgcccctcttctacaccatcaacctgatcatcccctgcctgctgatcagctgcctgactgtgctggtgttctacctgcccagtgaatgtggggagaagatcaccctgtgcatctctgtgctgctgagcctgaccgtcttcctgctgctgatcacagagatcatccccagcaccagcctggtgatccccctcatcggggagtacctgctcttcaccatgatctttgtgaccctgagcatcgtcatcaccgtgtttgtgctgaatgtgcaccacaggagccccaggacccacaccatgcccacctgggtgagaagagtcttcctggacatcgtgccccggctgctgctgatgaagaggcccagcgtggtgaaggacaactgcagaagactcatcgagagcatgcacaagatggccagcgccccccgcttctggccagagcctgagggggagcccccagccaccagcggcacccagagcctgcacccccccagccccagcttctgtgtgcccctggatgtgcctgctgagcccggccccagctgcaagagccccagcgaccagctgcccccccagcagcccctggaggccgagaaggccagcccccaccccagccctggcccctgcaggcctcctcatggcacccaggcccctggcctggccaaggcccggagcctgtctgtgcagcacatgagcagccctggagaggccgtggagggcggcgtgcgctgccgcagccgcagcatccagtactgtgtgcccagagatgatgctgcccctgaggctgatggccaggccgccggggccctggccagcaggaacacccacagcgctgagctgcccccaccagaccagcccagcccctgcaagtgcacctgcaagaaggagcccagctctgtgagccccagcgccaccgtgaagaccaggagcaccaaggcccccccaccccacctgcccctgagccctgccctgaccagggctgtggagggcgtgcagtacatcgctgaccacctgaaggccgaggacacagacttctctgtgaaggaggactggaagtatgtggccatggtgattgaccgcatcttcctgtggatgttcatcatcgtgtgcctgctgggcaccgtgggcctcttcctgcccccctggctggccggcatgatctag

SEQ ID NO: 147427 - DNA, 1884 bp, Artificial Sequence
  Description of Artificial Sequence: Synthetic coding sequence
atggagctgggcggccctggggccccccggctgctgccccccctgctgctgctgctgggcaccggcctgctgcgggccagcagccacgtggagacccgggcccacgccgaggagcggctgctgaagaagctgttcagcggctacaacaagtggagcaggcctgtggccaacatcagtgatgtggtgctggtgcgcttcggcctgagcatcgcccagctgattgatgtggatgagaagaaccagatgatgaccaccaacgtgtgggtgaagcaggagtggcatgactacaagctgcgctgggaccctgctgactatgaaaatgtgaccagcatccgcatccccagcgagctgatctggaggccagacatcgtgctgtacaacaatgctgatggagactttgctgtgacccacctgaccaaggcccacctgttccatgatggccgggtgcagtggaccccaccagccatctacaagagcagctgcagcattgatgtgaccttcttcccctttgaccagcagaactgcaccatgaagtttggctcctggacctatgacaaggccaagattgacctggtgaacatgcacagccgggtggaccagctggacttctgggagagcggggagtgggtgattgtggatgctgtgggcacctacaacaccaggaaatatgagtgctgtgccgagatctacccagacatcacctacgcctttgtgatccggcggctgcccctcttctacaccatcaacctgatcatcccctgcctgctgatcagctgcctgactgtgctggtgttctacctgcccagtgaatgtggggagaagatcaccctgtgcatctctgtgctgctgagcctgaccgtcttcctgctgctgatcacagagatcatccccagcaccagcctggtgatccccctcatcggggagtacctgctcttcaccatgatctttgtgaccctgagcatcgtcatcaccgtgtttgtgctgaatgtgcaccacaggagccccaggacccacaccatgcccacctgggtgagaagagtcttcctggacatcgtgccccggctgctgctgatgaagaggcccagcgtggtgaaggacaactgcagaagactcatcgagagcatgcacaagatggccagcgccccccgcttctggccagagcctgagggggagcccccagccaccagcggcacccagagcctgcacccccccagccccagcttctgtgtgcccctggatgtgcctgctgagcccggccccagctgcaagagccccagcgaccagctgcccccccagcagcccctggaggccgagaaggccagcccccaccccagccctggcccctgcaggcctcctcatggcacccaggcccctggcctggccaaggcccggagcctgtctgtgcagcacatgagcagccctggagaggccgtggagggcggcgtgcgctgccgcagccgcagcatccagtactgtgtgcccagagatgatgctgcccctgaggctgatggccaggccgccggggccctggccagcaggaacacccacagcgctgagctgcccccaccagaccagcccagcccctgcaagtgcacctgcaagaaggagcccagctctgtgagccccagcgccaccgtgaagaccaggagcaccaaggcccccccaccccacctgcccctgagccctgccctgaccagggctgtggagggcgtgcagtacatcgctgaccacctgaaggccgaggacacagacttctctgtgaaggaggactggaagtatgtggccatggtgattgaccgcatcttcctgtggatgttcatcatcgtgtgcctgctgggcaccgtgggcctcttcctgcccccctggctggccggcatgatctag

SEQ ID NO: 147428 - DNA, 1671 bp, Artificial Sequence
  Description of Artificial Sequence: Synthetic coding sequence
atgaggatgagccccccatctgccagcccccccagcagcagcggcggccgcaccagcagcagcaccaccacagctggggagcccttctgggccggcgtgctgtttgccatccggccccaccctggcctgagcggcagaattgtgtggacagctggctgccctggagagggcgcagatggagactttgctgtgacccacctgaccaaggcccacctgttccatgatggccgggtgcagtggaccccaccagccatctacaagagcagctgcagcattgatgtgaccttcttcccctttgaccagcagaactgcaccatgaagtttggctcctggacctatgacaaggccaagattgacctggtgaacatgcacagccgggtggaccagctggacttctgggagagcggggagtgggtgattgtggatgctgtgggcacctacaacaccaggaaatatgagtgctgtgccgagatctacccagacatcacctacgccttcgtcatccggcggctgcccctcttctacaccatcaacctgatcatcccctgcctgctgatcagctgcctgactgtgctggtgttctacctgcccagtgaatgtggggagaagatcaccctgtgcatctctgtgctgctgagcctgactgtgttcctgctgctgatcacagagatcatccccagcaccagcctggtgatccccctgattggagagtacctgctcttcaccatgatctttgtgaccctgagcatcgtcatcaccgtgtttgtgctgaatgtgcaccacaggagccccaggacccacaccatgcccacctgggtgcggcgggtcttcctggacatcgtgccccggctgctgctgatgaagaggccttctgtggtgaaggacaactgccggcggctgattgaatccatgcacaagatggccagcgccccccgcttctggccagagcctgagggggagcccccagccaccagcggcacccagagcctgcacccccccagccccagcttctgtgtgcccctggatgtgcctgctgagcccggccccagctgcaagagccccagcgaccagctgcccccccagcagcccctggaggccgagaaggccagcccccaccccagccctggcccctgccggcccccccacggcacccaggcccctggcctggccaaggcccggagcctgtctgtgcagcacatgagcagccctggagaggccgtggagggcggcgtgcgctgccgcagccgcagcatccagtactgtgtgcccagagatgatgctgcccctgaggctgatggccaggccgccggggccctggccagcaggaacacccacagcgctgagctgcccccaccagaccagcccagcccctgcaagtgcacctgcaagaaggagcccagctctgtgagccccagcgccaccgtgaagaccaggagcaccaaggcccccccaccccacctgcccctgagccctgccctgaccagggctgtggagggcgtgcagtacatcgctgaccacctgaaggccgaggacacagacttctctgtgaaggaggactggaagtatgtggccatggtgattgaccgcatcttcctgtggatgttcatcatcgtgtgcctgctgggcaccgtgggcctcttcctgcccccctggctggccggcatgatctag

SEQ ID NO: 147429 - DNA, 1407 bp, Artificial Sequence
  Description of Artificial Sequence: Synthetic coding sequence
atggccgcccggggcagcggcccccgggccctgcggctgctgctgctggtgcagctggtggccggccgctgtggcctggccggggccgccggcggggcccagaggggcctgtctgagcccagcagcatcgccaagcatgaggacagcctgctgaaggacctcttccaggactatgagcgctgggtgcggcctgtggagcacctgaatgacaagatcaagatcaagtttggcctggccatcagccagctggtggatgtggatgagaagaaccagctgatgaccaccaacgtgtggctgaagcaggagtggattgatgtgaagctgcgctggaacccagatgattatggaggcatcaaggtgatccgggtgcccagcgacagcgtgtggaccccagacatcgtgctgtttgacaatgctgatggccgctttgagggcaccagcaccaagacagtcatccgctacaatggaacagtgacctggaccccaccagccaactacaagagcagctgcaccattgatgtgaccttcttcccctttgacctgcagaactgcagcatgaagtttggctcctggacctatgatggcagccaggtggacatcatcctggaggaccaggatgtggacaagagggacttctttgacaatggagagtgggagatcgtgtctgccaccggcagcaaaggaaacagaacagacagctgctgctggtacccctacgtgacctacagctttgtgatcaagaggctgcccctcttctacaccctcttcctgatcatcccctgcatcggcctgtccttcctgactgtgctggtgttctacctgcccagcaatgaaggagagaagatctgcctgtgcacctctgtgctggtgtccctgactgtgttcctgctggtgattgaggagatcatccccagcagcagcaaggtgatccccctgattggagagtacctggtgttcaccatgatctttgtgaccctgagcatcatggtgacagtgtttgccatcaacatccaccacaggagcagcagcacccacaatgccatggcccccctggtgaggaagatcttcctgcacaccctgcccaagctgctgtgcatgaggagccacgtggaccgctacttcacccagaaggaggagacagagagcggcagcggccccaagagcagcaggaacaccctggaggccgccctggacagcatccgctacatcaccaggcacatcatgaaggaaaatgatgtgcgggaggtggtggaggactggaagttcatcgcccaggtgctggacaggatgttcctgtggaccttcctgtttgtgtccatcgtgggcagcctgggcctgtttgtgcctgtgatctacaagtgggccaacatcctgatccctgtgcacatcggaaatgccaacaagtag

SEQ ID NO: 147430 - DNA, 1485 bp, Artificial Sequence
  Description of Artificial Sequence: Synthetic coding sequence
atgctgaccagcaagggccagggcttcctgcatggaggcctgtgcctgtggctgtgtgtgttcacccccttcttcaagggctgtgtgggctgtgccacagaggagcggctcttccacaagctgttcagccactacaaccagttcatccggcctgtggagaatgtgtctgaccctgtgacagtgcactttgaggtggccatcacccagctggccaacgtggatgaggtgaaccagatcatggagaccaacctgtggctgcggcacatctggaatgactacaagctgcgctgggaccccatggagtatgatggcatcgagaccctgcgggtgcctgctgacaagatctggaagccagacatcgtgctgtacaacaatgctgtgggggacttccaggtggagggcaagaccaaggccctgctgaagtacaacggcatgatcacctggaccccaccagccatcttcaagagcagctgccccatggacatcaccttcttcccctttgaccaccagaactgcagcctgaagtttggctcctggacctatgacaaggccgagattgacctgctgatcatcggcagcaaggtggacatgaatgacttctgggagaacagcgagtgggagatcattgatgccagcggctacaagcatgacatcaagtacaactgctgtgaggagatctacacagacatcacctacagcttctacatccggcggctgcccatgttctacaccatcaacctgatcatcccctgcctcttcatctccttcctgactgtgctggtgttctacctgcccagcgactgtggggagaaggtgaccctgtgcatctctgtgctgctgagcctgactgtgttcctgctggtgatcacagagaccatccccagcaccagcctggtggtgcccctggtgggggagtacctgctcttcaccatgatctttgtgaccctgagcatcgtggtgacagtgtttgtgctgaacatccactaccgcacccccaccacccacaccatgccccgctgggtgaagacagtgttcctgaagctgctgccccaggtgctgctgatgcgctggcccctggacaagacccggggcactggaagtgatgctgtgccccggggcctggcccggcggcctgccaagggcaagctggccagccacggggagcccaggcacctgaaggagtgcttccactgccacaagagcaatgagctggccaccagcaagaggcggctgagccaccagcccctgcagtgggtggtggagaacagcgagcacagccctgaggtggaggatgtgatcaacagcgtgcagttcatcgccgagaacatgaagagccacaatgagaccaaggaggtggaggatgactggaagtatgtggccatggtggtggacagagtcttcctgtgggtgttcatcatcgtgtgtgtgtttggaacagctggcctcttcctgcagcccctgctgggcaacacaggcaagagctag

SEQ ID NO: 147431 - DNA, 1440 bp, Artificial Sequence
  Description of Artificial Sequence: Synthetic coding sequence
atgctgaccagcaagggccagggcttcctgcatggaggcctgtgcctgtggctgtgtgtgttcacccccttcttcaagggctgtgtgggctgtgccacagaggagcggctcttccacaagctgttcagccactacaaccagttcatccggcctgtggagaatgtgtctgaccctgtgacagtgcactttgaggtggccatcacccagctggccaacgtcatctggaatgactacaagctgcgctgggaccccatggagtatgatggcatcgagaccctgcgggtgcctgctgacaagatctggaagccagacatcgtgctgtacaacaatgctgtgggggacttccaggtggagggcaagaccaaggccctgctgaagtacaacggcatgatcacctggaccccaccagccatcttcaagagcagctgccccatggacatcaccttcttcccctttgaccaccagaactgcagcctgaagtttggctcctggacctatgacaaggccgagattgacctgctgatcatcggcagcaaggtggacatgaatgacttctgggagaacagcgagtgggagatcattgatgccagcggctacaagcatgacatcaagtacaactgctgtgaggagatctacacagacatcacctacagcttctacatccggcggctgcccatgttctacaccatcaacctgatcatcccctgcctcttcatctccttcctgactgtgctggtgttctacctgcccagcgactgtggggagaaggtgaccctgtgcatctctgtgctgctgagcctgaccgtcttcctgctggtgatcacagagaccatccccagcaccagcctggtggtgcccctggtgggggagtacctgctcttcaccatgatctttgtgaccctgagcatcgtggtgacagtgtttgtgctgaacatccactaccgcacccccaccacccacaccatgccccgctgggtgaagacagtgttcctgaagctgctgccccaggtgctgctgatgcgctggcccctggacaagacccggggcaccggcagtgatgctgtgccccggggcctggcccggcggcctgccaagggcaagctggccagccatggagagcccaggcacctgaaggagtgcttccactgccacaagagcaatgagctggccaccagcaagaggcggctgagccaccagcccctgcagtgggtggtggagaacagcgagcacagccctgaggtggaggatgtgatcaacagcgtgcagttcatcgccgagaacatgaagagccacaatgagaccaaggaggtggaggatgactggaagtatgtggccatggtggtggacagagtcttcctgtgggtgttcatcatcgtgtgtgtgtttggaacagctggcctcttcctgcagcccctgctgggcaacacaggcaagagctag

SEQ ID NO: 147432 - DNA, 1509 bp, Artificial Sequence
  Description of Artificial Sequence: Synthetic coding sequence
atgcgctgcagccctggaggagtgtggctggccctggccgccagcctgctgcacgtgtccctgcagggcgagttccagaggaagctgtacaaggagctggtgaagaactacaaccccctggagaggcctgtggccaatgacagccagcccctgactgtgtacttcagcctgagcctgctgcagatcatggatgtggatgagaagaaccaggtgctgaccaccaacatctggctgcagatgtcctggacagaccactacctgcagtggaatgtgtctgagtacccaggagtgaagacagtgcgcttcccagatggccagatctggaagccagacatcctgctgtacaacagcgcagatgaaagatttgatgccaccttccacaccaacgtgctggtgaacagcagcggccactgccagtacctgcccccaggcatcttcaagagcagctgctacattgatgtgcgctggttcccctttgatgtgcagcactgcaagctgaagtttggctcctggagctatggaggctggagcctggacctgcagatgcaggaggccgacatcagcggctacatccccaatggagagtgggacctggtgggcatccctgggaagaggtctgagcgcttctatgagtgctgcaaggagccctacccagatgtgaccttcaccgtgaccatgagaagaaggaccctgtactacggcctgaacctgctgatcccctgtgtgctgatcagcgccctggccctgctggtgttcctgctgcctgctgacagcggggagaagatcagcctgggcatcaccgtgctgctgagcctgactgtgttcatgctgctggtggccgagatcatgcctgccaccagtgacagcgtgcccctgattgcccagtactttgccagcaccatgatcatcgtgggcctgtctgtggtggtgacagtgattgtgctgcagtaccaccaccacgaccctgatggcggcaagatgcccaagtggaccagggtcatcctgctgaactggtgtgcctggttcctgaggatgaagaggcctggagaggacaaggtgcggcctgcctgccagcacaagcagaggcgctgcagcctggcctctgtggagatgtctgctgtggcccctcctccagccagcaatggaaacctgctgtacatcggcttccggggcctggatggagtgcactgtgtgcccaccccagattctggagtggtgtgtggccgcatggcctgcagccccacccatgatgagcacctgctgcacggcggccagcccccagagggggaccctgacctggccaagatcctggaggaggtgcgctacatcgccaaccgcttccgctgccaggatgaaagtgaagctgtgtgcagcgagtggaagtttgctgcctgtgtggtggaccggctgtgcctgatggccttcagcgtcttcaccatcatctgcaccatcggcatcctgatgtctgcccccaactttgtggaggccgtgtccaaggactttgcctag

SEQ ID NO: 147433 - DNA, 210 bp, Artificial Sequence
  Description of Artificial Sequence: Synthetic coding sequence
atgcagaagtactgcatctaccagcacttccagttccagctgctgatccagcacctgtggattgctgccaactgtgacatctgggccaaggtggcccgggtgattggcctgctggccagccacaagacagacctgcaggagaacacccctgtggtggaggccttccccaacagccccaggacccccaccctgcccggggtgctgacctag

SEQ ID NO: 147434 - DNA, 1239 bp, Artificial Sequence
  Description of Artificial Sequence: Synthetic coding sequence
atgcagaagtactgcatctaccagcacttccagttccagctgctgatccagcacctgtggattgctgccaactgtgacattgctgatgaaagatttgatgccaccttccacaccaacgtgctggtgaacagcagcggccactgccagtacctgcccccaggcatcttcaagagcagctgctacattgatgtgcgctggttcccctttgatgtgcagcactgcaagctgaagtttggctcctggagctatggaggctggagcctggacctgcagatgcaggaggccgacatcagcggctacatccccaatggagagtgggacctggtgggcatccctgggaagaggtctgagcgcttctatgagtgctgcaaggagccctacccagatgtgaccttcaccgtgaccatgagaagaaggaccctgtactacggcctgaacctgctgatcccctgtgtgctgatcagcgccctggccctgctggtgttcctgctgcctgctgacagcggggagaagatcagcctgggcatcaccgtgctgctgagcctgactgtgttcatgctgctggtggccgagatcatgcctgccaccagtgacagcgtgcccctgattgcccagtactttgccagcaccatgatcatcgtgggcctgtctgtggtggtgacagtgattgtgctgcagtaccaccaccacgaccctgatggcggcaagatgcccaagtggaccagggtcatcctgctgaactggtgtgcctggttcctgaggatgaagaggcctggagaggacaaggtgcggcctgcctgccagcacaagcagaggcgctgcagcctggcctctgtggagatgtctgctgtggcccctcctccagccagcaatggaaacctgctgtacatcggcttccggggcctggatggagtgcactgtgtgcccaccccagattctggagtggtgtgtggccgcatggcctgcagccccacccatgatgagcacctgctgcacggcggccagcccccagagggggaccctgacctggccaagatcctggaggaggtgcgctacatcgccaaccgcttccgctgccaggatgaaagtgaagctgtgtgcagcgagtggaagtttgctgcctgtgtggtggaccggctgtgcctgatggccttcagcgtcttcaccatcatctgcaccatcggcatcctgatgtctgcccccaactttgtggaggccgtgtccaaggactttgcctag

SEQ ID NO: 147435 - DNA, 447 bp, Artificial Sequence
  Description of Artificial Sequence: Synthetic coding sequence
atgcgctgcagccctggaggagtgtggctggccctggccgccagcctgctgcacgtgtccctgcagggcgagttccagaggaagctgtacaaggagctggtgaagaactacaaccccctggagaggcctgtggccaatgacagccagcccctgactgtgtacttcagcctgagcctgctgcagatcatggatgtggatgagaagaaccaggtgctgaccaccaacatctggctgcagatgtcctggacagaccactacctgcagtggaatgtgtctgagtacccaggagtgaagacagtgcgcttcccagatggccagatctggaagccagacatcctgctgtacaacagcagctatgaccagcagcaggaggtgctggcctacggcatgcactgctggagcccccagtttggccccaccagcagctccatgtttcctgtggtgtag

SEQ ID NO: 147436 - DNA, 600 bp, Artificial Sequence
  Description of Artificial Sequence: Synthetic coding sequence
atgaccaacagcaggaagtgctggcccatgggctgcacagctggggcccacagcctggacccccacccccggctgtgcagcctgctgtgcattggagagttctgtggcagagatggctgcagcgcagatgaaagatttgatgccaccttccacaccaacgtgctggtgaacagcagcggccactgccagtacctgcccccaggcatcttcaagagcagctgctacattgatgtgcgctggttcccctttgatgtgcagcactgcaagctgaagtttggctcctggagctatggaggctggagcctggacctgcagatgcaggaggccgacatcagcggctacatccccaatggagagtgggacctggtgggcatccctgggaagaggtctgagcgcttctatgagtgctgcaaggagccctacccagatgtgaccttcaccgtgaccatgagaagaaggaccctgtactacggcctgaacctgctgatcccctgtgtgctgatcagcgccctggccctgctggtgttcctgctgcctgctgacagcggggagaagatcagcctgggcatcaccgtgctgctgagcctgactgtgttctag

SEQ ID NO: 147437 - DNA, 1596 bp, Artificial Sequence
  Description of Artificial Sequence: Synthetic coding sequence
atgcgctgcagccctggaggagtgtggctggccctggccgccagcctgctgcacggcaaggccacagccagcccccccagcaccccaccctgggaccccggccacatccctggggcctctgtgcggcctgcccctggccctgtgtccctgcagggcgagttccagaggaagctgtacaaggagctggtgaagaactacaaccccctggagaggcctgtggccaatgacagccagcccctgactgtgtacttcagcctgagcctgctgcagatcatggatgtggatgagaagaaccaggtgctgaccaccaacatctggctgcagatgtcctggacagaccactacctgcagtggaatgtgtctgagtacccaggagtgaagacagtgcgcttcccagatggccagatctggaagccagacatcctgctgtacaacagcgcagatgaaagatttgatgccaccttccacaccaacgtgctggtgaacagcagcggccactgccagtacctgcccccaggcatcttcaagagcagctgctacattgatgtgcgctggttcccctttgatgtgcagcactgcaagctgaagtttggctcctggagctatggaggctggagcctggacctgcagatgcaggaggccgacatcagcggctacatccccaacggggagtgggacctggtgggcatccctgggaagaggtctgagcgcttctatgagtgctgcaaggagccctacccagatgtgaccttcaccgtgaccatgagaagaaggaccctgtactacggcctgaacctgctgatcccctgtgtgctgatcagcgccctggccctgctggtgttcctgctgcctgctgacagcggggagaagatcagcctgggcatcaccgtgctgctgagcctgaccgtcttcatgctgctggtggccgagatcatgcctgccaccagtgacagcgtgcccctcatcgcccagtactttgccagcaccatgatcatcgtgggcctgtctgtggtggtgaccgtcatcgtgctgcagtaccaccaccacgaccctgatggcggcaagatgcccaagtggaccagggtcatcctgctgaactggtgtgcctggttcctgaggatgaagaggcctggagaggacaaggtgcggcctgcctgccagcacaagcagaggcgctgcagcctggcctctgtggagatgtctgctgtggcccctcctccagccagcaatggaaacctgctgtacatcggcttccggggcctggatggagtgcactgtgtgcccaccccagacagcggcgtggtgtgtggccgcatggcctgcagccccacccatgatgagcacctgctgcatggaggccagcccccagagggggaccctgacctggccaagatcctggaggaggtgcgctacatcgccaaccgcttccgctgccaggatgagagcgaggccgtgtgcagcgagtggaagtttgctgcctgtgtggtggaccggctgtgcctgatggccttctctgtgttcaccatcatctgcaccatcggcatcctgatgtctgcccccaactttgtggaggccgtgtccaaggactttgcctag

SEQ ID NO: 147438 - DNA, 966 bp, Artificial Sequence
  Description of Artificial Sequence: Synthetic coding sequence
atgcaggaggccgacatcagcggctacatccccaacggggagtgggacctggtgggcatccctgggaagaggtctgagcgcttctatgagtgctgcaaggagccctacccagatgtgaccttcaccgtgaccatgagaagaaggaccctgtactacggcctgaacctgctgatcccctgtgtgctgatcagcgccctggccctgctggtgttcctgctgcctgctgacagcggggagaagatcagcctgggcatcaccgtgctgctgagcctgaccgtcttcatgctgctggtggccgagatcatgcctgccaccagtgacagcgtgcccctcatcgcccagtactttgccagcaccatgatcatcgtgggcctgtctgtggtggtgaccgtcatcgtgctgcagtaccaccaccacgaccctgatggcggcaagatgcccaagtggaccagggtcatcctgctgaactggtgtgcctggttcctgaggatgaagaggcctggagaggacaaggtgcggcctgcctgccagcacaagcagaggcgctgcagcctggcctctgtggagatgtctgctgtggcccctcctccagccagcaatggaaacctgctgtacatcggcttccggggcctggatggagtgcactgtgtgcccaccccagacagcggcgtggtgtgtggccgcatggcctgcagccccacccatgatgagcacctgctgcatggaggccagcccccagagggggaccctgacctggccaagatcctggaggaggtgcgctacatcgccaaccgcttccgctgccaggatgagagcgaggccgtgtgcagcgagtggaagtttgctgcctgtgtggtggaccggctgtgcctgatggccttctctgtgttcaccatcatctgcaccatcggcatcctgatgtctgcccccaactttgtggaggccgtgtccaaggactttgcctag

SEQ ID NO: 147439 - DNA, 1440 bp, Artificial Sequence
  Description of Artificial Sequence: Synthetic coding sequence
atgaactggagccacagctgcatctccttctgctggatctactttgctgccagccggctgcgggctgctgagacagcagatggcaagtatgcccagaagctgttcaatgacctgtttgaggactacagcaatgccctgcggcctgtggaggacacagacaaggtgctgaatgtgaccctgcagatcaccctgagccagatcaaggacatggatgaaagaaaccagatcctgacagcctacctgtggatccggcagatctggcatgatgcctacctgacctgggaccgggaccagtatgatggcctggacagcatccgcatccccagcgacctggtgtggaggccagacatcgtgctgtacaacaaggcagatgatgagagcagcgagcctgtgaacaccaacgtggtgctgcgctatgatggcctcatcacctgggatgccccagccatcaccaagagcagctgtgtggtggatgtgacctacttcccctttgacaaccagcagtgcaacctgaccttcggctcctggacctacaatggaaaccaggtggacatcttcaatgccctggacagcggggacctgagtgacttcattgaagatgtggagtgggaggtgcacggcatgcctgctgtgaagaatgtcatctcctatggctgctgcagcgagccctacccagatgtgaccttcaccctgctgctgaagagaagaagcagcttctacatcgtgaacctgctgatcccctgtgtgctgatctccttcctggcccccctgtccttctacctgcctgctgccagcggggagaaggtgtccctgggcgtgaccatcctgctggccatgaccgtcttccagctgatggtggccgagatcatgcctgcctctgaaaatgtgcccctgattggcaagtactacatcgccaccatggccctgatcacagccagcacagccctgaccatcatggtgatgaacatccacttctgtggggctgaggcccggcctgtgccccactgggcccgggtggtgatcctgaagtacatgagccgggtgctgtttgtgtatgatgtgggggagagctgcctgagcccccaccacagccgggagcgggaccacctgaccaaggtgtacagcaagctgcctgagagcaacctgaaggccgccaggaacaaggacctgagcaggaagaaggacatgaacaagaggctgaagaatgacctgggctgccagggcaagaacccccaggaggccgagagctactgtgcccagtacaaggtgctgaccaggaacatcgagtacatcgccaagtgcctgaaggaccacaaggccaccaacagcaagggcagcgagtggaagaaggtggccaaggtgattgaccgcttcttcatgtggatcttcttcatcatggtgtttgtgatgaccatcctgatcatcgcccgggctgactag

SEQ ID NO: 147440 - DNA, 1506 bp, Artificial Sequence
  Description of Artificial Sequence: Synthetic coding sequence
atgacccctggggccctgctgatgctgctgggcgccctgggcgcccccctggcccctggggtgcggggcagcgaggccgagggccgcctgcgggagaagctgttcagcggctatgacagctctgtgcggcctgcccgggaggtgggggacagagtgcgggtgtctgtgggcctcatcctggcccagctgatcagcctgaatgagaaggatgaggagatgagcaccaaggtgtacctggacctggagtggacagactaccgcctgtcctgggaccctgctgagcatgatggcatcgacagcctgcgcatcacagctgagagcgtgtggctgcctgatgtggtgctgctgaacaacaatgatggcaactttgatgtggccctggacatctctgtggtggtgtccagtgatggctctgtgcgctggcagcccccaggcatctaccgcagcagctgcagcatccaggtgacctacttcccctttgactggcagaactgcaccatggtgttcagcagctacagctatgacagcagcgaggtgtccctgcagacaggcctgggcccagatggccagggccaccaggagatccacatccacgagggcaccttcattgaaaatggccagtgggagatcatccacaagcccagccgcctcatccagcccccaggggacccccggggcggccgggagggccagaggcaggaggtgatcttctacctgatcatccggaggaagcccctcttctacctggtgaatgtgattgccccctgcatcctgatcaccctgctggccatctttgtgttctacctgcccccagatgctggggagaagatgggcctgagcatctttgccctgctgaccctgaccgtcttcctgctgctgctggccgacaaggtgcctgagaccagcctgtctgtgcccatcatcatcaagtacctgatgttcaccatggtgctggtgaccttcagcgtcatcctgtctgtggtggtgctgaacctgcaccacaggagcccccacacccaccagatgcccctgtgggtgcggcagatcttcatccacaagctgcccctgtacctgcggctgaagaggcccaagccagagcgggacctgatgcctgagcccccccactgcagcagccctggcagcggctggggccggggcacagatgagtacttcatcaggaagcccccaagtgacttcctgttccccaagcccaaccgcttccagcctgagctgagcgccccagacctgcggcgcttcattgatggccccaacagagctgtggccctgctgcctgagctgcgggaggtggtgagcagcatctcctacatcgcccggcagctgcaggagcaggaggaccatgatgccctgaaggaggactggcagtttgtggccatggtggtggacaggctcttcctgtggaccttcatcatcttcacctctgtgggcaccctggtgatcttcctggatgccacctaccacctgcccccaccagaccccttcccctag

SEQ ID NO: 147441 - DNA, 1290 bp, Artificial Sequence
  Description of Artificial Sequence: Synthetic coding sequence
atgagcaccaaggtgtacctggacctggagtggacagactaccgcctgtcctgggaccctgctgagcatgatggcatcgacagcctgcgcatcacagctgagagcgtgtggctgcctgatgtggtgctgctgaacaacaatgatggcaactttgatgtggccctggacatctctgtggtggtgtccagtgatggctctgtgcgctggcagcccccaggcatctaccgcagcagctgcagcatccaggtgacctacttcccctttgactggcagaactgcaccatggtgttcagcagctacagctatgacagcagcgaggtgtccctgcagacaggcctgggcccagatggccagggccaccaggagatccacatccacgagggcaccttcattgaaaatggccagtgggagatcatccacaagcccagccgcctcatccagcccccaggggacccccggggcggccgggagggccagaggcaggaggtgatcttctacctgatcatccggaggaagcccctcttctacctggtgaatgtgattgccccctgcatcctgatcaccctgctggccatctttgtgttctacctgcccccagatgctggggagaagatgggcctgagcatctttgccctgctgaccctgaccgtcttcctgctgctgctggccgacaaggtgcctgagaccagcctgtctgtgcccatcatcatcaagtacctgatgttcaccatggtgctggtgaccttcagcgtcatcctgtctgtggtggtgctgaacctgcaccacaggagcccccacacccaccagatgcccctgtgggtgcggcagatcttcatccacaagctgcccctgtacctgcggctgaagaggcccaagccagagcgggacctgatgcctgagcccccccactgcagcagccctggcagcggctggggccggggcacagatgagtacttcatcaggaagcccccaagtgacttcctgttccccaagcccaaccgcttccagcctgagctgagcgccccagacctgcggcgcttcattgatggccccaacagagctgtggccctgctgcctgagctgcgggaggtggtgagcagcatctcctacatcgcccggcagctgcaggagcaggaggaccatgatgccctgaaggaggactggcagtttgtggccatggtggtggacaggctcttcctgtggaccttcatcatcttcacctctgtgggcaccctggtgatcttcctggatgccacctaccacctgcccccaccagaccccttcccctag

SEQ ID NO: 147442 - DNA, 1509 bp, Artificial Sequence
  Description of Artificial Sequence: Synthetic coding sequence
atggcccggcgctgtggccctgtggccctgctgctgggcttcggcctgctgcggctgtgcagcggcgtgtggggcacagacacagaggagcggctggtggagcacctgctggaccccagccgctacaacaagctgatccggcctgccaccaatggaagtgagctggtgacagtgcagctgatggtgtccctggcccagctgatctctgtgcatgagcgggagcagatcatgaccaccaacgtgtggctgacccaggagtgggaggactaccgcctgacctggaagccagaggagtttgacaacatgaagaaggtgcggctgcccagcaagcacatctggctgcctgatgtggtgctgtacaacaatgctgatggcatgtatgaggtgtccttctacagcaatgctgtggtgtcctatgatggcagcatcttctggctgcccccagccatctacaagagcgcctgcaagattgaggtgaagcacttcccctttgaccagcagaactgcaccatgaagttccgctcctggacctatgacagaacagaaattgacctggtgctgaagtctgaggtggccagcctggatgacttcacccccagcggggagtgggacatcgtggccctgcctggaagaagaaatgaaaatccagatgacagcacctacgtggacatcacctatgacttcatcatccggaggaagcccctcttctacaccatcaacctgatcatcccctgtgtgctgatcaccagcctggccatcctggtgttctacctgcccagcgactgtggggagaagatgaccctgtgcatctctgtgctgctggccctgactgtgttcctgctgctgatcagcaagatcgtgccccccaccagcctggatgtgcccctggtgggcaagtacctgatgttcaccatggtgctggtgaccttcagcatcgtgacctctgtgtgtgtgctgaatgtgcaccacaggagccccaccacccacaccatggccccctgggtgaaggtggtgttcctggagaagctgcctgccctgctcttcatgcagcagcccaggcaccactgtgcccggcagaggctgcggctgcggcggcggcagcgggagcgggagggcgctggggccctcttcttccgggaggcccctggagctgacagctgcacctgctttgtgaacagagcctctgtgcagggcctggccggggcctttggagctgagcccgcccctgtggccggccctggccgcagcggggagccctgtggctgcggcctgcgggaggccgtggatggagtgcgcttcatcgctgaccacatgagaagtgaagatgatgaccagagcgtgtctgaggactggaagtatgtggccatggtgattgacaggctcttcctgtggatctttgtgtttgtgtgtgtgtttggcaccatcggcatgttcctgcagcccctcttccagaactacaccaccaccaccttcctgcacagcgaccacagcgcccccagcagcaagtag

SEQ ID NO: 147443 - DNA, 1377 bp, Artificial Sequence
  Description of Artificial Sequence: Synthetic coding sequence
atgctgcctgacttcatgctggtgctgattgtgctgggcatccccagcagcgccaccaccggcttcaacagcattgctgaaaatgaagatgccctgctgcggcacctgttccagggctaccagaagtgggtgcggcctgtgctgcacagcaatgacaccatcaaggtgtacttcggcctgaagatcagccagctggtggatgtggatgagaagaaccagctgatgaccaccaacgtgtggctgaagcaggagtggacagaccacaagctgcgctggaacccagatgattatggaggcatccacagcatcaaggtgcccagcgagagcctgtggctgcctgacatcgtgctgtttgaaaatgctgatggccgctttgagggcagcctgatgaccaaggtgattgtgaagagcaatggcaccgtggtgtggaccccaccagccagctacaagagcagctgcaccatggatgtgaccttcttcccctttgaccggcagaactgcagcatgaagtttggctcctggacctatgatggcaccatggtggacctgatcctgatcaatgaaaatgtggacaggaaggacttctttgacaacggggagtgggagatcctgaatgccaagggcatgaagggcaacagaagagatggagtgtacagctaccccttcatcacctacagctttgtgctgcggcggctgcccctcttctacaccctcttcctgatcatcccctgcctgggcctgtccttcctgactgtgctggtgttctacctgcccagtgatgaaggagagaagctgagcctgagcacctctgtgctggtgtccctgaccgtcttcctgctggtgattgaggagatcatccccagcagcagcaaggtgatccccctcatcggggagtacctgctcttcatcatgatctttgtgaccctgagcatcatcgtgacagtgtttgtgatcaacgtgcaccacaggagcagcagcacctaccaccccatggccccctgggtgaagaggctcttcctgcagaagctgcccaagctgctgtgcatgaaggaccacgtggaccgctacagcagccctgagaaggaggagagccagcctgtggtgaagggcaaggtgctggagaagaagaagcagaagcagctgagtgatggagagaaggtgctggtggccttcctggagaaggctgctgacagcatccgctacatcagcagacatgtgaagaaggagcacttcatcagccaggtggtgcaggactggaagtttgtggcccaggtgctggaccgcatcttcctgtggctgttcctgattgtgtctgtgacaggctctgtgctgatcttcaccccagccctgaagatgtggctgcacagctaccactag

SEQ ID NO: 147444 - DNA, 1497 bp, Artificial Sequence
  Description of Artificial Sequence: Synthetic coding sequence
atgaggcgggcccccagcctggtgctcttcttcctggtggccctgtgtggccggggcaactgccgggtggccaatgctgaggagaagctgatggatgacctgctgaacaagacccgctacaacaacctgatccggcctgccaccagcagcagccagctgatcagcatcaagctgcagctgagcctggcccagctgatctctgtgaatgaaagagagcagatcatgaccaccaacgtgtggctgaagcaggagtggacagactaccgcctgacctggaacagcagccgctatgaaggagtgaacatcctgcgcatcccagccaagaggatctggctgcctgacatcgtgctgtacaacaatgctgatggcacctatgaggtgtctgtgtacaccaacctgattgtgcgcagcaatggatctgtgctgtggctgcccccagccatctacaagagcgcctgcaagattgaggtgaagtacttcccctttgaccagcagaactgcaccctgaagttccgctcctggacctatgaccacacagaaattgacatggtgctgatgacccccacagcctccatggatgacttcacccccagcggggagtgggacatcgtggccctgcctggaagaagaacagtgaacccccaggaccccagctatgtggatgtgacctatgacttcatcatcaagaggaagcccctcttctacaccatcaacctgatcatcccctgtgtgctgaccaccctgctggccatcctggtgttctacctgcccagcgactgtggggagaagatgaccctgtgcatctctgtgctgctggccctgaccttcttcctgctgctgatcagcaagatcgtgccccccaccagcctggatgtgcccctgattggcaagtacctgatgttcaccatggtgctggtgaccttcagcatcgtgacctctgtgtgtgtgctgaatgtgcaccacaggagccccagcacccacaccatggccccctgggtgaagcgctgcttcctgcacaagctgcccaccttcctgttcatgaagaggcctggccctgacagcagccctgcccgggccttcccccccagcaagagctgtgtgaccaagccagaggccacagccaccagcaccagccccagcaacttctacggcaacagcatgtactttgtgaacccagccagcgctgccagcaagagccctgctggcagcacccctgtggccatcccccgggacttctggctgcggagcagcggccgcttccggcaggatgtgcaggaggccctggagggcgtgtccttcatcgcccagcacatgaagaatgatgatgaggaccagagcgtggtggaggactggaagtatgtggccatggtggtggacaggctcttcctgtgggtgttcatgtttgtgtgtgtgctgggcaccgtgggcctcttcctgcccccactcttccagacccatgctgccagcgagggcccctatgctgcccagagggactag

SEQ ID NO: 147445 - DNA, 696 bp, Artificial Sequence
  Description of Artificial Sequence: Synthetic coding sequence
atgaggcgggcccccagcctggtgctcttcttcctggtggccctgtgtggccggggcaactgccgggtggccaatgctgaggagaagctgatggatgacctgctgaacaagacccgctacaacaacctgatccggcctgccaccagcagcagccagctgatcagcatcaagctgcagctgagcctggcccagctgatctctgtgaatgaaagagagcagatcatgaccaccaacgtgtggctgaagcaggagtggacagactaccgcctgacctggaacagcagccgctatgaaggagtgaacatcctgcgcatcccagccaagaggatctggctgcctgacatcgtgctgtacaacaagagcctgaggacaggcagcacctggctgtggtggtggacaggctgcagctgtggctgcagctgcctgtgtgcctcctgggccctgtggggcagcagctaccggcccagcagccggcccatgcagctgctgcggggccccaccctgcccagcgtgacagagggccccctgggctgcggcgtgcggggctgtgagtggccaggcggccactttgctgccagcttctgggtggtggctgatgaggccctgagcaaatatgtgtccatcggccaccagccccaccagaccagccacagccggggcaccgggaaggatggcggcctgggctgccccctgtag

SEQ ID NO: 147446 - DNA, 1554 bp, Artificial Sequence
  Description of Artificial Sequence: Synthetic coding sequence
atggagggccctgtgctgaccctgggcctgctggccgccctggccgtgtgtggctcctggggcctgaatgaggaggagcggctcatccgccacctgttccaggagaagggctacaacaaggagctgcggcctgtggcccacaaggaggagagcgtggatgtggccctggccctgaccctgagcaacctgatcagcctgaaggaggtggaggagaccctgaccaccaacgtgtggattgaacatggctggacagacaaccggctgaagtggaatgctgaggagtttggaaacatctctgtgctgcggctgcccccagacatggtgtggctgcctgagatcgtgctggagaacaacaatgatggcagcttccagatctcctacagctgcaatgtgctggtgtaccactacggctttgtgtactggctgcccccagccatcttccgcagcagctgccccatctctgtgacctacttcccctttgactggcagaactgcagcctgaagttcagcagcctgaagtacacagccaaggagatcaccctgagcctgaagcaggatgccaaggaaaatagaacctaccctgtggagtggatcatcatcgaccctgagggcttcacagaaaatggagagtgggagatcgtgcacaggcctgcccgggtgaatgtggacccccgggcccccctggacagccccagccggcaggacatcaccttctacctgatcatccggaggaagcccctcttctacatcatcaacatcctggtgccctgtgtgctgatctccttcatggtgaacctggtgttctacctgcctgctgacagcggggagaagacctctgtggccatctctgtgctgctggcccagagcgtcttcctgctgctgatcagcaagaggctgcctgccacctccatggccatccccctgattggcaagttcctgctgtttggcatggtgctggtgaccatggtggtggtgatctgtgtgattgtgctgaacatccacttccgcacccccagcacccacgtgctgtctgagggcgtgaagaagctgttcctggagaccctgcctgagctgctgcacatgagcaggcctgcagaagatggccccagccctggggccctggtgcggcgcagcagcagcctgggctacatcagcaaggccgaggagtacttcctgctgaagagcagaagtgacctgatgtttgagaagcagagcgagcggcacggcctggcccggcggctgaccacagcccggcggcccccagccagcagcgagcaggcccagcaggagctgttcaatgagctgaagccagctgtggatggagccaacttcatcgtgaaccacatgagggaccagaacaactacaatgaggagaaggacagctggaacagagtggccaggacagtggaccggctgtgcctgtttgtggtgacccctgtgatggtggtgggcacagcctggatcttcctgcagggcgtgtacaaccagcccccaccccagcccttccctggggacccctacagctacaacgtgcaggacaagcgcttcatctag

SEQ ID NO: 147447 - DNA, 708 bp, Artificial Sequence
  Description of Artificial Sequence: Synthetic coding sequence
atggagggccctgtgctgaccctgggcctgctggccgccctggccgtgtgtggctcctggggcctgaatgaggaggagcggctcatccgccacctgttccaggagaagggctacaacaaggagctgcggcctgtggcccacaaggaggagagcgtggatgtggccctggccctgaccctgagcaacctgatcagcctgaaggaggtggaggagaccctgaccaccaacgtgtggattgaacatggctggacagacaaccggctgaagtggaatgctgaggagtttggaaacatctctgtgctgcggctgcccccagacatggtgtggctgcctgagatcgtgctggagaacaacaatgatggcagcttccagatctcctacagctgcaatgtgctggtgtaccactacggctttgtgtactggctgcccccagccatcttccgcagcagctgccccatctctgtgacctacttcccctttgactggcagaactgcagcctgaagttccgggagcggggcgtgggggacagccccccagctggccagggccagaggggcccccagagccccagcggccagccccagcccccaggccaccacctgctgccccaccaccccccccaggcccccctgctgcaccaccagcaccctggggccctgcgggcccacctgctgcacggccagcccggcctgctgcccaccggctag

SEQ ID NO: 147448 - DNA, 972 bp, Artificial Sequence
  Description of Artificial Sequence: Synthetic coding sequence
atgctgaagaacctggagacctctgtgtcctgtgccagccccaggacctggtgtggcagccagaggctgtgctggaggaccaccatgacagcccccagccgcagccccaccccagccacctgcctgagcaccaccacagccagctgcaccggctgccacctgcccagcagcgcccccccagcccccagcctgagccccatcagccccagcactggaagaacagcccccagcagcagtggaggagagaagacctctgtggccatctctgtgctgctggcccagagcgtcttcctgctgctgatcagcaagaggctgcctgccacctccatggccatccccctgattggcaagttcctgctgtttggcatggtgctggtgaccatggtggtggtgatctgtgtgattgtgctgaacatccacttccgcacccccagcacccacgtgctgtctgagggcgtgaagaagctgttcctggagaccctgcctgagctgctgcacatgagcaggcctgcagaagatggccccagccctggggccctggtgcggcgcagcagcagcctgggctacatcagcaaggccgaggagtacttcctgctgaagagcagaagtgacctgatgtttgagaagcagagcgagcggcacggcctggcccggcggctgaccacagcccggcggcccccagccagcagcgagcaggcccagcaggagctgttcaatgagctgaagccagctgtggatggagccaacttcatcgtgaaccacatgagggaccagaacaactacaatgaggagaaggacagctggaacagagtggccaggacagtggaccggctgtgcctgtttgtggtgacccctgtgatggtggtgggcacagcctggatcttcctgcagggcgtgtacaaccagcccccaccccagcccttccctggggacccctacagctacaacgtgcaggacaagcgcttcatctag

SEQ ID NO: 147449 - DNA, 708 bp, Artificial Sequence; identical to SEQ ID NO: 147447
  Description of Artificial Sequence: Synthetic coding sequence

SEQ ID NO: 147450 - DNA, 1509 bp, Artificial Sequence
  Description of Artificial Sequence: Synthetic coding sequence
atggagggccctgtgctgaccctgggcctgctggccgccctggccgtgtgtggctcctggggcctgaatgaggaggagcggctcatccgccacctgttccaggagaagggctacaacaaggagctgcggcctgtggcccacaaggaggagagcgtggatgtggccctggccctgaccctgagcaacctgatcagcctgggctggacagacaaccggctgaagtggaatgctgaggagtttggaaacatctctgtgctgcggctgcccccagacatggtgtggctgcctgagatcgtgctggagaacaacaatgatggcagcttccagatctcctacagctgcaatgtgctggtgtaccactacggctttgtgtactggctgcccccagccatcttccgcagcagctgccccatctctgtgacctacttcccctttgactggcagaactgcagcctgaagttcagcagcctgaagtacacagccaaggagatcaccctgagcctgaagcaggatgccaaggagaacagaacctaccctgtggagtggatcatcattgatcctgagggcttcacagaaaatggagagtgggagatcgtgcacaggcctgcccgggtgaatgtggacccccgggcccccctggacagccccagccggcaggacatcaccttctacctgatcatccggaggaagcccctcttctacatcatcaacatcctggtgccctgtgtgctgatctccttcatggtgaacctggtgttctacctgcctgctgacagcggggagaagacctctgtggccatctctgtgctgctggcccagagcgtcttcctgctgctgatcagcaagaggctgcctgccacctccatggccatccccctcatcggcaagttcctgctgtttggcatggtgctggtgaccatggtggtggtgatctgtgtgattgtgctgaacatccacttccgcacccccagcacccacgtgctgtctgaaggagtgaagaagctgttcctggagaccctgcctgagctgctgcacatgagcaggcctgcagaagatggccccagccctggggccctggtgagaagaagcagcagcctgggctacatcagcaaggccgaggagtacttcctgctgaagagcagaagtgacctgatgtttgagaagcagagcgagagacatggcctggcccggcggctgaccacagcccggcggcccccagccagcagcgagcaggcccagcaggagctgttcaatgagctgaagccagctgtggatggagccaacttcatcgtgaaccacatgagggaccagaacaactacaatgaggagaaggacagctggaacagagtggccaggacagtggaccggctgtgcctgtttgtggtgacccctgtgatggtggtgggcacagcctggatcttcctgcagggcgtgtacaaccagcccccaccccagcccttccctggggacccctacagctacaacgtgcaggacaagcgcttcatctag

SEQ ID NO: 147451 - DNA, 1482 bp, Artificial Sequence
  Description of Artificial Sequence: Synthetic coding sequence
atggcccgggcccccctgggcgtgctgctgctgctgggcctgctgggccggggcgtgggcaagaatgaggagctgcggctgtaccaccacctgttcaacaactatgaccccggcagcaggcctgtgcgggagcctgaggacacagtgaccatcagcctgaaggtgaccctgaccaacctgatcagcctgaatgagaaggaggagaccctgaccacctctgtgtggattggcatcgactggcaggactaccgcctgaactacagcaaggatgactttggaggcatcgagaccctgcgggtgcccagcgagctggtgtggctgcctgagatcgtgctggagaacaacattgatggccagtttggagtggcctatgatgccaacgtgctggtgtatgaaggaggctctgtgacctggctgcccccagccatctacagatctgtgtgtgctgtggaggtgacctacttcccctttgactggcagaactgcagcctcatcttccgcagccagacctacaatgctgaggaggtggagttcacctttgctgtggacaatgatggcaagaccatcaacaagattgacatcgacacagaggcctacacagaaaatggagagtgggccatcgacttctgccctggggtcatcagaagacaccacggcggggccacagatggccctggagaaacagatgtgatctacagcctcatcatccggaggaagcccctcttctacgtgatcaacatcatcgtgccctgtgtgctgatcagcggcctggtgctgctggcctacttcctgcctgcccaggccggcggccagaagtgcaccgtgtccatcaacgtgctgctggcccagaccgtcttcctgttcctgattgcccagaagatccctgagaccagcctgtctgtgcccctgctgggccgcttcctgatctttgtgatggtggtggccaccctcatcgtgatgaactgtgtgattgtgctgaatgtgtcccagaggacccccaccacccacgccatgagcccccggctgcggcacgtgctgctggagctgctgccccggctgctgggcagccccccacctcctgaggcccccagggctgccagccccccccggcgggccagctctgtgggcctgctgctgcgggcagaggagctgatcctgaagaagcccaggtctgagctggtgtttgagggccagaggcaccggcagggcacctggacagctgccttctgccagagcctgggcgccgccgcccctgaggtgcgctgctgcgtggatgctgtgaactttgtggccgagagcacccgggaccaggaggccaccggggaggaggtgtctgactgggtgaggatgggaaatgccctggacaacatctgcttctgggccgccctggtgctcttctctgtgggcagcagcctcatcttcctgggcgcctacttcaacagagtgcctgacctgccctatgccccctgcatccagccctag

SEQ ID NO: 147452 - DNA, 1554 bp, Artificial Sequence
  Description of Artificial Sequence: Synthetic coding sequence
atgcacggcggccagggccccctgctgctgctgctgctgctggccgtgtgcctgggcgcccagggcaggaaccaggaggagcggctgctggccgacctgatgcagaactatgaccccaacctgcggcctgctgagcgggacagtgatgtggtgaatgtgtccctgaagctgaccctgaccaacctgatcagcctgaatgaaagagaggaggccctgaccaccaacgtgtggattgagatgcagtggtgtgactaccgcctgcgctgggacccccgggactatgagggcctgtgggtgctgcgggtgcccagcaccatggtgtggaggccagacatcgtgctggagaacaacgtggatggagtgtttgaggtggccctgtactgcaatgtgctggtgtccccagatggctgcatctactggctgcccccagccatcttccgcagcgcctgcagcatctctgtgacctacttcccctttgactggcagaactgcagcctcatcttccagagccagacctacagcaccaatgaaattgacctgcagctgagccaggaggatggccagaccatcgagtggatcttcattgatcctgaggccttcacagaaaatggagagtgggccatccagcacaggcctgccaagatgctgctggaccctgctgccccagcccaggaggccggccaccagaaggtggtgttctacctgctgatccagaggaagcccctcttctacgtgatcaacatcatcgccccctgtgtgctgatcagctctgtggccatcctgatccacttcctgcctgccaaggccggcggccagaagtgcaccgtggccatcaacgtgctgctggcccagacagtgttcctgttcctggtggccaagaaggtgcctgagaccagccaggccgtgcccctcatcagcaagtacctgaccttcctgctggtggtgaccatcctgattgtggtgaatgctgtggtggtgctgaatgtgtccctgcggagcccccacacccacagcatggcccggggcgtgaggaaggtgttcctgcggctgctgccccagctgctgaggatgcacgtgcggcccctggccccagctgctgtgcaggacacccagagccggctgcagaatggcagcagcggctggagcatcaccactggagaggaggtggccctgtgcctgcccaggtctgagctgctcttccagcagtggcagaggcagggcctggtggccgccgccctggagaagctggagaagggccctgagctgggcctgagccagttctgtggcagcctgaagcaggccgccccagccatccaggcctgtgtggaggcctgcaacctgattgcctgtgcccggcaccagcagagccactttgacaatggaaatgaggagtggttcctggtgggccgggtgctggacagagtgtgcttcctggccatgctgagcctcttcatctgtggcacagctggcatcttcctgatggcccactacaacagagtgcctgccctgcccttccctggggacccccggccctacctgcccagcccagactag

SEQ ID NO: 147453 - DNA, 1554 bp, Artificial Sequence; identical to SEQ ID NO: 147452
  Description of Artificial Sequence: Synthetic coding sequence

SEQ ID NO: 147454 - DNA, 1080 bp, Artificial Sequence
  Description of Artificial Sequence: Synthetic coding sequence
atggtgcggcccatgctgctgctgagcctgggcctgctggccggcctgctgcctgccctggccgcctgcccccagaactgccactgccacagcgacctgcagcacgtgatctgtgacaaggtgggcctgcagaagatccccaaggtgtctgagaagaccaagctgctgaacctgcagaggaacaacttccctgtgctggccgccaacagcttccgggccatgcccaacctggtgtccctgcacctgcagcactgccagatccgggaggtggccgccggggccttccggggcctgaagcagctgatctacctgtacctgagccacaatgacatccgggtgctgcgggccggggcctttgatgacctgacagagctgacctacctgtacctggaccacaacaaggtgacagagctgccccggggcctgctgagccccctggtgaacctcttcatcctgcagctgaacaacaacaagatccgggagctgcgggccggggccttccagggcgccaaggacctgcgctggctgtacctgtctgaaaatgccctgagcagcctgcagcccggggccctggatgatgtggagaacctggccaagttccacgtggacaggaaccagctgagcagctaccccagcgctgccctgagcaagctgcgggtggtggaggagctgaagctgagccacaaccccctgaagagcatcccagacaatgccttccagagctttggccgctacctggagaccctgtggctggacaacaccaacctggagaagttcagtgatggagccttcctgggcgtgaccaccctgaagcacgtgcacctggagaacaaccggctgaaccagctgcccagcaacttcccctttgacagcctggagaccctggccctgaccaacaacccctggaagtgcacctgccagctgcggggcctgcggcgctggctggaggccaaggccagcaggccagatgccacctgtgccagccctgccaagttcaagggccagcacatccgggacacagatgccttccgcagctgcaagttccccaccaagaggagcaagaaggccggccgccactag

SEQ ID NO: 147455 - DNA, 129 bp, Artificial Sequence
  Description of Artificial Sequence: Synthetic coding sequence
tgagccagcaggccagatgccacctgtgccagccctgccaagttcaagggccagcacatccgggacacagatgccttccgcagctgcaagttccccaccaagaggagcaagaaggccggccgccactag

SEQ ID NO: 147456 - DNA, 1080 bp, Artificial Sequence; identical to SEQ ID NO: 147454
  Description of Artificial Sequence: Synthetic coding sequence

SEQ ID NO: 147457 - DNA, 2328 bp, Artificial Sequence
  Description of Artificial Sequence: Synthetic coding sequence
atgagggccagcctgctgctgtctgtgctgcggcctgctggccctgtggccgtgggcatcagcctgggcttcaccctgagcctgctgtctgtgacctgggtggaggagccctgtggccctggccccccccagcccggggacagcgagctgcccccccggggcaacaccaatgctgcccggcggcccaacagcgtgcagcctggagctgagcgggagaagccaggggccggggagggcgctggggagaactgggagccccgggtgctgccctaccacccagcccagcccggccaggccgccaagaaggctgtgaggacccgctacatcagcacagagctgggcatccggcagaggctgctggtggccgtgctgaccagccagaccaccctgcccaccctgggcgtggccgtgaacagaaccctgggccaccggctggagcgggtggtgttcctgaccggggcccggggcagaagagcccctcctggcatggctgtggtgaccctgggggaggagcggcccatcggccacctgcacctggccctgcggcacctgctggagcagcacggagatgactttgactggttcttcctggtgcctgacaccacctacacagaggcccacggcctggcccggctgaccggccacctgagcctggccagcgctgcccacctgtacctgggccggccccaggacttcatcggcggggagcccaccccaggccgctactgccacggcggctttggagtgctgctgagcaggatgctgctgcagcagctgcggccccacctggagggctgcagaaatgacatcgtgtctgcccggccagatgagtggctgggccgctgcatcctggatgccactggagtgggctgcaccggggaccatgaaggagtgcactacagccacctggagctgagccctggagagcctgtgcaggagggggacccccacttccgcagcgccctgacagcccaccctgtgcgggaccctgtgcacatgtaccagctgcacaaggcctttgcccgggcagagctggagaggacctaccaggagatccaggagctgcagtgggagatccagaacaccagccacctggccgtggatggagaccaggccgccgcctggcctgtgggcatcccagcccccagcaggcctgccagcagatttgaggtgctgcgctgggactacttcacagagcagcacgccttcagctgtgctgatggcagcccccgctgccccctgcggggagctgacagagcagatgtggctgatgtgctgggcacagccctggaggagctgaacagacgctaccacccagccctgcggctgcagaagcagcagctggtgaatggctacagaagatttgatcctgcccggggcatggagtacaccctggacctgcagctggaggccctgaccccccagggcggccggcggcccctgaccaggagagtgcagctgctgcggcccctgagccgggtggagatcctgcctgtgccctacgtgacagaggccagccggctgactgtgctgctgcccctggccgctgctgagcgggacctggcccctggcttcctggaggcctttgccacagctgccctggagcctggagatgctgctgctgccctgaccctgctgctgctgtatgagccccggcaggcccagagggtggcccacgcagatgtgtttgcccctgtgaaggcccacgtggccgagctggagcggcgcttccctggggcccgggtgccctggctgtctgtgcagacagctgcccccagccccctgcggctgatggacctgctgagcaagaagcaccccctggacaccctcttcctgctggccggccctgacacagtgctgaccccagacttcctgaaccgctgcaggatgcacgccatcagcggctggcaggccttcttccccatgcacttccaggccttccaccctgctgtggccccaccccagggccctggccccccagagctgggccgggacaccggccgctttgaccggcaggccgccagcgaggcctgcttctacaacagcgactatgtggccgcccggggccgcctggccgccgccagcgagcaggaggaggagctgctggagagcctggatgtgtatgagctgttcctgcacttcagcagcctgcacgtgctgcgggctgtggagcccgccctgctgcagcgctaccgggcccagacctgcagcgcccggctgtctgaggacctgtaccaccgctgcctgcagagcgtgctggagggcctgggcagcaggacccagctggccatgctgctgtttgagcaggagcagggcaacagcacctag

SEQ ID NO: 147458 - DNA, 1842 bp, Artificial Sequence
  Description of Artificial Sequence: Synthetic coding sequence
atggctgtggtgaccctgggggaggagcggcccatcggccacctgcacctggccctgcggcacctgctggagcagcacggagatgactttgactggttcttcctggtgcctgacaccacctacacagaggcccacggcctggcccggctgaccggccacctgagcctggccagcgctgcccacctgtacctgggccggccccaggacttcatcggcggggagcccaccccaggccgctactgccacggcggctttggagtgctgctgagcaggatgctgctgcagcagctgcggccccacctggagggctgcagaaatgacatcgtgtctgcccggccagatgagtggctgggccgctgcatcctggatgccactggagtgggctgcaccggggaccatgaaggagtgcactacagccacctggagctgagccctggagagcctgtgcaggagggggacccccacttccgcagcgccctgacagcccaccctgtgcgggaccctgtgcacatgtaccagctgcacaaggcctttgcccgggcagagctggagaggacctaccaggagatccaggagctgcagtgggagatccagaacaccagccacctggccgtggatggagaccaggccgccgcctggcctgtgggcatcccagcccccagcaggcctgccagcagatttgaggtgctgcgctgggactacttcacagagcagcacgccttcagctgtgctgatggcagcccccgctgccccctgcggggagctgacagagcagatgtggctgatgtgctgggcacagccctggaggagctgaacagacgctaccacccagccctgcggctgcagaagcagcagctggtgaatggctacagaagatttgatcctgcccggggcatggagtacaccctggacctgcagctggaggccctgaccccccagggcggccggcggcccctgaccaggagagtgcagctgctgcggcccctgagccgggtggagatcctgcctgtgccctacgtgacagaggccagccggctgactgtgctgctgcccctggccgctgctgagcgggacctggcccctggcttcctggaggcctttgccacagctgccctggagcctggagatgctgctgctgccctgaccctgctgctgctgtatgagccccggcaggcccagagggtggcccacgcagatgtgtttgcccctgtgaaggcccacgtggccgagctggagcggcgcttccctggggcccgggtgccctggctgtctgtgcagacagctgcccccagccccctgcggctgatggacctgctgagcaagaagcaccccctggacaccctcttcctgctggccggccctgacacagtgctgaccccagacttcctgaaccgctgcaggatgcacgccatcagcggctggcaggccttcttccccatgcacttccaggccttccaccctgctgtggccccaccccagggccctggccccccagagctgggccgggacaccggccgctttgaccggcaggccgccagcgaggcctgcttctacaacagcgactatgtggccgcccggggccgcctggccgccgccagcgagcaggaggaggagctgctggagagcctggatgtgtatgagctgttcctgcacttcagcagcctgcacgtgctgcgggctgtggagcccgccctgctgcagcgctaccgggcccagacctgcagcgcccggctgtctgaggacctgtaccaccgctgcctgcagagcgtgctggagggcctgggcagcaggacccagctggccatgctgctgtttgagcaggagcagggcaacagcacctag

SEQ ID NO: 147459 - DNA, 2319 bp, Artificial Sequence
  Description of Artificial Sequence: Synthetic coding sequence
atgaggctgagcagcctgctggccctgctgcggcctgccctgcccctcatcctgggcctgagcctgggctgcagcctgagcctgctgcgggtgtcctggatccagggcgagggggaggacccctgtgtggaggccgtgggggagcggggcggcccccagaacccagacagccgggcccggctggaccagagtgatgaggacttcaagccccgcatcgtgccctactacagagaccccaacaagccctacaagaaggtgctgcggacccgctacatccagacagagctgggcagccgggagcggctgctggtggccgtgctgaccagccgggccaccctgagcaccctggccgtggccgtgaacagaacagtggcccaccacttcccccggctgctgtacttcaccggccagagaggagcccgggccccagctggcatgcaggtggtgtcccatggagatgagaggcctgcctggctgatgtctgagaccctgcggcacctgcacacccactttggagctgactatgactggttcttcatcatgcaggatgacacctacgtgcaggccccccggctggccgccctggccggccacctgagcatcaaccaggacctgtacctgggccgggcagaggagttcatcggggccggggagcaggcccgctactgccacggcggcttcggctacctgctgagccgcagcctgctgctgcggctgcggccccacctggatggctgccgcggggacatcctgagcgcccggccagatgagtggctgggccgctgcctgattgacagcctgggcgtgggctgtgtgtcccagcaccagggccagcagtaccgcagctttgagctggccaagaacagagatcctgagaaggagggcagcagcgccttcctgagcgcctttgctgtgcaccctgtgtctgagggcaccctgatgtaccgcctgcacaagcgcttcagcgccctggagctggagcgggcctacagcgagattgagcagctgcaggcccagatccggaacctgactgtgctgaccccagagggggaggccggcctgtcctggcctgtgggcctgcctgcccccttcaccccccacagcagatttgaggtgctgggctgggactacttcacagagcagcacaccttcagctgtgctgatggagcccccaagtgccccctgcagggcgccagcagagcagatgtgggagatgccctggagacagccctggagcagctgaacagacgctaccagccccggctgcgcttccagaagcagaggctgctgaatggctaccgccgctttgatcctgcccggggcatggagtacaccctggacctgctgctggagtgtgtgacccagaggggccacagaagagccctggcccggcgggtgtccctgctgcggcccctgagccgggtggagatcctgcccatgccctacgtgacagaggccaccagggtgcagctggtgctgcccctgctggtggccgaggccgccgccgccccagccttcctggaggcctttgctgccaacgtgctggagccccgggagcacgccctgctgaccctgctgctggtgtatggcccccgggagggcggccgcggggccccagaccccttcctgggcgtgaaggctgctgctgctgagctggagcggcgctacccaggcacccggctggcctggctggccgtgcgggcagaggcccccagccaggtgcggctgatggatgtggtgtccaagaagcaccctgtggacaccctcttcttcctgaccaccgtgtggaccaggcctggccctgaggtgctgaaccgctgcaggatgaatgccatcagcggctggcaggccttcttccctgtgcacttccaggagttcaacccagccctgagcccccagaggagccccccaggccccccaggggccggccctgacccccccagccccccaggagctgaccccagcagaggagcccccatcggcggccgctttgaccggcaggccagcgctgagggctgcttctacaatgctgactacctggccgcccgggcccggctggccggggagctggccggccaggaggaggaggaggccctggagggcctggaggtgatggatgtgttcctgcgcttcagcggcctgcacctgttccgggctgtggagcccggcctggtgcagaagttcagcctgcgggactgcagcccccggctgtctgaggagctgtaccaccgctgccgcctgagcaacctggagggcctgggcggccgggcccagctggccatggccctgtttgagcaggagcaggccaacagcacctag

SEQ ID NO: 147460 - DNA, 2004 bp, Artificial Sequence
  Description of Artificial Sequence: Synthetic coding sequence
atgaggctgagcagcctgctggccctgctgcggcctgccctgcccctcatcctgggcctgagcctgggctgcagcctgagcctgctgcgggtgtcctggatccagggcgagggggaggacccctgtgtggaggccgtgggggagcggggcggcccccagaacccagacagccgggcccggctggaccagagtgatgaggacttcaagccccgcatcgtgccctactacagagaccccaacaagccctacaagaaggtgctgcggacccgctacatccagacagagctgggcagccgggagcggctgctggtggccgtgctgaccagccgggccaccctgagcaccctggccgtggccgtgaacagaacagtggcccaccacttcccccggctgctgtacttcaccggccagagaggagcccgggccccagctggcatgcaggtggtgtcccatggagatgagaggcctgcctggctgatgtctgagaccctgcggcacctgcacacccactttggagctgactatgactggttcttcatcatgcaggatgacacctacgtgcaggccccccggctggccgccctggccggccacctgagcatcaaccaggacctgtacctgggccgggcagaggagttcatcggggccggggagcaggcccgctactgccacggcggcttcggctacctgctgagccgcagcctgctgctgcggctgcggccccacctggatggctgccgcggggacatcctgagcgcccggccagatgagtggctgggccgctgcctgattgacagcctgggcgtgggctgtgtgtcccagcaccagggccagcagtaccgcagctttgagctggccaagaacagagatcctgagaaggagggcagcagcgccttcctgagcgcctttgctgtgcaccctgtgtctgagggcaccctgatgtaccgcctgcacaagcgcttcagcgccctggagctggagcgggcctacagcgagattgagcagctgcaggcccagatccggaacctgactgtgctgaccccagagggggaggccggcctgtcctggcctgtgggcctgcctgcccccttcaccccccacagcagatttgaggtgctgggctgggactacttcacagagcagcacaccttcagctgtgctgatggagcccccaagtgccccctgcagggcgccagcagagcagatgtgggagatgccctggagacagccctggagcagctgaacagacgctaccagccccggctgcgcttccagaagcagaggctgctgaatggctaccgccgctttgatcctgcccggggcatggagtacaccctggacctgctgctggagtgtgtgacccagaggggccacagaagagccctggcccggcgggtgtccctgctgcggcccctgagccgggtggagatcctgcccatgccctacgtgacagaggccaccagggtgcagctggtgctgcccctgctggtggccgaggccgccgccgccccagccttcctggaggcctttgctgccaacgtgctggagccccgggagcacgccctgctgaccctgctgctggtgtatggcccccgggagggcggccgcggggccccagaccccttcctgggcgtgaaggctgctgctgctgagctggagcggcgctacccaggcacccggctggcctggctggccgtgcgggcagaggcccccagccaggtgcggctgatggatgtggtgtccaagaagcaccctgtggacaccctcttcttcctgaccaccgtgtggaccaggcctggccctgaggtgctgaaccgctgcaggatgaatgccatcagcggctggcaggccttcttccctgtgcacttccaggagttcaacccagccctgagcccccagaggagccccccacccaacctgatcaccttccccctgagcgccagcgcccctggccgggcccggcaggacggcggccagatcgagaactgctgctgcatcttctag

SEQ ID NO: 147461 - DNA, 6969 bp, Artificial Sequence
  Description of Artificial Sequence: Synthetic coding sequence
atgcagagcggccccaggcctcccctgcctgcccctggcctggccctggccctgaccctgaccatgctggcccggctggccagcgctgccagcttctttggagagaaccacctggaggtgcctgtggccacagccctgacagacatcgacctgcagctgcagttcagcaccagccagcctgaggccctgctgctgctggccgccggccctgctgaccacctgctgctgcagctgtacagcggccgcctgcaggtgcggctggtgctgggccaggaggagctgcggctgcagaccccagctgagaccctgctgagtgacagcatcccccacacagtggtgctgactgtggtggagggctgggccaccctgtctgtggatggcttcctgaatgccagcagcgctgtgcctggggcccccctggaggtgccctacggcctgtttgtgggcggcaccggcaccctgggcctgccctacctgcggggcaccagccggcccctgcggggctgcctgcacgccgccaccctgaatggccgcagcctgctgcggcccctgaccccagatgtgcatgagggctgtgccgaggagttcagcgccagtgatgatgtggccctgggcttcagcggcccccacagcctggccgccttccctgcctggggcacccaggatgagggcaccctggagttcaccctgaccacccagagccggcaggcccccctggccttccaggccggcggccggcggggggacttcatctacgtggacatctttgagggccacctgcgggctgtggtggagaagggccagggcaccgtgctgctgcacaacagcgtgcctgtggctgatggccagccccatgaggtgtctgtgcacatcaatgcccaccggctggagatctctgtggaccagtaccccacccacaccagcaacagaggagtgctgagctacctggagccccggggcagcctgctgctgggcggcctggatgctgaggccagccgccacctgcaggagcaccggctgggcctgaccccagaggccaccaatgccagcctgctgggctgcatggaggacctgtctgtgaatggccagaggcggggcctgcgggaggccctgctgaccaggaacatggccgccggctgccgcctggaggaggaggagtatgaagatgatgcctacggccactatgaggccttcagcaccctggcccctgaggcctggccagccatggagctgcctgagccctgtgtgcctgagcccggcctgccccctgtgtttgccaacttcacccagctgctgaccatcagccccctggtggtggccgagggcggcacagcctggctggagtggaggcatgtgcagcccaccctggacctgatggaggccgagctgaggaagagccaggtgctcttctctgtgaccaggggggcccggcacggggagctggagctggacatccctggggcccaggccaggaagatgttcaccctgctggatgtggtgaacaggaaggcccgcttcatccatgatggcagcgaggacaccagtgaccagctggtgctggaggtgtctgtgacagcccgggtgcccatgcccagctgcctgcggcggggccagacctacctgctgcccatccaggtgaaccctgtgaatgaccccccccacatcatcttcccccacggcagcctgatggtgatcctggagcacacccagaagcccctgggccctgaggtgttccaggcctatgaccctgattctgcctgtgagggcctgaccttccaggtgctgggcaccagcagcggcctgcctgtggagcggcgggaccagcctggagagcccgccacagagttcagctgccgggagctggaggccggcagcctggtgtatgtgcaccggggcggccctgcccaggacctgaccttccgggtgtctgatggcctgcaggccagccccccagccaccctgaaggtggtggccatccggcctgccatccagatccacaggagcacaggcctgcggctggcccagggcagcgccatgcccatcctgcctgccaacctgtctgtggagaccaatgctgtgggccaggatgtgtctgtgctcttccgggtgactggagccctgcagtttggagagctgcagaagcagggcgctgggggcgtggagggcgctgagtggtgggccacccaggccttccaccagagagatgtggagcagggccgggtgcgctacctgagcacagacccccagcaccacgcctatgacacagtggagaacctggccctggaggtgcaggtgggccaggagatcctgagcaacctgtccttccctgtgaccatccagagggccaccgtgtggatgctgcggctggagcccctgcacacccagaacacccagcaggagaccctgaccacagcccacctggaggccaccctggaggaggccggccccagcccccccaccttccactatgaggtggtgcaggcccccaggaaaggaaacctgcagctgcagggcacccggctgagtgatggccagggcttcacccaggatgacatccaggccggccgggtgacctatggagccacagcccgggccagcgaggccgtggaggacaccttccgcttccgggtgacagccccaccctacttcagccccctgtacaccttccccatccacatcggcggggaccctgatgcccctgtgctgaccaacgtgctgctggtggtgcctgagggcggggagggcgtgctgtctgctgaccacctgtttgtgaagagcctgaacagcgccagctacctgtatgaggtgatggagcggcccaggcatggccgcctggcctggaggggcacccaggacaagaccaccatggtgaccagcttcaccaatgaagacctgctgcggggccgcctggtgtaccagcatgatgattctgagaccacagaagatgacatcccctttgtggccacccggcagggcgagagcagcggggacatggcctgggaggaggtgcggggcgtcttccgggtggccatccagcctgtgaatgaccacgcccctgtgcagaccatcagccgcatcttccacgtggcccggggcggccggcggctgctgaccacagatgatgtggccttcagtgatgctgacagcggctttgctgatgcccagctggtgctgaccaggaaggacctgctgtttggcagcatcgtggccgtggatgagcccacccggcccatctaccgcttcacccaggaggacctgaggaagagaagagtgctgtttgtgcacagcggggctgaccggggctggatccagctgcaggtgtctgatggccagcaccaggccacagccctgctggaggtgcaggccagcgagccctacctgcgggtggccaacggcagcagcctggtggtgccccagggcggccagggcaccatcgacacagctgtgctgcacctggacaccaacctggacatccgctctggagatgaggtgcactaccacgtgacagctggcccccgctggggccagctggtgcgggccggccagcctgccacagccttcagccagcaggacctgctggatggagctgtgctgtacagccacaacggcagcctgagcccccgggacaccatggccttctctgtggaggccggccctgtgcacacagatgccaccctgcaggtgaccatcgccctggagggccccctggcccccctgaagctggtgcgccacaagaagatctacgtgttccagggcgaggccgctgagatccggcgggaccagctggaggccgcccaggaggccgtgcccccagctgacatcgtgttttctgtgaagagccccccatctgctggctacctggtgatggtgtccagaggagccctggctgatgagccccccagcctggaccctgtgcagagcttcagccaggaggccgtggacaccggccgggtgctgtacctgcacagcaggcctgaggcctggagcgatgccttcagcctggatgtggccagcggcctgggcgcccccctggagggcgtgctggtggagctggaggtgctgcctgctgccatccccctggaggcccagaacttctctgtgcctgagggcggcagcctgaccctggccccacccctgctgcgggtgtctggcccctacttccccaccctgctgggcctgagcctgcaggtgctggagcccccccagcacggggccctgcagaaggaggatggcccccaggcccggaccctgagcgccttctcctggaggatggtggaggagcagctgatccgctacgtgcatgatggcagcgagaccctgacagacagctttgtgctgatggccaatgccagcgagatggaccggcagagccaccctgtggccttcaccgtgacagtgctgcctgtgaatgaccagccccccatcctgaccaccaacacaggcctgcagatgtgggagggcgccacagcccccatcccagctgaggccctgcggagcacagatggagacagcggcagcgaggacctggtgtacaccatcgagcagcccagcaatggccgggtggtgctgcggggggcccctggaacagaggtgcgctccttcacccaggcccagctggatggcggcctggtgctcttcagccaccggggcaccctggatggcggcttccgcttccggctgagtgatggagagcacaccagccctggccacttcttccgggtgacagcccagaagcaggtgctgctgagcctgaagggcagccagaccctgactgtgtgccccggctctgtgcagcccctgagcagccagaccctgcgggccagcagcagcgctggaacagacccccagctgctgctgtacagagtggtgcggggcccccagctgggccgcctcttccacgcccagcaggacagcactggagaggccctggtgaacttcacccaggccgaggtgtatgccggcaacatcctgtatgagcacgagatgcctcctgagcccttctgggaggcccatgacaccctggagctgcagctgagcagccccccagccagagatgtggccgccaccctggccgtggccgtgtcctttgaggccgcctgcccccagaggcccagccacctgtggaagaacaagggcctgtgggtgcctgagggccagagggcccgcatcaccgtggccgccctggatgccagcaacctgctggcctctgtgcccagcccccagaggagtgaacatgatgtgctcttccaggtgacccagttccccagccggggccagctgctggtgtctgaggagcccctgcatgctggccagccccacttcctgcagagccagctggccgccggccagctggtgtatgcccacggcggcggcggcacccagcaggacggcttccacttccgggcccacctgcagggccctgctggggcctctgtggccggcccccagaccagcgaggcctttgccatcaccgtgagagatgtgaatgaaagaccaccccagccccaggcctctgtgcccctgcggctgacccggggcagccgggcccccatcagccgggcccagctgtctgtggtggaccctgattctgcccctggagaaattgaatatgaggtgcagagggccccccacaacggcttcctgagcctggtgggcggcggcctgggccctgtgacccgcttcacccaggctgatgtggacagcggccgcctggcctttgtggccaacggcagctctgtggccggcatcttccagctgtccatgtctgatggagccagcccccccctgcccatgagcctggccgtggacatcctgcccagcgccatcgaggtgcagctgcgggcccccctggaggtgccccaggccctgggccgcagcagcctgagccagcagcagctgcgggtggtgtctgaccgggaggagcctgaggccgcctaccgcctcatccagggcccccagtatggccacctgctggtgggcggccggcccaccagcgccttcagccagttccagattgaccagggcgaggtggtgtttgccttcaccaacttcagcagcagccatgaccacttccgggtgctggccctggcccggggcgtgaatgccagcgctgtggtgaatgtgacagtgcgggccctgctgcacgtgtgggccggcggcccctggccccagggcgccaccctgcggctggaccccaccgtgctggatgctggggagctggccaacagaactggatctgtgccccgcttccggctgctggagggccccaggcatggccgggtggtgcgggtgccccgggccaggacagagcccggcggcagccagctggtggagcagttcacccagcaggacctggaggatggccgcctgggcctggaggtgggccggcctgagggccgggcccctggccctgctggggacagcctgaccctggagctgtgggcccagggcgtgcccccagctgtggccagcctggactttgccacagagccctacaatgctgcccggccctacagcgtggccctgctgtctgtgcctgaggccgccaggacagaggccggcaagccagagagcagcacccccactggagagcccggccccatggccagcagccctgagcctgctgtggccaagggcggcttcctgtccttcctggaggccaacatgttcagcgtcatcatccccatgtgcctggtgctgctgctgctggccctgatcctgcccctgctcttctacctgaggaagaggaacaagacaggcaagcatgatgtgcaggtgctgacagccaagcccagaaatggcctggccggggacacagagaccttcaggaaggtggagcccggccaggccatccccctgacagctgtgcccggccagggccccccacctgggggccagcctgaccctgagctgctgcagttctgcaggacccccaacccagccctgaagaatggccagtactgggtgtag

SEQ ID NO: 147462 - DNA, 984 bp, Artificial Sequence
  Description of Artificial Sequence: Synthetic coding sequence
gagcagcaccgggaggagcctgaggccgcctaccgcctcatccagggcccccagtatggccacctgctggtgggcggccggcccaccagcgccttcagccagttccagattgaccagggcgaggtggtgtttgccttcaccaacttcagcagcagccatgaccacttccgggtgctggccctggcccggggcgtgaatgccagcgctgtggtgaatgtgacagtgcgggccctgctgcacgtgtgggccggcggcccctggccccagggcgccaccctgcggctggaccccaccgtgctggatgctggggagctggccaacagaactggatctgtgccccgcttccggctgctggagggccccaggcatggccgggtggtgcgggtgccccgggccaggacagagcccggcggcagccagctggtggagcagttcacccagcaggacctggaggatggccgcctgggcctggaggtgggccggcctgagggccgggcccctggccctgctggggacagcctgaccctggagctgtgggcccagggcgtgcccccagctgtggccagcctggactttgccacagagccctacaatgctgcccggccctacagcgtggccctgctgtctgtgcctgaggccgccaggacagaggccggcaagccagagagcagcacccccactggagagcccggccccatggccagcagccctgagcctgctgtggccaagggcggcttcctgtccttcctggaggccaacatgttcagcgtcatcatccccatgtgcctggtgctgctgctgctggccctgatcctgcccctgctcttctacctgaggaagaggaacaagacaggcaagcatgatgtgcaggtgctgacagccaagcccagaaatggcctggccggggacacagagaccttcaggaaggtggagcccggccaggccatccccctgacagctgtgcccggccagggccccccatag

SEQ ID NO: 147463 - DNA, 2409 bp, Artificial Sequence
  Description of Artificial Sequence: Synthetic coding sequence
atggccgcccggggccggcgggcctggctgtctgtgctgctgggcctggtgctgggctttgtgctggccagccggctggtgctgccccgggccagcgagctgaagagagctggccccaggagaagagccagccctgagggctgccgcagcggccaggccgccgccagccaggccggcggggcccggggagatgcccggggggcccagctgtggcccccaggcagtgaccctgatggcggcccccgggacaggaacttcctgtttgtgggcgtgatgacagcccagaagtacctgcagaccagggctgtggccgcctaccgcacctggagcaagaccatccctgggaaggtgcagttcttcagcagcgagggcagtgacacctctgtgcccatccctgtggtgcccctgcggggcgtggatgacagctacccaccccagaagaagagcttcatgatgctgaagtacatgcatgaccactacctggacaagtatgagtggttcatgagagcagatgatgatgtgtacatcaagggggaccggctggagaacttcctgcggagcctgaacagcagcgagcccctcttcctgggccagacaggcctgggcaccacagaggagatgggcaagctggccctggagcccggggagaacttctgcatgggcggccctggggtcatcatgagccgggaggtgctgcggaggatggtgccccacatcggcaagtgcctgcgggagatgtacaccacccatgaagatgtggaggtgggccgctgtgtgagaagatttgctggggtgcagtgtgtgtggagctatgagatgcagcagctgttctatgaaaattatgagcagaacaagaagggctacatccgggacctgcacaacagcaagatccaccaggccatcaccctgcaccccaacaagaaccccccctaccagtaccgcctgcacagctacatgctgagcaggaagatcagcgagctgcggcacaggaccatccagctgcaccgggagatcgtgctgatgagcaagtacagcaacacagagatccacaaggaggacctgcagctgggcatccccccatccttcatgaggttccagccccggcagcgggaggagatcctggagtgggagttcctgaccgggaagtacctgtacagcgctgtggatggccagcccccccggcggggcatggattctgcccagcgggaggccctggatgacatcgtgatgcaggtgatggagatgatcaatgccaatgccaagacccggggccgcatcatcgacttcaaggagatccagtatggctacagaagagtgaaccccatgtatggagctgagtacatcctggacctgctgctgctgtacaagaagcacaagggcaagaagatgacagtgcctgtgagaagacatgcctacctgcagcagaccttcagcaagatccagtttgtggagcacgaggagctggatgcccaggagctggccaagaggatcaaccaggagagcggcagcctgtccttcctgagcaacagcctgaagaagctggtgcccttccagctgcccggcagcaagtctgagcacaaggagcccaaggacaagaagatcaacatcctgatccccctgagcggccgctttgacatgtttgtgcgcttcatgggcaactttgagaagacctgcctgatccccaaccagaatgtgaagctggtggtgctgctcttcaacagcgacagcaacccagacaaggccaagcaggtggagctgatgagggactaccgcatcaagtaccccaaggctgacatgcagatcctgcctgtgtctggagagttcagccgggccctggccctggaggtgggcagcagccagttcaacaatgaaagcctgctcttcttctgtgatgtggacctggtgttcaccacagagttcctgcagcgctgccgggccaacacagtgctgggccagcagatctacttccccatcatcttcagccagtatgaccccaagatcgtgtacagcggcaaggtgcccagcgacaaccactttgccttcacccagaagacaggcttctggagaaattatggcttcggcatcacctgcatctacaagggggacctggtgcgggtgggcggctttgatgtgtccatccagggctggggcctggaggatgtggacctcttcaacaaggtggtgcaggccggcctgaagaccttccgcagccaggaggtgggcgtggtgcacgtgcaccaccctgtgttctgtgaccccaacctggaccccaagcagtacaagatgtgcctgggcagcaaggccagcacctacggcagcacccagcagctggccgagatgtggctggagaagaatgaccccagctacagcaagagcagcaacaacaacggctctgtgaggacagcctag

SEQ ID NO: 147464 - DNA, 2649 bp, Artificial Sequence
  Description of Artificial Sequence: Synthetic coding sequence
atggctgtgcgcagccggcggccctggatgtctgtggccctgggcctggtgctgggcttcaccgctgcctcctggctgattgccccccgggtggccgagctgtctgagaggaagagaagaggcagcagcctgtgcagctactacggccgctctgctgctggccccagggctggggcccagcagcccctgccccagccccagagccggccccggcaggagcagagccccccaccagcccggcaggacctgcagggcccccccctgcctgaggccgcccctggcatcaccagcttccgcagcagcccctggcagcagcccccacccctgcagcagaggagaagaggccgggagcctgagggcgccaccggcctgcccggggccccagctgctgagggggagcctgaggaggaggatggaggagctgctggccagaggagagatggccggcccggcagcagccacaatggaagtggagatggaggagctgctgcccccagcgcccggccccgggacttcctgtatgtgggcgtgatgacagcccagaagtacctgggcagccgggccctggccgcccagaggacctgggcccgcttcatccctggccgggtggagttcttcagcagccagcagcccccaaatgccggccagcccccaccacccctgcccgtcatcgccctgcccggggtggatgacagctacccaccccagaagaagagcttcatgatgatcaagtacatgcatgaccactacctggacaagtatgagtggttcatgagagcagatgatgatgtgtacatcaagggggacaagctggaggagttcctgcggagcctgaacagcagcaagcccctgtacctgggccagacaggcctgggcaacatcgaggagctgggcaagctgggcctggagcccggggagaacttctgcatgggcggccctggcatgatcttcagccgggaggtgctgcggaggatggtgccccacatcggagaatgtctgcgggagatgtacaccacccatgaagatgtggaggtgggccgctgtgtgagaagatttggaggcacccagtgtgtgtggagctatgagatgcagcagctgttccatgaaaattatgagcacaacaggaagggctacatccaggacctgcacaacagcaagatccatgctgccatcaccctgcaccccaacaagaggcctgcctaccagtaccgcctgcacaactacatgctgagcaggaagatcagcgagctgcgctaccgcaccatccagctgcaccgggagagcgccctgatgagcaagctgagcaacacagaggtgtccaaggaggaccagcagctgggcgtcatccccagcttcaaccacttccagccccgggagagaaatgaagtcatcgagtgggagttcctgaccgggaagctgctgtacagcgctgctgagaaccagcccccccggcagagcctgagcagcatcctgaggacagccctggatgacacagtgctgcaggtgatggagatgatcaatgaaaatgccaagagccggggccgcctgattgacttcaaggagatccagtatggctacagaagagtgaaccccatgcatggagtggagtacatcctggacctgctgctgctgtacaagaggcacaagggcaggaagctgactgtgcctgtgagaagacatgcctacctgcagcagctgttcagcaagcccttcttccgggagacagaggagctggatgtgaacagcctggtggagagcatcaacagcgagacccagagcttctccttcatcagcaacagcctgaagatcctgagcagcttccagggcgccaaggagatgggcggccacaatgagaagaaggtgcacatcctggtgcccctcatcggccgctatgacatcttcctgcgcttcatggagaactttgagaacatgtgcctgatccccaagcagaatgtgaagctggtgatcatcctcttcagccgggacagcggccaggacagcagcaagcacatcgagctgatcaagggctaccagaacaagtaccccaaggccgagatgaccctcatccccatgaagggggagttcagccggggcctgggcctggagatggccagcgcccagtttgacaatgacaccctgctgctcttctgtgatgtggacctgatcttccgggaggacttcctgcagcgctgccgggacaacaccatccagggccagcaggtgtactaccccatcatcttcagccagtatgaccccaaggtgaccaacggcggcaaccccccaacagatgactacttcatcttcagcaagaagacaggcttctggagggactatggctacggcatcacctgcatctacaagagtgacctgctgggcgccggcggctttgacaccagcatccagggctggggcctggaggatgtggacctgtacaacaaggtgatcctgagcggcctgcggcccttccgcagccaggaggtgggcgtggtgcacatcttccaccctgtgcactgtgaccccaacctggaccccaagcagtacaagatgtgcctgggcagcaaggccagcacctttgccagcaccatgcagctggccgagctgtggctggagaagcacctgggcgtgcgctacaacagaaccctgtcctag

SEQ ID NO: 147465 - DNA, 2868 bp, Artificial Sequence
  Description of Artificial Sequence: Synthetic coding sequence
atgcccagcctgcctgcccccccagcccccctgctgctgctgggcctgctgctgctgggcagcaggcctgcccggggagctggccctgagccccctgtgctgcccatccgctctgagaaggagcccctgcctgtgagaggagctgctggctgcacctttggaggcaaggtgtatgccctggatgagacctggcacccagacctgggggagcccttcggcgtgatgagatgtgtgctgtgtgcctgtgaggccccccagtggggccgccgcacccggggccctggccgggtgtcctgcaagaacatcaagccagaatgtcccaccccagcctgtggccagccccggcagctgcccggccactgctgccagacctgcccccaggagaggagcagcagcgagcggcagcccagcggcctgagctttgagtacccccgggaccctgagcacaggagctacagcgacagaggagagcccggggctgaggagcgggcccggggagatggccacacagactttgtggccctgctgaccggccccaggagccaggccgtggcccgggcccgggtgtccctgctgcggagcagcctgcgcttcagcatctcctacagaaggctggaccggcccacccgcatccgcttcagtgacagcaatggatctgtgctgtttgagcaccctgctgcccccacccaggacggcctggtgtgtggggtgtggagggctgtgccccggctgagcctgcggctgctgcgggcagagcagctgcacgtggccctggtgaccctgacccaccccagcggggaggtgtggggccccctcatccgccaccgggccctggccgctgagaccttcagcgccatcctgaccctggagggccccccccagcagggcgtgggcggcatcaccctgctgaccctgagtgacacagaggacagcctgcacttcctgctgctcttccggggcctgctggagcccaggtctgggggcctgacccaggtgcccctgcggctgcagatcctgcaccagggccagctgctgcgggagctgcaggccaacgtgtctgcccaggagcccggctttgctgaggtgctgcccaacctgactgtgcaggagatggactggctggtgctgggggagctgcagatggccctggagtgggccggccggcccggcctgcgcatcagcggccacatcgccgccaggaagagctgtgatgtgctgcagagcgtgctgtgtggggctgatgccctgatccctgtgcagacaggagctgctggcagcgccagcctgaccctgctgggcaatggcagcctcatctaccaggtgcaggtggtgggcaccagcagcgaggtggtggccatgaccctggagaccaagccccagaggcgggaccagaggacagtgctgtgccacatggccggcctgcagcccggcggccacacagctgtgggcatctgccccggcctgggcgcccggggggcccacatgctgctgcagaatgaactcttcctgaatgtgggcaccaaggacttcccagatggagagctgcggggccacgtggccgccctgccctactgcggccacagcgcccggcatgacaccctgcctgtgcccctggccggggccctggtgctgccccctgtgaagagccaggccgccggccacgcctggctgagcctggacacccactgccacctgcactatgaggtgctgctggccggcctgggcggcagcgagcagggcaccgtgacagcccacctgctgggccccccaggcaccccaggcccccggcggctgctgaagggcttctacggcagcgaggcccagggcgtggtgaaggacctggagcctgagctgctgcggcacctggccaagggcatggccagcctgatgatcaccaccaagggcagccccagaggagagctgcggggccaggtgcacatcgccaaccagtgtgaggtgggcggcctgcggctggaggccgccggggctgagggcgtgcgggccctgggcgccccagacacagccagcgctgcccctcctgtggtgcccggcctgcctgccctggccccagccaagccaggcggccctggccggccccgggaccccaacacctgcttctttgagggccagcagaggccccacggggcccgctgggcccccaactatgaccccctgtgcagcctgtgcacctgccagaggagaactgtcatctgtgaccctgtggtgtgccccccacccagctgcccccaccctgtgcaggccccagaccagtgctgccctgtgtgcccagagaagcaggatgtgcgggacctgcccggcctgcccaggagccgggaccccggggagggctgctactttgatggagaccgctcctggagggctgctggcacccgctggcaccctgtggtgccccccttcggcctcatcaagtgtgctgtgtgcacctgcaagggcggcaccggggaggtgcactgtgagaaggtgcagtgcccccggctggcctgtgcccagcctgtgcgggtgaaccccacagactgctgcaagcagtgccctgtgggcagcggggcccacccccagctgggggaccccatgcaggctgatggcccccggggctgccgctttgctggccagtggttccctgagagccagagctggcaccccagcgtgcccccatttggagagatgagctgcatcacctgccgctgtggggccggcgtgccccactgtgaaagagatgactgcagcctgcccctgagctgtggcagcggcaaggagagccgctgctgcagccgctgcacagcccaccggcggcctgcccctgagaccaggacagatcctgagctggagaaggaggccgagggcagctag

SEQ ID NO: 147466 - DNA, 285 bp, Artificial Sequence
  Description of Artificial Sequence: Synthetic coding sequence
atgcccagcctgcctgcccccccagcccccctgctgctgctgggcctgctgctgctgggcagcaggcctgcccggggagctggccctgagccccctgtgctgcccatccgctctgagaaggagcccctgcctgtgagaggagctgctggctgcacctttggaggcaaggtgtatgccctggatgagacctggcacccagacctgggggagcccttcggcgtgatgagatgtgtgctgtgtgcctgtgaggccaccggcaccctgcggccccgggagatgaagtag

SEQ ID NO: 147467 - DNA, 1512 bp, Artificial Sequence
  Description of Artificial Sequence: Synthetic coding sequence
ggggagcacctgagccagaagggcccccacgtgcggccctgcaggaccaaccctggcagcctggaggccccagacagcacccctggggccgccacagcccggaccagcggccagtgcctgagccctggagagtggggcagcggcagccgctgccacctgtcctggcccctggccatcgcccaccacaccctgctgtgcccccaggagcccggctttgctgaggtgctgcccaacctgactgtgcaggagatggactggctggtgctgggggagctgcagatggccctggagtgggccggccggcccggcctgcgcatcagcggccacatcgccgccaggaagagctgtgatgtgctgcagagcgtgctgtgtggggctgatgccctgatccctgtgcagacaggagctgctggcagcgccagcctgaccctgctgggcaatggcagcctcatctaccaggtgcaggtggtgggcaccagcagcgaggtggtggccatgaccctggagaccaagccccagaggcgggaccagaggacagtgctgtgccacatggccggcctgcagcccggcggccacacagctgtgggcatctgccccggcctgggcgcccggggggcccacatgctgctgcagaatgagctgttcctgaatgtgggcaccaaggacttcccagatggagagctgcggggccacgtggccgccctgccctactgcggccacagcgcccggcatgacaccctgcctgtgcccctggccggggccctggtgctgccccctgtgaagagccaggccgccggccacgcctggctgagcctggacacccactgccacctgcactatgaggtgctgctggccggcctgggcggcagcgagcagggcaccgtgacagcccacctgctgggccccccaggcaccccaggcccccggcggctgctgaagggcttctacggcagcgaggcccagggcgtggtgaaggacctggagcctgagctgctgcggcacctggccaagggcatggccagcctgatgatcaccaccaagggcagccccagaggagagctgcggggccaggtgcacatcgccaaccagtgtgaggtgggcggcctgcggctggaggccgccggggctgagggcgtgcgggccctgggcgccccagacacagccagcgctgcccctcctgtggtgcccggcctgcctgccctggccccagccaagccaggcggccctggccggccccgggaccccaacacctgcttctttgagggccagcagaggcctcatggagcccgctgggcccccaactatgaccccctgtgcagcctgtgcacctgccagaggagaactgtcatctgtgaccctgtggtgtgccccccacccagctgcccccaccctgtgcaggccccagaccagtgctgccctgtgtgcccagagaagcaggatgtgcgggacctgcccggcctgcccaggagccgggaccctggagagggcggccactggaggggggccctgtag

SEQ ID NO: 147468 - DNA, 2748 bp, Artificial Sequence
  Description of Artificial Sequence: Synthetic coding sequence
atgcccagcctgcctgcccccccagcccccctgctgctgctgggcctgctgctgctgggcagcaggcctgcccggggagctggccctgagccccctgtgctgcccatccgctctgagaaggagcccctgcctgtgagaggagctgctggctgcacctttggaggcaaggtgtatgccctggatgagacctggcacccagacctgggggagcccttcggcgtgatgagatgtgtgctgtgtgcctgtgaggccccccagtggggccgccgcacccggggccctggccgggtgtcctgcaagaacatcaagccagaatgtcccaccccagcctgtggccagccccggcagctgcccggccactgctgccagacctgcccccaggagaggagcagcagcgagcggcagcccagcggcctgagctttgagtacccccgggaccctgagcacaggagctacagcgacagaggagagcccggggctgaggagcgggcccggggagatggccacacagactttgtggccctgctgaccggccccaggagccaggccgtggcccgggcccgggtgtccctgctgcggagcagcctgcgcttcagcatctcctacagaaggctggaccggcccacccgcatccgcttcagtgacagcaatggatctgtgctgtttgagcaccctgctgcccccacccaggacggcctggtgtgtggggtgtggagggctgtgccccggctgagcctgcggctgctgcgggcagagcagctgcacgtggccctggtgaccctgacccaccccagcggggaggtgtggggccccctcatccgccaccgggccctggccgctgagaccttcagcgccatcctgaccctggagggccccccccagcagggcgtgggcggcatcaccctgctgaccctgagtgacacagaggacagcctgcacttcctgctgctcttccggggcctgctggagcccaggtctgggggcctgacccaggtgcccctgcggctgcagatcctgcaccagggccagctgctgcgggagctgcaggccaacgtgtctgcccaggagcccggctttgctgaggtgctgcccaacctgactgtgcaggagatggactggctggtgctgggggagctgcagatggccctggagtgggccggccggcccggcctgcgcatcagcggccacatcgccgccaggaagagctgtgatgtgctgcagagcgtgctgtgtggggctgatgccctgatccctgtgcagacaggagctgctggcagcgccagcctgaccctgctgggcaatggcagcctcatctaccaggccgtgggcatctgccccggcctgggcgcccggggggcccacatgctgctgcagaatgaactcttcctgaatgtgggcaccaaggacttcccagatggagagctgcggggccacgtggccgccctgccctactgcggccacagcgcccggcatgacaccctgcctgtgcccctggccggggccctggtgctgccccctgtgaagagccaggccgccggccacgcctggctgagcctggacacccactgccacctgcactatgaggtgctgctggccggcctgggcggcagcgagcagggcaccgtgacagcccacctgctgggccccccaggcaccccaggcccccggcggctgctgaagggcttctacggcagcgaggcccagggcgtggtgaaggacctggagcctgagctgctgcggcacctggccaagggcatggccagcctgatgatcaccaccaagggcagccccagaggagagctgcggggccaggtgcacatcgccaaccagtgtgaggtgggcggcctgcggctggaggccgccggggctgagggcgtgcgggccctgggcgccccagacacagccagcgctgcccctcctgtggtgcccggcctgcctgccctggccccagccaagccaggcggccctggccggccccgggaccccaacacctgcttctttgagggccagcagaggccccacggggcccgctgggcccccaactatgaccccctgtgcagcctgtgcacctgccagaggagaactgtcatctgtgaccctgtggtgtgccccccacccagctgcccccaccctgtgcaggccccagaccagtgctgccctgtgtgcccagagaagcaggatgtgcgggacctgcccggcctgcccaggagccgggaccccggggagggctgctactttgatggagaccgctcctggagggctgctggcacccgctggcaccctgtggtgccccccttcggcctcatcaagtgtgctgtgtgcacctgcaagggcggcaccggggaggtgcactgtgagaaggtgcagtgcccccggctggcctgtgcccagcctgtgcgggtgaaccccacagactgctgcaagcagtgccctgtgggcagcggggcccacccccagctgggggaccccatgcaggctgatggcccccggggctgccgctttgctggccagtggttccctgagagccagagctggcaccccagcgtgcccccatttggagagatgagctgcatcacctgccgctgtggggccggcgtgccccactgtgaaagagatgactgcagcctgcccctgagctgtggcagcggcaaggagagccgctgctgcagccgctgcacagcccaccggcggcctgcccctgagaccaggacagatcctgagctggagaaggaggccgagggcagctag

SEQ ID NO: 147469 - DNA, 1494 bp, Artificial Sequence
  Description of Artificial Sequence: Synthetic coding sequence
atggactggctggtgctgggggagctgcagatggccctggagtgggccggccggcccggcctgcgcatcagcggccacatcgccgccaggaagagctgtgatgtgctgcagagcgtgctgtgtggggctgatgccctgatccctgtgcagacaggagctgctggcagcgccagcctgaccctgctgggcaatggcagcctcatctaccaggtgcaggtggtgggcaccagcagcgaggtggtggccatgaccctggagaccaagccccagaggcgggaccagaggacagtgctgtgccacatggccggcctgcagcccggcggccacacagctgtgggcatctgccccggcctgggcgcccggggggcccacatgctgctgcagaatgaactcttcctgaatgtgggcaccaaggacttcccagatggagagctgcggggccacgtggccgccctgccctactgcggccacagcgcccggcatgacaccctgcctgtgcccctggccggggccctggtgctgccccctgtgaagagccaggccgccggccacgcctggctgagcctggacacccactgccacctgcactatgaggtgctgctggccggcctgggcggcagcgagcagggcaccgtgacagcccacctgctgggccccccaggcaccccaggcccccggcggctgctgaagggcttctacggcagcgaggcccagggcgtggtgaaggacctggagcctgagctgctgcggcacctggccaagggcatggccagcctgatgatcaccaccaagggcagccccagaggagagctgcggggccagaggagaactgtcatctgtgaccctgtggtgtgccccccacccagctgcccccaccctgtgcaggccccagaccagtgctgccctgtgtgcccagagaagcaggatgtgcgggacctgcccggcctgcccaggagccgggaccccggggagggctgctactttgatggagaccgctcctggagggctgctggcacccgctggcaccctgtggtgccccccttcggcctcatcaagtgtgctgtgtgcacctgcaagggcggcaccggggaggtgcactgtgagaaggtgcagtgcccccggctggcctgtgcccagcctgtgcgggtgaaccccacagactgctgcaagcagtgccctgtgggcagcggggcccacccccagctgggggaccccatgcaggctgatggcccccggggctgccgctttgctggccagtggttccctgagagccagagctggcaccccagcgtgcccccatttggagagatgagctgcatcacctgccgctgtggggccggcgtgccccactgtgaaagagatgactgcagcctgcccctgagctgtggcagcggcaaggagagccgctgctgcagccgctgcacagcccaccggcggcctgcccctgagaccaggacagatcctgagctggagaaggaggccgagggcagctag

SEQ ID NO: 147470 - DNA, 3126 bp, Artificial Sequence
  Description of Artificial Sequence: Synthetic coding sequence
atggagaacatgttcctgcagagctccatgctgacctgcatcttcctgctgatcagcggcagctgtgagctgtgtgccgaggagaacttcagccgcagctacccctgtgatgagaagaagcagaatgacagcgtgattgctgagtgcagcaacagaaggctgcaggaggtgccccagacagtgggcaagtatgtgacagagctggacctgagtgacaacttcatcacccacatcaccaatgaaagcttccagggcctgcagaacctgaccaagatcaacctgaaccacaaccccaacgtgcagcaccagaatggaaatcctggcatccagagcaatggcctgaacatcacagatggagccttcctgaacctgaagaacctgcgggagctgctgctggaggacaaccagctgccccagatccccagcggcctgcctgagagcctgacagagctgagcctcatccagaacaacatctacaacatcaccaaggagggcatcagccgcctcatcaacctgaagaacctgtacctggcctggaactgctacttcaacaaggtgtgtgagaagaccaacattgaagatggagtgtttgagaccctgaccaacctggagctgctgagcctgtccttcaacagcctgagccacgtgccccccaagctgcccagcagcctgaggaagctgttcctgagcaacacccagatcaagtacatcagcgaggaggacttcaagggcctcatcaacctgaccctgctggacctgagcggcaactgcccccgctgcttcaatgcccccttcccctgtgtgccctgtgatggaggagccagcatcaacatcgacagatttgccttccagaacctgacccagctgcgctacctgaacctgagcagcaccagcctgaggaagatcaatgctgcctggttcaagaacatgccccacctgaaggtgctggacctggagttcaactacctggtgggggagatcgccagcggggccttcctgaccatgctgccccggctggagatcctggacctgtccttcaactacatcaagggcagctacccccagcacatcaacatcagcaggaacttcagcaagctgctgagcctgcgggccctgcacctgcggggctacgtgttccaggagctgcgggaggatgacttccagcccctgatgcagctgcccaacctgagcaccatcaacctgggcatcaacttcatcaagcagattgacttcaagctgttccagaacttcagcaacctggagatcatctacctgtctgaaaatcgcatcagccccctggtgaaggacacccggcagagctatgccaacagcagcagcttccagaggcacatcaggaagaggaggagcacagactttgaatttgacccccacagcaacttctaccacttcacccggcccctcatcaagccccagtgtgccgcctacggcaaggccctggacctgagcctgaacagcatcttcttcatcggccccaaccagtttgagaacctgcctgacatcgcctgcctgaacctgagcgccaacagcaatgcccaggtgctgagcggcacagagttcagcgccatcccccacgtgaagtacctggacctgaccaacaaccggctggactttgacaatgccagcgccctgacagagctgagtgacctggaggtgctggacctgagctacaacagccactacttcagaattgctggggtgacccaccacctggagttcatccagaacttcaccaacctgaaggtgctgaacctgagccacaacaacatctacaccctgacagacaagtacaacctggagagcaagagcctggtggagctggtgttcagcggcaaccggctggacatcctgtggaatgatgatgacaaccgctacatcagcatcttcaagggcctgaagaacctgacccggctggacctgagcctgaaccggctgaagcacatccccaatgaggccttcctgaacctgcctgccagcctgacagagctgcacatcaatgacaacatgctgaagttcttcaactggaccctgctgcagcagttcccccggctggagctgctggacctgcggggcaacaagctgctcttcctgacagacagcctgagtgacttcaccagcagcctgcggaccctgctgctgagccacaaccgcatcagccacctgcccagcggcttcctgtctgaggtgagcagcctgaagcacctggacctgagcagcaacctgctgaagaccatcaacaagagcgccctggagaccaagaccaccaccaagctgtccatgctggagctgcacggcaacccctttgaatgtacctgtgacatcggggacttccgccgctggatggatgagcacctgaatgtgaagatcccccggctggtggatgtgatctgtgccagccctggggaccagaggggcaagagcatcgtgtccctggagctgaccacctgtgtgtctgatgtgacagctgtgatcctcttcttcttcaccttcttcatcaccaccatggtgatgctggccgccctggcccaccacctgttctactgggatgtgtggttcatctacaacgtgtgcctggccaaggtgaagggctaccgcagcctgagcaccagccagaccttctatgatgcctacatctcctatgacaccaaggatgcctctgtgacagactgggtgatcaatgagctgcgctaccacctggaggagagccgggacaagaatgtgctgctgtgcctggaggagcgggactgggaccccggcctggccatcatcgacaacctgatgcagagcatcaaccagagcaagaagacagtgtttgtgctgaccaagaagtatgccaagtcctggaacttcaagacagccttctacctggccctgcagaggctgatggatgagaacatggatgtgatcatcttcatcctgctggagcctgtgctgcagcacagccagtacctgcggctgcggcagaggatctgcaagagcagcatcctgcagtggccagacaaccccaaggccgagggcctcttctggcagaccctgagaaatgtggtgctgacagaaaatgacagccgctacaacaacatgtatgtggacagcatcaagcagtactag

SEQ ID NO: 147471 - DNA, 1377 bp, Artificial Sequence
  Description of Artificial Sequence: Synthetic coding sequence
atgaggaagaagtggaagatgggcggcatgaagtacatcttcagcctgctcttcttcctgctgctggagggcggcaagacagagcaggtgaagcacagcgagacctactgcatgttccaggacaagaagtacagagtgggggagcgctggcacccctacctggagccctacggcctggtgtactgtgtgaactgcatctgcagtgaaaatggaaatgtgctgtgcagccgggtgcgctgccccaacgtgcactgcctgagccctgtgcacatcccccacctgtgctgcccccgctgcccagaggacagcctgccccctgtgaacaacaaggtgaccagcaagagctgtgagtacaacggcaccacctaccagcacggggagctgtttgtggccgagggcctcttccagaaccggcagcccaaccagtgcacccagtgcagctgcagcgagggcaatgtgtactgcggcctgaagacctgccccaagctgacctgtgccttccctgtgtctgtgcctgacagctgctgccgggtgtgcagaggagatggagagctgtcctgggagcacagtgatggagacatcttccggcagcctgccaaccgggaggcccggcacagctaccacaggagccactatgaccccccacccagccggcaggccggcggcctgagccgcttccctggggcccggagccacagaggagccctgatggacagccagcaggccagcggcaccatcgtgcagatcgtcatcaacaacaagcacaagcacggccaggtgtgtgtgtccaatggcaagacctacagccacggggagagctggcaccccaacctgcgggcctttggaattgtggagtgtgtgctgtgcacctgcaatgtgaccaagcaggagtgcaagaagatccactgccccaaccgctacccctgcaagtacccccagaagattgatggcaagtgctgcaaggtgtgccctgggaagaaggccaaggaggagctgcccggccagagctttgacaacaagggctacttctgtggggaggagaccatgcctgtgtatgagagcgtcttcatggaggatggagagaccaccaggaagatcgccctggagacagagaggcctccccaggtggaggtgcacgtgtggaccatcaggaagggcatcctgcagcacttccacatcgagaagatcagcaagaggatgtttgaggagctgccccacttcaagctggtgaccaggaccaccctgagccagtggaagatcttcacagaaggagaggcccagatcagccagatgtgcagcagccgggtgtgcaggacagagctggaggacctggtgaaggtgctgtacctggagaggtctgagaagggccactgctag

SEQ ID NO: 147472 - DNA, 1353 bp, Artificial Sequence
  Description of Artificial Sequence: Synthetic coding sequence
atgggcggcatgaagtacatcttcagcctgctcttcttcctgctgctggagggcggcaagacagagcaggtgaagcacagcgagacctactgcatgttccaggacaagaagtacagagtgggggagcgctggcacccctacctggagccctacggcctggtgtactgtgtgaactgcatctgcagtgaaaatggaaatgtgctgtgcagccgggtgcgctgccccaacgtgcactgcctgagccctgtgcacatcccccacctgtgctgcccccgctgcccagacagcctgccccctgtgaacaacaaggtgaccagcaagagctgtgagtacaacggcaccacctaccagcacggggagctgtttgtggccgagggcctcttccagaaccggcagcccaaccagtgcacccagtgcagctgcagcgagggcaatgtgtactgcggcctgaagacctgccccaagctgacctgtgccttccctgtgtctgtgcctgacagctgctgccgggtgtgcagaggagatggagagctgtcctgggagcacagtgatggagacatcttccggcagcctgccaaccgggaggcccggcacagctaccacaggagccactatgaccccccacccagccggcaggccggcggcctgagccgcttccctggggcccggagccacagaggagccctgatggacagccagcaggccagcggcaccatcgtgcagatcgtcatcaacaacaagcacaagcacggccaggtgtgtgtgtccaatggcaagacctacagccatggagagagctggcaccccaacctgcgggccttcggcatcgtggagtgtgtgctgtgcacctgcaatgtgaccaagcaggagtgcaagaagatccactgccccaaccgctacccctgcaagtacccccagaagattgatggcaagtgctgcaaggtgtgccctgggaagaaggccaaggagctgcccggccagagctttgacaacaagggctacttctgtggggaggagaccatgcctgtgtatgagagcgtcttcatggaggatggagagaccaccaggaagatcgccctggagacagagaggcctccccaggtggaggtgcacgtgtggaccatcaggaagggcatcctgcagcacttccacatcgagaagatcagcaagaggatgtttgaggagctgccccacttcaagctggtgaccaggaccaccctgagccagtggaagatcttcacagaaggagaggcccagatcagccagatgtgcagcagccgggtgtgcaggacagagctggaggacctggtgaaggtgctgtacctggagaggtctgagaagggccactgctag

SEQ ID NO: 147473 - DNA, 1371 bp, Artificial Sequence
  Description of Artificial Sequence: Synthetic coding sequence
atgaggaagaagtggaagatgggcggcatgaagtacatcttcagcctgctcttcttcctgctgctggagggcggcaagacagagcaggtgaagcacagcgagacctactgcatgttccaggacaagaagtacagagtgggggagcgctggcacccctacctggagccctacggcctggtgtactgtgtgaactgcatctgcagtgaaaatggaaatgtgctgtgcagccgggtgcgctgccccaacgtgcactgcctgagccctgtgcacatcccccacctgtgctgcccccgctgcccagacagcctgccccctgtgaacaacaaggtgaccagcaagagctgtgagtacaacggcaccacctaccagcacggggagctgtttgtggccgagggcctcttccagaaccggcagcccaaccagtgcacccagtgcagctgcagcgagggcaatgtgtactgcggcctgaagacctgccccaagctgacctgtgccttccctgtgtctgtgcctgacagctgctgccgggtgtgcagaggagatggagagctgtcctgggagcacagtgatggagacatcttccggcagcctgccaaccgggaggcccggcacagctaccacaggagccactatgaccccccacccagccggcaggccggcggcctgagccgcttccctggggcccggagccacagaggagccctgatggacagccagcaggccagcggcaccatcgtgcagatcgtcatcaacaacaagcacaagcacggccaggtgtgtgtgtccaatggcaagacctacagccatggagagagctggcaccccaacctgcgggccttcggcatcgtggagtgtgtgctgtgcacctgcaatgtgaccaagcaggagtgcaagaagatccactgccccaaccgctacccctgcaagtacccccagaagattgatggcaagtgctgcaaggtgtgccctgggaagaaggccaaggagctgcccggccagagctttgacaacaagggctacttctgtggggaggagaccatgcctgtgtatgagagcgtcttcatggaggatggagagaccaccaggaagatcgccctggagacagagaggcctccccaggtggaggtgcacgtgtggaccatcaggaagggcatcctgcagcacttccacatcgagaagatcagcaagaggatgtttgaggagctgccccacttcaagctggtgaccaggaccaccctgagccagtggaagatcttcacagaaggagaggcccagatcagccagatgtgcagcagccgggtgtgcaggacagagctggaggacctggtgaaggtgctgtacctggagaggtctgagaagggccactgctag

SEQ ID NO: 147474 - DNA, 1134 bp, Artificial Sequence
  Description of Artificial Sequence: Synthetic coding sequence
atgaggaagaagtggaagatgggcggcatgaagtacatcttcagcctgctcttcttcctgctgctggagggcggcaagacagagcaggtgaagcacagcgagacctactgcatgttccaggacaagaagtacagagtgggggagcgctggcacccctacctggagccctacggcctggtgtactgtgtgaactgcatctgcagtgaaaatggaaatgtgctgtgcagccgggtgcgctgccccaacgtgcactgcctgagccctgtgcacatcccccacctgtgctgcccccgctgccctggagatggagagctgtcctgggagcacagtgatggagacatcttccggcagcctgccaaccgggaggcccggcacagctaccacaggagccactatgaccccccacccagccggcaggccggcggcctgagccgcttccctggggcccggagccacagaggagccctgatggacagccagcaggccagcggcaccatcgtgcagatcgtcatcaacaacaagcacaagcacggccaggtgtgtgtgtccaatggcaagacctacagccacggggagagctggcaccccaacctgcgggcctttggaattgtggagtgtgtgctgtgcacctgcaatgtgaccaagcaggagtgcaagaagatccactgccccaaccgctacccctgcaagtacccccagaagattgatggcaagtgctgcaaggtgtgccctgggaagaaggccaaggagctgcccggccagagctttgacaacaagggctacttctgtggggaggagaccatgcctgtgtatgaatctgtgttcatggaggatggagagaccaccaggaagatcgccctggagacagagcggcccccccaggtggaggtgcacgtgtggaccatcaggaagggcatcctgcagcacttccacatcgagaagatcagcaagaggatgtttgaggagctgccccacttcaagctggtgaccaggaccaccctgagccagtggaagatcttcacagaaggagaggcccagatcagccagatgtgcagcagccgggtgtgcaggacagagctggaggacctggtgaaggtgctgtacctggagaggtctgagaagggccactgctag

SEQ ID NO: 147475 - DNA, 1374 bp, Artificial Sequence
  Description of Artificial Sequence: Synthetic coding sequence
atgaggaagaagtggaagatgggcggcatgaagtacatcttcagcctgctcttcttcctgctgctggagggcggcaagacagagcaggtgaagcacagcgagacctactgcatgttccaggacaagaagtacagagtgggggagcgctggcacccctacctggagccctacggcctggtgtactgtgtgaactgcatctgcagtgaaaatggaaatgtgctgtgcagccgggtgcgctgccccaacgtgcactgcctgagccctgtgcacatcccccacctgtgctgcccccgctgcccagacagcctgccccctgtgaacaacaaggtgaccagcaagagctgtgagtacaacggcaccacctaccagcacggggagctgtttgtggccgagggcctcttccagaaccggcagcccaaccagtgcacccagtgcagctgcagcgagggcaatgtgtactgcggcctgaagacctgccccaagctgacctgtgccttccctgtgtctgtgcctgacagctgctgccgggtgtgcagaggagatggagagctgtcctgggagcacagtgatggagacatcttccggcagcctgccaaccgggaggcccggcacagctaccacaggagccactatgaccccccacccagccggcaggccggcggcctgagccgcttccctggggcccggagccacagaggagccctgatggacagccagcaggccagcggcaccatcgtgcagatcgtcatcaacaacaagcacaagcacggccaggtgtgtgtgtccaatggcaagacctacagccatggagagagctggcaccccaacctgcgggccttcggcatcgtggagtgtgtgctgtgcacctgcaatgtgaccaagcaggagtgcaagaagatccactgccccaaccgctacccctgcaagtacccccagaagattgatggcaagtgctgcaaggtgtgccctgggaagaaggccaaggaggagctgcccggccagagctttgacaacaagggctacttctgtggggaggagaccatgcctgtgtatgaatctgtgttcatggaggatggagagaccaccaggaagatcgccctggagacagagcggcccccccaggtggaggtgcacgtgtggaccatcaggaagggcatcctgcagcacttccacatcgagaagatcagcaagaggatgtttgaggagctgccccacttcaagctggtgaccaggaccaccctgagccagtggaagatcttcacagaaggagaggcccagatcagccagatgtgcagcagccgggtgtgcaggacagagctggaggacctggtgaaggtgctgtacctggagaggtctgagaagggccactgctag

SEQ ID NO: 147476 - DNA, 1137 bp, Artificial Sequence
  Description of Artificial Sequence: Synthetic coding sequence
atgaggaagaagtggaagatgggcggcatgaagtacatcttcagcctgctcttcttcctgctgctggagggcggcaagacagagcaggtgaagcacagcgagacctactgcatgttccaggacaagaagtacagagtgggggagcgctggcacccctacctggagccctacggcctggtgtactgtgtgaactgcatctgcagtgaaaatggaaatgtgctgtgcagccgggtgcgctgccccaacgtgcactgcctgagccctgtgcacatcccccacctgtgctgcccccgctgccctggagatggagagctgtcctgggagcacagtgatggagacatcttccggcagcctgccaaccgggaggcccggcacagctaccacaggagccactatgaccccccacccagccggcaggccggcggcctgagccgcttccctggggcccggagccacagaggagccctgatggacagccagcaggccagcggcaccatcgtgcagatcgtcatcaacaacaagcacaagcacggccaggtgtgtgtgtccaatggcaagacctacagccacggggagagctggcaccccaacctgcgggcctttggaattgtggagtgtgtgctgtgcacctgcaatgtgaccaagcaggagtgcaagaagatccactgccccaaccgctacccctgcaagtacccccagaagattgatggcaagtgctgcaaggtgtgccctgggaagaaggccaaggaggagctgcccggccagagctttgacaacaagggctacttctgtggggaggagaccatgcctgtgtatgagagcgtcttcatggaggatggagagaccaccaggaagatcgccctggagacagagaggcctccccaggtggaggtgcacgtgtggaccatcaggaagggcatcctgcagcacttccacatcgagaagatcagcaagaggatgtttgaggagctgccccacttcaagctggtgaccaggaccaccctgagccagtggaagatcttcacagaaggagaggcccagatcagccagatgtgcagcagccgggtgtgcaggacagagctggaggacctggtgaaggtgctgtacctggagaggtctgagaagggccactgctag

SEQ ID NO: 147477 - DNA, 1356 bp, Artificial Sequence
  Description of Artificial Sequence: Synthetic coding sequence
atggtgcctgaggtgcgggtgctgagcagcctgctgggcctggccctgctgtggttccccctggacagccacgcccgggcccggccagacatgttctgcctcttccacggcaagcgctacagccctggagagagctggcacccctacctggagccccagggcctgatgtactgcctgcgctgcacctgcagcgagggcgcccacgtgtcctgctaccgcctgcactgcccccctgtgcactgcccccagcctgtgacagagccccagcagtgctgccccaagtgtgtggagccccacacccccagcggcctgcgggccccacccaagagctgccagcacaacggcaccatgtaccagcacggggagatcttcagcgcccacgagctgttccccagccggctgcccaaccagtgtgtgctgtgcagctgcacagagggccagatctactgcggcctgaccacctgcccagagcccggctgcccagcccccctgcccctgcctgacagctgctgccaggcctgcaaggatgaggccagcgagcagagtgatgaagaagattctgtgcagagcctgcacggcgtgcgccacccccaggacccctgcagcagtgatgctggcaggaagaggggccctggcaccccagcccccaccggcctgagcgcccccctgtccttcatccccaggcacttccggcccaagggagctggcagcaccaccgtgaagatcgtgctgaaggagaagcacaagaaggcctgtgtgcacggcggcaagacctacagccatggagaggtgtggcacccagccttccgggccttcggccccctgccctgcatcctgtgcacctgtgaagatggccggcaggactgccagagggtgacctgccccacagagtacccctgccgccaccctgagaaggtggccggcaagtgctgcaagatctgcccagaggacaaggctgaccccggccacagcgagatcagcagcacccgctgccccaaggcccctggccgggtgctggtgcacacctctgtgagccccagcccagacaacctgcggagatttgccctggagcacgaggccagtgacctggtggagatctacctgtggaagctggtgaaggatgaggagacagaggcccagagaggagaggtgcccggcccccggccccacagccagaacctgcccctggacagcgaccaggagagccaggaggcccggctgcctgagcggggcacagccctgcccacagcccgctggccaccccggcgcagcctggagcggctgcccagcccagaccctggagctgagggccacggccagagccggcagagcgaccaggacatcaccaagacctag

SEQ ID NO: 147478 - DNA, 846 bp, Artificial Sequence
  Description of Artificial Sequence: Synthetic coding sequence
atgtaccagcacggggagatcttcagcgcccacgagctgttccccagccggctgcccaaccagtgtgtgctgtgcagctgcacagagggccagatctactgcggcctgaccacctgcccagagcccggctgcccagcccccctgcccctgcctgacagctgctgccaggcctgcaaggccggcagctcctggggcctgctgtgcagcgtgtctgacttccaccccagctgccacctgcagaggcacccccaggacccctgcagcagtgatgctggcaggaagaggggccctggcaccccagcccccaccggcctgagcgcccccctgtccttcatccccaggcacttccggcccaagggagctggcagcaccaccgtgaagatcgtgctgaaggagaagcacaagaaggcctgtgtgcacggcggcaagacctacagccatggagaggtgtggcacccagccttccgggccttcggccccctgccctgcatcctgtgcacctgtgaagatggccggcaggactgccagagggtgacctgccccacagagtacccctgccgccaccctgagaaggtggccggcaagtgctgcaagatctgcccagaggacaaggctgaccccggccacagcgagatcagcagcacccgctgccccaaggcccctggccgggtgctggtgcacacctctgtgagccccagcccagacaacctgcggagatttgccctggagcacgaggccagtgacctggtggagatctacctgtggaagctggtgaagggcgtcttcctggcccagaccctggagctgaaggtgacagccagcccagacaaggtgaccaagacctag

SEQ ID NO: 147479 - DNA, 1290 bp, Artificial Sequence
  Description of Artificial Sequence: Synthetic coding sequence
atggtgcctgaggtgcgggtgctgagcagcctgctgggcctggccctgctgtggttccccctggacagccacgcccgggcccggccagacatgttctgcctcttccacggcaagcgctacagccctggagagagctggcacccctacctggagccccagggcctgatgtactgcctgcgctgcacctgcagcgagggcgcccacgtgtcctgctaccgcctgcactgcccccctgtgcactgcccccagcctgtgacagagccccagcagtgctgccccaagtgtgtggagccccacacccccagcggcctgcgggccccacccaagagctgccagcacaacggcaccatgtaccagcacggggagatcttcagcgcccacgagctgttccccagccggctgcccaaccagtgtgtgctgtgcagctgcacagagggccagatctactgcggcctgaccacctgcccagagcccggctgcccagcccccctgcccctgcctgacagctgctgccaggcctgcaaggatgaggccagcgagcagagtgatgaagaagattctgtgcagagcctgcacggcgtgcgccacccccaggacccctgcagcagtgatgctggcaggaagaggggccctggcaccccagcccccaccggcctgagcgcccccctgtccttcatccccaggcacttccggcccaagggagctggcagcaccaccgtgaagatcgtgctgaaggagaagcacaagaaggcctgtgtgcacggcggcaagacctacagccatggagaggtgtggcacccagccttccgggccttcggccccctgccctgcatcctgtgcacctgtgaagatggccggcaggactgccagagggtgacctgccccacagagtacccctgccgccaccctgagaaggtggccggcaagtgctgcaagatctgcccagaggacaaggctgaccccggccacagcgagatcagcagcacccgctgccccaaggcccctggccgggtgctggtgcacacctctgtgagccccagcccagacaacctgcggagatttgccctggagcacgaggccagtgacctggtggagatctacctgtggaagctggtgaagggcatcttccacctgacccagatcaagaaggtgaggaagcaggacttccagaaggaggcccagcacttccggctgctggccggcccccatgagggccactggaatgtgttcctggcccagaccctggagctgaaggtgacagccagcccagacaaggtgaccaagacctag

SEQ ID NO: 147480 - DNA, 840 bp, Artificial Sequence
  Description of Artificial Sequence: Synthetic coding sequence
atgtaccagcacggggagatcttcagcgcccacgagctgttccccagccggctgcccaaccagtgtgtgctgtgcagctgcacagagggccagatctactgcggcctgaccacctgcccagagcccggctgcccagcccccctgcccctgcctgacagctgctgccaggcctgcaaggatgaggccagcgagcagagtgatgaagaagattctgtgcagagcctgcacggcgtgcgccacccccaggacccctgcagcagtgatgctggcaggaagaggggccctggcaccccagcccccaccggcctgagcgcccccctgtccttcatccccaggcacttccggcccaagggagctggcagcaccaccgtgaagatcgtgctgaaggagaagcacaagaaggcctgtgtgcacggcggcaagacctacagccatggagaggtgtggcacccagccttccgggccttcggccccctgccctgcatcctgtgcacctgtgaagatggccggcaggactgccagagggtgacctgccccacagagtacccctgccgccaccctgagaaggtggccggcaagtgctgcaagatctgcccagaggacaaggctgaccccggccacagcgagatcagcagcacccgctgccccaaggcccctggccgggtgctggtgcacacctctgtgagccccagcccagacaacctgcggagatttgccctggagcacgaggccagtgacctggtggagatctacctgtggaagctggtgaaggatgtgttcctggcccagaccctggagctgaaggtgacagccagcccagacaaggtgaccaagacctag

SEQ ID NO: 147481 - DNA, 498 bp, Artificial Sequence
  Description of Artificial Sequence: Synthetic coding sequence
atggagatgttccagggcctgctgctgctgctgctgctgtccatgggcggcacctgggccagcaaggagcccctgcggccccgctgccggcccatcaatgccaccctggccgtggagaaggagggctgccctgtgtgcatcaccgtgaacaccaccatctgtgccggctactgccccaccatgaccagggtgctgcagggcgtgctgcctgccctgccccaggtggtgtgcaactacagagatgtgcgctttgagagcatccggctgcccggctgcccccggggcgtgaaccctgtggtgtcctatgctgtggccctgagctgccagtgtgccctgtgccgccgcagcaccacagactgtggcggccccaaggaccaccccctgacctgtgatgacccccgcttccaggacagcagcagcagcaaggcccccccacccagcctgcccagccccagccggctgcccggccccagcgacacccccatcctgccccagtag

SEQ ID NO: 147482 - DNA, 507 bp, Artificial Sequence
  Description of Artificial Sequence: Synthetic coding sequence
gcccccaggatggagatgttccagggcctgctgctgctgctgctgctgtccatgggcggcacctgggccagcaaggagcccctgcggccccgctgccggcccatcaatgccaccctggccgtggagaaggagggctgccctgtgtgcatcaccgtgaacaccaccatctgtgccggctactgccccaccatgaccagggtgctgcagggcgtgctgcctgccctgccccaggtggtgtgcaactacagagatgtgcgctttgagagcatccggctgcccggctgcccccggggcgtgaaccctgtggtgtcctatgctgtggccctgagctgccagtgtgccctgtgcagaagaagcaccacagactgtggcggccccaaggaccaccccctgacctgtgatgacccccgcttccaggacagcagcagcagcaaggcccccccacccagcctgcccagccccagccggctgcccggccccagcgacacccccatcctgccccagtag

SEQ ID NO: 147483 - DNA, 654 bp, Artificial Sequence
  Description of Artificial Sequence: Synthetic coding sequence
atggcccctggcagcaggaccagcctgctgctggcctttgccctgctgtgcctgccctggctgcaggaggccggggctgtgcagacagtgcccctgagccggctgtttgaccacgccatgctgcaggcccaccgggcccaccagctggccatcgacacctaccaggagtttgaggagacctacatccccaaggaccagaagtacagcttcctgcatgacagccagaccagcttctgcttcagtgacagcatccccacccccagcaacatggaggagacccagcagaagagcaacctggagctgctgcgcatcagcctgctgctgattgaatcctggctggagcctgtgcgcttcctgcgctccatgtttgccaacaacctggtgtatgacaccagtgacagtgatgactaccacctgctgaaggacctggaggagggcatccagaccctgatgggccgcctggaggatggcagcagaagaacaggccagatcctgaagcagacctacagcaagtttgacaccaacagccacaaccatgatgccctgctgaagaactacggcctgctgtactgcttcaggaaggacatggacaaggtggagaccttcctgaggatggtgcagtgccgctctgtggagggcagctgtggcttctag

SEQ ID NO: 147484 - DNA, 771 bp, Artificial Sequence
  Description of Artificial Sequence: Synthetic coding sequence
atggcccctggcagcaggaccagcctgctgctggcctttgccctgctgtgcctgccctggctgcaggaggccggggctgtgcagacagtgcccctgagccggctgtttgaccacgccatgctgcaggcccaccgggcccaccagctggccatcgacacctaccaggagtttgaggagacctacatccccaaggaccagaagtacagcttcctgcatgacagccagaccagcttctgcttcagtgacagcatccccacccccagcaacatggaggagacccagcagaagagcaacctggagctgctgcgcatcagcctgctgctgattgaatcctggctggagcctgtgcgcttcctgcgctccatgtttgccaacaacctggtgtatgacaccagtgacagtgatgactaccacctgctgaaggacctggaggagggcatccagaccctgatgggcgtgcgggtggcccctggggtgaccaaccctggcacccccctggccagccgggccggcggggagaagtactgctgccccctcttcagcagcaaggccctgacccaggagaacagcccctacagcagcttccggctggtgaaccccccaggcctgagcctgcaccctgagggggagggcggcaagtggatcaatgaaagaggccgggagcagtgccccagcgcctggcccctgctgctcttcctgcactttgctgaggccggccggcggcagcccccagactgggccgacccccaggccgacctgcagcaggtgtag

SEQ ID NO: 147485 - DNA, 369 bp, Artificial Sequence
  Description of Artificial Sequence: Synthetic coding sequence
atggcccctggcagcaggaccagcctgctgctggcctttgccctgctgtgcctgccctggctgcaggaggccggggctgtgcagacagtgcccctgagccggctgtttgaccacgccatgctgcaggcccaccgggcccaccagctggccatcgacacctaccaggagttccggctggaggatggcagcagaagaacaggccagatcctgaagcagacctacagcaagtttgacaccaacagccacaaccatgatgccctgctgaagaactacggcctgctgtactgcttcaggaaggacatggacaaggtggagaccttcctgaggatggtgcagtgccgctctgtggagggcagctgtggcttctag

SEQ ID NO: 147486 - DNA, 552 bp, Artificial Sequence
  Description of Artificial Sequence: Synthetic coding sequence
atggcccctggcagcaggaccagcctgctgctggcctttgccctgctgtgcctgccctggctgcaggaggccgagacctacatccccaaggaccagaagtacagcttcctgcatgacagccagaccagcttctgcttcagtgacagcatccccacccccagcaacatggaggagacccagcagaagagcaacctggagctgctgcgcatcagcctgctgctgattgaatcctggctggagcctgtgcgcttcctgcgctccatgtttgccaacaacctggtgtatgacaccagtgacagtgatgactaccacctgctgaaggacctggaggagggcatccagaccctgatgggccgcctggaggatggcagcagaagaacaggccagatcctgaagcagacctacagcaagtttgacaccaacagccacaaccatgatgccctgctgaagaactacggcctgctgtactgcttcaggaaggacatggacaaggtggagaccttcctgaggatggtgcagtgccgctctgtggagggcagctgtggcttctag

SEQ ID NO: 147487 - DNA, 504 bp, Artificial Sequence
  Description of Artificial Sequence: Synthetic coding sequence
atggctgctggcagcaggaccagcctgctgctggcctttgccctgctgtgcctgccctggctgcaggaggccggggctgtgcagacagtgcccctgagccggctgtttgaccacgccatgctgcaggcccaccgggcccaccagctggccatcgacacctaccaggagtttgaggagacctacatccccaaggaccagaagtacagcttcctgcatgacagccagaccagcttctgcttcagtgacagcatccccacccccagcaacatggaggagacccagcagaagagcaacctggagctgctgcgcatcagcctgctgctgattgaatcctggctggagcctgtgcgcttcctgcgctccatgtttgccaacaacctggtgtatgacaccagtgacagtgatgactaccacctgctgaaggacctggaggagggcatccagaccctgatgggcgtgcgggtggcccctggggtggccaaccctggcacccccctggcctag

SEQ ID NO: 147488 - DNA, 369 bp, Artificial Sequence
  Description of Artificial Sequence: Synthetic coding sequence
atggctgctggcagcaggaccagcctgctgctggcctttgccctgctgtgcctgccctggctgcaggaggccggggctgtgcagacagtgcccctgagccggctgtttgaccacgccatgctgcaggcccaccgggcccaccagctggccatcgacacctaccaggagttccggctggaggatggcagcagaagaacaggccagatcctgaagcagacctacagcaagtttgacaccaacagccacaaccatgatgccctgctgaagaactacggcctgctgtactgcttcaggaaggacatggacaaggtggagaccttcctgaggatggtgcagtgccgctctgtggagggcagctgtggcttctag

SEQ ID NO: 147489 - DNA, 654 bp, Artificial Sequence
  Description of Artificial Sequence: Synthetic coding sequence
atggctgctggcagcaggaccagcctgctgctggcctttgccctgctgtgcctgccctggctgcaggaggccggggctgtgcagacagtgcccctgagccggctgtttgaccacgccatgctgcaggcccaccgggcccaccagctggccatcgacacctaccaggagtttgaggagacctacatccccaaggaccagaagtacagcttcctgcatgacagccagaccagcttctgcttcagtgacagcatccccacccccagcaacatggaggagacccagcagaagagcaacctggagctgctgcgcatcagcctgctgctgattgaatcctggctggagcctgtgcgcttcctgcgctccatgtttgccaacaacctggtgtatgacaccagtgacagtgatgactaccacctgctgaaggacctggaggagggcatccagaccctgatgggccgcctggaggatggcagcagaagaacaggccagatcctgaagcagacctacagcaagtttgacaccaacagccacaaccatgatgccctgctgaagaactacggcctgctgtactgcttcaggaaggacatggacaaggtggagaccttcctgaggatggtgcagtgccgctctgtggagggcagctgtggcttctag

SEQ ID NO: 147490 - DNA, 483 bp, Artificial Sequence
  Description of Artificial Sequence: Synthetic coding sequence
atggctgctggcagcaggaccagcctgctgctggcctttgccctgctgtgcctgccctggctgcaggaggccgacagcatccccacccccagcaacatggaggagacccagcagaagagcaacctggagctgctgcgcatcagcctgctgctgattgagagctggctggagcctgtgcgcttcctgcgctccatgtttgccaacaacctggtgtatgacaccagtgacagtgatgactaccacctgctgaaggacctggaggagggcatccagaccctgatgggccgcctggaggatggcagcagaagaacaggccagatcctgaagcagacctacagcaagtttgacaccaacagccacaaccatgatgccctgctgaagaactacggcctgctgtactgcttcaggaaggacatggacaaggtggagaccttcctgaggatggtgcagtgccgctctgtggagggcagctgtggcttctag

SEQ ID NO: 147491 - DNA, 498 bp, Artificial Sequence
  Description of Artificial Sequence: Synthetic coding sequence
tgaggaagcaggaccagcctgctgctggcctttgccctgctgtgcctgccctggctgcaggaggccggggctgtgcagacagtgcccctgagccggctgtttgaccacgccatgctgcaggcccaccgggcccaccagctggccatcgacacctaccaggagtttgaggagacctacatccccaaggaccagaagtacagcttcctgcatgacagccagaccagcttctgcttcagtgacagcatccccacccccagcaacatggaggagacccagcagaagagcaacctggagctgctgcgcatcagcctgctgctgattgaatcctggctggagcctgtgcgcttcctgcgctccatgtttgccaacaacctggtgtatgacaccagtgacagtgatgactaccacctgctgaaggacctggaggagggcatccagaccctgatgggcgtgcgggtggcccctggggtggccaaccctggcacccccctggcctag

SEQ ID NO: 147492 - DNA, 669 bp, Artificial Sequence
  Description of Artificial Sequence: Synthetic coding sequence
atggctgctggcagcaggaccagcctgctgctggcctttgccctgctgtgcctgccctggctgcaggaggccggggctgtgcagacagtgcccctgagccgcctcttcaaggaggccatgctgcaggcccaccgggcccaccagctggccatcgacacctaccaggagttcatcagctcctggggcatggaggcctacatcaccaaggagcagaagtacagcttcctgcatgacagccagaccagcttctgcttcagtgacagcatccccaccagcagcaacatggaggagacccagcagaagagcaacctggagctgctgcacatcagcctgctgctgattgagagccggctggagcctgtgcgcttcctgcggagcaccttcaccaacaacctggtgtatgacaccagtgacagtgatgactaccacctgctgaaggacctggaggagggcatccagatgctgatgggccgcctggaggatggcagccacctgaccggccagaccctgaagcagacctacagcaagtttgacaccaacagccacaaccatgatgccctgctgaagaactacggcctgctgcactgcttcaggaaggacatggacaaggtggagaccttcctgaggatggtgcagtgccgctctgtggagggcagctgtggcttctag

SEQ ID NO: 147493 - DNA, 387 bp, Artificial Sequence
  Description of Artificial Sequence: Synthetic coding sequence
atggaggagacccagcagaagagcaacctggagctgctgcacatcagcctgctgctgattgagagccggctggagcctgtgcgcttcctgcggagcaccttcaccaacaacctggtgtatgacaccagtgacagtgatgactaccacctgctgaaggacctggaggagggcatccagatgctgatgggccgcctggaggatggcagccacctgaccggccagaccctgaagcagacctacagcaagtttgacaccaacagccacaaccatgatgccctgctgaagaactacggcctgctgcactgcttcaggaaggacatggacaaggtggagaccttcctgaggatggtgcagtgccgctctgtggagggcagctgtggcttctag

SEQ ID NO: 147494 - DNA, 522 bp, Artificial Sequence
  Description of Artificial Sequence: Synthetic coding sequence
atggccaccggcagcaggaccagcctgctgctggcctttgccctgctgtgcctgccctggctgcaggaggccggggctgtgcagacagtgcccctgagccgcctcttcaaggaggccatgctgcaggcccaccgggcccaccagctggccatcgacacctaccaggagttcatcagctcctggggcatgggcgccggccagggctggcaggagggcgtgaccttcccccactggggcagcaatggaagaaggctgcggagcagcggcctcttcagcgaggccaagatgcaggctgatgagcaccggctgagccaggtgccccggcgggtgacagtgggcgccggcctgcagcacaggaagcagtggagcttcctggtgggcggccccagccccaggaagaagcccatcagccagaggaacagaagcatccacagctgcatgacccccaggcctccttctgccagccagaccctcttccgccacccccccacctggaggaagaggagcaggaaccccacctag

SEQ ID NO: 147495 - DNA, 420 bp, Artificial Sequence
  Description of Artificial Sequence: Synthetic coding sequence
atggctgctgacagcatccccaccagcagcaacatggaggagacccagcagaagagcaacctggagctgctgcacatcagcctgctgctgattgagagccggctggagcctgtgcgcttcctgcggagcaccttcaccaacaacctggtgtatgacaccagtgacagtgatgactaccacctgctgaaggacctggaggagggcatccagatgctgatgggccgcctggaggatggcagccacctgaccggccagaccctgaagcagacctacagcaagtttgacaccaacagccacaaccatgatgccctgctgaagaactacggcctgctgcactgcttcaggaaggacatggacaaggtggagaccttcctgaggatggtgcagtgccgctctgtggagggcagctgtggcttctag

SEQ ID NO: 147496 - DNA, 1962 bp, Artificial Sequence
  Description of Artificial Sequence: Synthetic coding sequence
atggctgacaccctgcccagcgagtttgatgtgattgtcatcggcaccggcctgcctgagagcatcatcgctgctgcctgcagccgcagcggccggcgggtgctgcacgtggacagccgcagctactatggaggcaactgggccagcttctccttcagcggcctgctgtcctggctgaaggagtaccaggagaacagcgacatcgtgtctgacagccctgtgtggcaggaccagatcctggagaatgaggaggccatcgccctgagcaggaaggacaagaccatccagcacgtggaggtgttctgctacgccagccaggacctgcatgaagatgtggaggaggccggggccctgcagaagaaccacgccctggtgaccagcgccaacagcacagaagctgctgacagcgccttcctgcccacagaagatgagagcctgagcaccatgagctgtgagatgctgacagagcagacccccagcagtgaccctgaaaatgccctggaggtgaatggagctgaggtgactggagagaaggagaaccactgtgatgacaagacctgtgtgcccagcaccagcgctgaggacatgtctgaaaatgtgcccatcgccgaggacaccacagagcagcccaagaagaaccgcatcacctacagccagatcatcaaggagggccgccgcttcaacatcgacctggtgtccaagctgctgtacagccggggcctgctgattgacctgctgatcaagagcaatgtgagccgctatgcagagttcaagaacatcacccgcatcctggccttccgggagggccgggtggagcaggtgccctgcagcagagcagatgtgttcaacagcaagcagctgaccatggtggagaagaggatgctgatgaagttcctgaccttctgcatggagtatgagaagtacccagatgagtacaagggctatgaggagatcaccttctatgagtacctgaagacccagaagctgacccccaacctgcagtacatcgtgatgcacagcatcgccatgaccagcgagacagccagcagcaccattgatggcctgaaggccaccaagaacttcctgcactgcctgggccgctatggcaacacccccttcctgttccccctgtatggccagggcgagctgccccagtgcttctgcaggatgtgtgctgtgtttggaggcatctactgcctgcggcacagcgtgcagtgcctggtggtggacaaggagagcaggaagtgcaaggccatcatcgaccagtttggccagaggatcatcagcgagcacttcctggtggaggacagctacttccctgagaacatgtgcagccgggtgcagtaccggcagatcagcagagctgtgctgatcacagacagatctgtgctgaagacagacagcgaccagcagatcagcatcctgactgtgcctgctgaggagcccggcacctttgctgtgcgggtcatcgagctgtgcagcagcaccatgacctgcatgaagggcacctacctggtgcacctgacctgcaccagcagcaagacagcccgggaggacctggagagcgtggtgcagaagctgtttgtgccctacacagagatggagattgaaaatgagcaggtggagaagccccgcatcctgtgggccctgtacttcaacatgagggacagcagtgacatcagccgcagctgctacaatgacctgcccagcaatgtgtatgtgtgcagcggccctgactgtggcctgggcaatgacaatgctgtgaagcaggccgagaccctcttccaggagatctgccccaatgaagacttctgccccccaccacccaaccctgaggacatcatcctggatggagacagcctgcagcctgaggccagcgagagcagcgccatccctgaggccaacagcgagaccttcaaggagagcaccaacctgggcaacctggaggagagcagcgagtag

SEQ ID NO: 147497 - DNA, 333 bp, Artificial Sequence
  Description of Artificial Sequence: Synthetic coding sequence
atggctgacaccctgcccagcgagtttgatgtgattgtcatcggcaccggcctgcctgagagcatcatcgctgctgcctgcagccgcagcggccggcgggtgctgcacgtggacagccgcagctactatggaggcaactgggccagcttctccttcagcggcctgctgtcctggctgaaggagtaccaggagaacagcgacatcgtgtctgacagccctgtgtggcaggaccagatcctggagaatgaggaggccatcgccctgagcaggaaggacaagaccatccagcacgtggaggtgttctgctacgcccggagcaccctgctgctgtag

SEQ ID NO: 147498 - DNA, 1518 bp, Artificial Sequence
  Description of Artificial Sequence: Synthetic coding sequence
atgagctgtgagatgctgacagagcagacccccagcagtgaccctgaaaatgccctggaggtgaatggagctgaggtgactggagagaaggagaaccactgtgatgacaagacctgtgtgcccagcaccagcgctgaggacatgtctgaaaatgtgcccatcgccgaggacaccacagagcagcccaagaagaaccgcatcacctacagccagatcatcaaggagggccgccgcttcaacatcgacctggtgtccaagctgctgtacagccggggcctgctgattgacctgctgatcaagagcaatgtgagccgctatgcagagttcaagaacatcacccgcatcctggccttccgggagggccgggtggagcaggtgccctgcagcagagcagatgtgttcaacagcaagcagctgaccatggtggagaagaggatgctgatgaagttcctgaccttctgcatggagtatgagaagtacccagatgagtacaagggctatgaggagatcaccttctatgagtacctgaagacccagaagctgacccccaacctgcagtacatcgtgatgcacagcatcgccatgaccagcgagacagccagcagcaccattgatggcctgaaggccaccaagaacttcctgcactgcctgggccgctatggcaacacccccttcctgttccccctgtatggccagggcgagctgccccagtgcttctgcaggatgtgtgctgtgtttggaggcatctactgcctgcggcacagcgtgcagtgcctggtggtggacaaggagagcaggaagtgcaaggccatcatcgaccagtttggccagaggatcatcagcgagcacttcctggtggaggacagctacttccctgagaacatgtgcagccgggtgcagtaccggcagatcagcagagctgtgctgatcacagacagatctgtgctgaagacagacagcgaccagcagatcagcatcctgactgtgcctgctgaggagcccggcacctttgctgtgcgggtcatcgagctgtgcagcagcaccatgacctgcatgaagggcacctacctggtgcacctgacctgcaccagcagcaagacagcccgggaggacctggagagcgtggtgcagaagctgtttgtgccctacacagagatggagattgaaaatgagcaggtggagaagccccgcatcctgtgggccctgtacttcaacatgagggacagcagtgacatcagccgcagctgctacaatgacctgcccagcaatgtgtatgtgtgcagcggccctgactgtggcctgggcaatgacaatgctgtgaagcaggccgagaccctcttccaggagatctgccccaatgaagacttctgccccccaccacccaaccctgaggacatcatcctggatggagacagcctgcagcctgaggccagcgagagcagcgccatccctgaggccaacagcgagaccttcaaggagagcaccaacctgggcaacctggaggagagcagcgagtag

SEQ ID NO: 147499 - DNA, 1971 bp, Artificial Sequence
  Description of Artificial Sequence: Synthetic coding sequence
atggctgacaacctgcccacagaatttgatgtggtgatcatcggcaccggcctgcctgagagcatcctggccgccgcctgcagccgcagcggccagagggtgctgcacatcgacagccgcagctactatggaggcaactgggccagcttctccttcagcggcctgctgtcctggctgaaggagtaccagcagaacaatgacatcggggaggagagcacagtggtgtggcaggacctgattcatgaaacagaggaggccatcaccctgaggaagaaggatgagaccatccagcacacagaggccttctgctacgccagccaggacatggaggacaacgtggaggagatcggggccctgcagaagaaccccagcctgggcgtgagcaacaccttcacagaggtgctggacagcgccctgcctgaggagagccagctgagctacttcaacagtgatgagatgcctgccaagcacacccagaagagtgacacagagatcagcctggaggtgacagatgtggaggagagcgtggagaaggagaagtactgtggggacaagacctgcatgcacacagtgtctgacaaggatggagacaaggatgagagcaagagcacagtggaggacaaggcagatgagcccatccggaaccgcatcacctacagccagatcgtgaaggagggccgccgcttcaacatcgacctggtgtccaagctgctgtacagccagggcctgctgattgacctgctgatcaagagtgatgtgagccgctacgtggagttcaagaatgtgacccgcatcctggccttccgggagggcaaggtggagcaggtgccctgcagcagagcagatgtgttcaacagcaaggagctgaccatggtggagaagaggatgctgatgaagttcctgaccttctgcctggagtatgagcagcacccagatgagtaccaggccttccggcagtgcagcttcagcgagtacctgaagaccaagaagctgacccccaacctgcagcactttgtgctgcacagcatcgccatgaccagcgagagcagctgcaccaccattgatggcctgaatgccaccaagaacttcctgcagtgcctgggccgcttcggcaacacccccttcctgttccccctgtatggccagggcgagatcccccagggcttctgcaggatgtgtgctgtgtttggaggcatctactgcctgcggcacaaggtgcagtgctttgtggtggacaaggagagcggccgctgcaaggccatcatcgaccacttcggccagaggatcaatgccaagtacttcatcgtggaggacagctacctgtctgaggagacctgcagcaatgtgcagtacaagcagatcagcagagctgtgctgatcacagaccagagcatcctgaagacagacctggaccagcagaccagcatcctgattgtgcccccagctgagcccggggcctgtgctgtgcgggtgacagagctgtgcagcagcaccatgacctgcatgaaggacacctacctggtgcacctgacctgcagcagcagcaagacagcccgggaggacctggagagcgtggtgaagaagctgttcaccccctacacagaaacagagatcaatgaggaggagctgaccaagccccggctgctgtgggccctgtacttcaacatgagggacagcagcggcatcagccgcagcagctacaacggcctgcccagcaatgtgtatgtgtgcagcggccctgactgtggcctgggcaatgagcacgctgtgaagcaggccgagaccctcttccaggagatcttccccacagaggagttctgccccccaccacccaaccctgaggacatcatctttgatggagatgacaagcagcctgaggcccctggcaccaacaacgtggtgatggccaagctggagagcagcgaggagagcaagaacctggagagccctgagaagcacctgcagaactag

SEQ ID NO: 147500 - DNA, 1641 bp, Artificial Sequence
  Description of Artificial Sequence: Synthetic coding sequence
atggagcagaggagagtgacagacttctttgccaggagaagacctggccccccacgcatcgccccacccaagctggcctgcaggacccccagccctgcccggcctgccctgcgggccccagccagcgccaccagcggcagcaggaagagggcccggcccccagctgcccctggccgggaccaggcccggcccccagcccggcggcggctgcggctgtctgtggatgaggtgagcagccccagcaccccagaggccccagacatcccagcctgccccagccctggccagaagatcaagaagagcaccccagctgctggccagcccccccacctgaccagcgcccaggaccaggacaccatcagcgagctggccagctgcctgcagagggcccgggagctgggcgcccgggtgcgggccctgaaggccagcgcccaggatgctggggagagctgcaccccagaggccgagggccggcctgaggagccctgtggggagaaggccccagcctaccagcgcttccacgccctggcccagcccggcctgcccggcctggtgctgccctacaagtaccaggtgctggccgagatgttccgctccatggacaccatcgtgggcatgctgcacaacagaagtgagacccccacctttgccaaggtgcagaggggcgtgcaggacatgatgagaagaagatttgaagaatgtaatgtgggccagatcaagacagtgtacccagccagctaccgcttccggcaggagaggtctgtgcccaccttcaaggatggcaccaggagaagtgactaccagctgaccatcgagcccctgctggagcaggaggctgatggagctgccccccagctgacagccagccggctgctgcagaggcggcagatcttcagccagaagctggtggagcacgtgaaggagcaccacaaggccttcctggccagcctgagccctgccatggtggtgcctgaggaccagctgacccgctggcacccccgcttcaacgtggatgaggtgcctgacatcgagcctgctgccctgccccagcccccagccacagagaagctgaccacagcccaggaggtgctggcccgggccaggaacctgatcagccccaggatggagaaggccctgagccagctggccctgcggtctgctgcccccagcagccctggcagccccaggcctgccctgcctgccaccccaccagccaccccacctgctgccagccccagcgccctgaagggcgtgtcccaggacctgctggagcgcatccgggccaaggaggcccagaagcagctggcccagatgacccgctgcccagagcaggagcagaggctgcagaggctggagcggctgcctgagctggcccgggtgctgcggtctgtgtttgtgtctgagaggaagccagccctgtccatggaggtggcctgtgccaggatggtgggcagctgctgcaccatcatgagccctggagagatggagaagcacctgctgctgctgtctgagctgctgcctgactggctgagcctgcaccgcatcagaacagacacctacgtgaagctggacaaggctgctgacctggcccacatcacagcccggctggcccaccagaccagggctgaggagggcctgtag

SEQ ID NO: 147501 - DNA, 306 bp, Artificial Sequence
  Description of Artificial Sequence: Synthetic coding sequence
atgcagcagcagcagcagctggccagcgccaggaacagaaggctggcccagcagatggagaaccggcccagcgtgcaggccgccctgaagctgaagcagaagagcctgaagcagaggctgggcaagagcaacatccaggcccggctgggccggcccatcggggccctggcccggggggccatcggcggccggggcctgcccatcatccagaggggcctgccccggggcggcctgcggggcggccgggccaccaggaccctgctgcggggcggcatgagcctgcggggccagtgctgcgtgccctag

SEQ ID NO: 147502 - DNA, 672 bp, Artificial Sequence
  Description of Artificial Sequence: Synthetic coding sequence
atgctgaagaacaagcagcccacccctgtgaacatccgggcctccatgcagcagcagcagcagctggccagcgccaggaacagaaggctggcccagcagatggagaaccggcccagcgtgcaggccgccctgaagctgaagcagagcctgaagcagaggctgggcaagagcaacatccaggcccggctgggccggcccatcggggccctggcccggggggccatcggcggccggggcctgcccatcatccagaggggcctgccccggggcggcctgcggggcggccgggccaccaggaccctgctgcggggcggcatgagcctgcggggccagaacctgctgcggggcggccgggctgtggcccccaggatgggcctgcggcggggcggcgtgcggggccggggcggccctggccggggcggcctgggccgcggggccatgggccggggcggcatcggcggccggggccggggcatgattggccggggccggggcggctttggaggccggggccggggccggggccggggccgcggggccctggcccggcctgtgctgaccaaggagcagctggacaaccagctggatgcctacatgagcaagaccaagggccacctggatgctgagctggatgcctacatggcccagacagatcctgagaccaatgactag

SEQ ID NO: 147503 - DNA, 609 bp, Artificial Sequence
  Description of Artificial Sequence: Synthetic coding sequence
atggccgcccagagcgcccccaaggtggtgctgaagagcaccaccaagatgagcctgaatgaacgcttcaccaacatgctgaagaacaagcagcccacccctgtgaacatccgggcctccatgcagcagcagcagcagctggccagcgccaggaacagaaggctggcccagcagatggagaaccggcccagcgtgcaggccgccctgaagctgaagcagagcctgaagcagaggctgggcaagagcaacatccaggcccggctgggccggcccatcggggccctggcccggggggccatcggcggccggggcctgcccatcatccagaggggcctgccccggggcggcctgcggggcggccgggccaccaggaccctgctgcggggcggcatgagcctgcggggccggggcatgattggccggggccggggcggctttggaggccggggccggggccggggccggggccgcggggccctggcccggcctgtgctgaccaaggagcagctggacaaccagctggatgcctacatgagcaagaccaagggccacctggatgctgagctggatgcctacatggcccagacagatcctgagaccaatgactag

SEQ ID NO: 147504 - DNA, 747 bp, Artificial Sequence
  Description of Artificial Sequence: Synthetic coding sequence
atggccgcccagagcgcccccaaggtggtgctgaagagcaccaccaagatgagcctgaatgaacgcttcaccaacatgctgaagaacaagcagcccacccctgtgaacatccgggcctccatgcagcagcagcagcagctggccagcgccaggaacagaaggctggcccagcagatggagaaccggcccagcgtgcaggccgccctgaagctgaagcagagcctgaagcagaggctgggcaagagcaacatccaggcccggctgggccggcccatcggggccctggcccggggggccatcggcggccggggcctgcccatcatccagaggggcctgccccggggcggcctgcggggcggccgggccaccaggaccctgctgcggggcggcatgagcctgcggggccagaacctgctgcggggcggccgggctgtggcccccaggatgggcctgcggcggggcggcgtgcggggccggggcggccctggccggggcggcctgggccgcggggccatgggccggggcggcattggaggccggggccggggcatgattggccggggccggggcggctttggaggccggggccggggccggggccggggccgcggggccctggcccggcctgtgctgaccaaggagcagctggacaaccagctggatgcctacatgagcaagaccaagggccacctggatgctgagctggatgcctacatggcccagacagatcctgagaccaatgactag

SEQ ID NO: 147505 - DNA, 609 bp, Artificial Sequence; identical to SEQ ID NO: 147503
  Description of Artificial Sequence: Synthetic coding sequence

SEQ ID NO: 147506 - DNA, 636 bp, Artificial Sequence
  Description of Artificial Sequence: Synthetic coding sequence
atggaggagctgagctctgtgggggagcaggtgtttgctgctgagtgcatcctgagcaagaggctgaggaagggcaagctggagtacctggtgaagtggaggggctggagcagcaagcacaacagctgggagcctgaggagaacatcctggacccccggctgctgctggccttccagaagaaggagcacgagaaggaggtgcagaacaggaagaggggcaagaggccccggggccggcccaggaagctgacagccatgagcagctgcagcagaagaagcaagctgaaggtgggcggctgtgccggctacgccgaccccaccagccagcaccccctgggcgtgggcggccggcagcgggagggcctgggccccagcggccggggctggcacttctgccagcagagcgtgcccctgctgggcaagcaggagccccccttcttcctgagcctgtccttctgctgccagggcccccagcctgctgagagcagcagcccccccctgcccggggccagctgcttcagcctgagctgcacccccctgtgctgggtggccggcagcaactgctgccggcaggccctcttccccccccggggcagcctgggagatggcaaggagcaggaggcctgtgtgcagtag

SEQ ID NO: 147507 - DNA, 1599 bp, Artificial Sequence
  Description of Artificial Sequence: Synthetic coding sequence
atggaggagctgagctctgtgggggagcaggtgtttgctgctgagtgcatcctgagcaagaggctgaggaagggcaagctggagtacctggtgaagtggaggggctggagcagcaagcacaacagctgggagcctgaggagaacatcctggacccccggctgctgctggccttccagaagaaggagcacgagaaggaggtgcagaacaggaagaggggcaagaggccccggggccggcccaggaagctgacagccatgagcagctgcagcagaagaagcaagctgaaggagccagatgcccccagcaagagcaagagcagcagcagcagcagcagcagcaccagcagcagcagcagcagtgatgaagaagatgacagcgacctggatgccaagaggggcccccggggccgggagacccaccctgtgccccagaagaaggcccagatcctggtggccaagccagagctgaaggaccccatcaggaagaagaggggcaggaagcccctgcccccagagcagaaggccaccaggaggcctgtgtccctggccaaggtgctgaagacagccaggaaggacctgggcgccccagccagcaagctgcccccacccctgagcgcccctgtggccggcctggccgccctgaaggcccacgccaaggaggcctgtggcggccccagcgccatggccaccccagagaacctggccagcctgatgaagggcatggccagcagccctggccggggcggcatctcctggcagagcagcatcgtgcactacatgaacaggatgacccagagccaggcccaggccgccagccggctggccctgaaggcccaggccaccaacaagtgtggcctgggcctggacctgaaggtgaggacccagaagggggagctgggcatgagccccccaggcagcaagatccccaaggcccccagcggcggcgctgtggagcagaaggtgggcaacacaggaggccccccccacacccatggagccagccgggtgcctgctggctgccccggcccccagcctgcccccacccaggagctgagcctgcaggtgctggacctgcagagcgtgaagaatggcatgcctggggtgggcctgctggcccggcatgccacagccaccaagggcgtgcctgccaccaacccagcccctgggaagggcaccggcagcggcctgattggagccagcggggccaccatgcccacagacaccagcaagtctgagaagctggccagcagagctgtggccccacccaccccagccagcaagagggactgtgtgaagggcagcgccacccccagcggccaggagagcaggacagcccctggagaggccaggaaggccgccaccctgcctgagatgtctgctggggaggagagcagcagcagtgacagcgaccctgattctgccagcccccccagcacaggccagaaccccagcgtgtctgtgcagaccagccaggactggaagcccaccaggagcctcatcgagcacgtgtttgtgacagatgtgacagccaacctgatcaccgtgacagtgaaggagagccccacctctgtgggcttcttcaacctgcggcactactag

SEQ ID NO: 147508 - DNA, 1935 bp, Artificial Sequence
  Description of Artificial Sequence: Synthetic coding sequence
atggaggccgagcggggccctgagaggaggcctgctgagaggagcagccctggccagaccccagaggagggcgcccaggccctggccgagtttgctgccctgcacggccctgccctgcgggccagcggcgtgcctgagcgctactggggccgcctgctgcacaagctggagcacgaggtgtttgatgctggggaggtgtttggcatcatgcaggtggaggaggtggaggaggaggaggatgaggccgcccgggaggtgaggaagcagcagcccaaccctggaaatgagctgtgctacaaggtgattgtgacccgggagagcggcctgcaggccgcccaccccaacagcatcttcctgattgaccacgcctggacctgccgggtggagcacgcccggcagcagctgcagcaggtgcccggcctgctgcacaggatggccaacctgatgggcatcgagttccacggggagctgcccagcacagaggccgtggccctggtgctggaggagatgtggaagttcaaccagacctaccagctggcccatggaacagctgaggagaagatgcctgtgtggtacatcatggatgaatttggcagccgcatccagcacgcagatgtgcccagctttgccacagcccccttcttctacatgccccagcaggtggcctacaccctgctgtggcccctgcgggacctggacaccggggaggaggtgacccgggactttgcctacggggagacagaccccctcatcaggaagtgcatgctgctgccctgggcccccacagacatgctggacctgagcagctgcaccccagagcccccagctgagcactaccaggccatcctggaggagaacaaggagaagctgcccctggacatcaaccctgtggtgcacccccacggccacatcttcaaggtgtacacagatgtgcagcaggtggccagcagcctgacccacccccgcttcaccctgacccagagcgaggctgatgctgacatcctcttcaacttcagccacttcaaggactacaggaagctgagccaggagaggcctggggtgctgctgaaccagttcccctgtgagaacctgctgactgtgaaggactgcctggccagcatcgcccggcgggccggcggccctgagggccccccctggctgcccaggaccttcaacctgaggacagagctgccccagtttgtgtcctacttccagcagcgggagcgctggggcgaggacaaccactggatctgcaagccctggaacctggcccggagcctggacacccacgtgaccaagagcctgcacagcatcatccgccaccgggagagcacccccaaggtggtgtccaagtacatcgagagccctgtgctcttcctgcgggaggatgtgggcaaggtgaagtttgacatccgctacatcgtgctgctgcggtctgtgcggcccctgcggctgtttgtgtatgatgtgttctggctgcgcttcagcaacagagcctttgccctgaatgacctggatgattatgagaagcacttcaccgtgatgaactatgaccctgatgtggtgctgaagcaggtgcactgtgaggagttcatccctgagtttgagaagcagtacccagagttcccctggacagatgtgcaggccgagatcttccgggccttcacagagctgttccaggtggcctgtgccaagcccccacccctgggcctgtgtgactaccccagcagccgggccatgtatgctgtggacctgatgctgaagtgggacaatggaccagatggccggcgggtgatgcagccccagatcctggaggtgaacttcaacccagactgtgagcgggcctgccgctaccaccccaccttcttcaatgatgtgttcagcaccctcttcctggaccagcccggcggctgccacgtgacctgcctggtgtag

SEQ ID NO: 147509 - DNA, 477 bp, Artificial Sequence
  Description of Artificial Sequence: Synthetic coding sequence
atggagctgagcgccatcggggagcaggtgtttgctgtggagagcatcaggaagaagagggtgaggaagggcaaggtggagtacctggtgaagtggaagggctggccacccaagtacagcacctgggagcctgaggagcacatcctggacccccggctggtgatggcctatgaggagaaggaggagcgggaccgggccagcggctacaggaagaggggccccaagcccaagaggctgctgctgcaggagcccccagccccagatgtgctgcaggccgccggggagtgggagcctgctgcccagcccccagaggaggaggctgatgctgacctggccgagggccccccaccctggaccccagccctgcccagcagcgaggtgacagtgacagacatcacagccaacagcatcaccgtgaccttccgggaggcccaggccgctgagggcttcttccgggacagaagtggcaagttctag

SEQ ID NO: 147510 - DNA, 366 bp, Artificial Sequence
  Description of Artificial Sequence: Synthetic coding sequence
atggagctgagcgccatcggggagcaggtgtttgctgtggagagcatcaggaagaagagggtgaggaagggcaaggtggagtacctggtgaagtggaagggctggccacccaaggaggagcgggaccgggccagcggctacaggaagaggggccccaagcccaagaggctgctgctgcagaggctgtacagcatggacctgcggagcagccacaaggccaagggcaaggagaagctgtgcttcagcctgacctgccccctgggcagcggcagccctgagggcgtggtgaaggccggggcccctgagctggtggacaagggccccctggtgcccaccctgcccttccccctgaggaagcccaggtag

SEQ ID NO: 147511 - DNA, 5133 bp, Artificial Sequence
  Description of Artificial Sequence: Synthetic coding sequence
atgaatggccacagtgatgaggagagcgtgaggaacagcagcggggagagcagccagagtgatgatgacagcggcagcgccagcggcagcggcagcggcagcagcagcggcagcagcagtgatggcagcagcagccagagcggcagcagtgacagcgacagcggcagcgagagcggcagccagagcgagagcgagagtgacaccagccgggagaacaaggtgcaggccaagccacccaaggtggatggagctgagttctggaagagcagccccagcatcctggccgtgcagaggtctgccatcctgaagaagcagcagcagcagcagcagcagcagcagcaccaggccagcagcaacagcggcagcgaggaggacagcagcagcagcgaggacagtgatgacagcagcagcgaggtgaagaggaagaagcacaaggatgaggactggcagatgagcggcagcggcagccccagccagagcggcagtgacagcgagagcgaggaggagcgggagaagagcagctgtgatgaaacagaaagtgactatgagcccaagaacaaggtgaagagcaggaagccccagaacagaagcaagagcaagaatggcaagaagatcctgggccagaagaagaggcagattgacagcagcgaggaggatgatgatgaagaagattatgacaatgacaagaggagcagccggcggcaggccaccgtgaatgtgtcctacaaggaggatgaggagatgaagacagacagtgatgacctgctggaggtgtgtggagaagatgtgccccagcctgaggaggaggagtttgagaccatcgagcgcttcatggactgccgcatcggcaggaaaggagccaccggggccaccaccaccatctatgctgtggaggctgatggagaccccaatgccggctttgagaagaacaaggagcctggagagatccagtacctgatcaagtggaagggctggagccacatccacaacacctgggagacagaggagaccctgaagcagcagaatgtgcggggcatgaagaagctggacaactacaagaagaaggaccaggagaccaagcgctggctgaagaatgccagcccagaagatgtggagtactacaactgccagcaggagctgacagatgacctgcacaagcagtaccagatcgtggagcgcatcatcgcccacagcaaccagaagtctgctgctggctacccagactactactgcaagtggcagggcctgccctacagcgagtgctcctgggaggatggagccctgatcagcaagaagttccaggcctgcattgatgagtacttcagcaggaaccagagcaagaccacccccttcaaggactgcaaggtgctgaagcagaggcccaggtttgtggccctgaagaagcagcccagctacatcggcggccacgagggcctggagctgcgggactaccagctgaatggcctgaactggctggcccacagctggtgcaagggcaacagctgcatcctggctgatgagatgggcctgggcaagaccatccagaccatctccttcctgaactacctgttccacgagcaccagctgtatggccccttcctgctggtggtgcccctgagcaccctgacctcctggcagcgggagatccagacctgggccagccagatgaatgctgtggtgtacctgggggacatcaacagcaggaacatgatccgcacccatgagtggacccaccaccagaccaagaggctgaagttcaacatcctgctgaccacctatgagatcctgctgaaggacaaggccttcctgggcggcctgaactgggccttcatcggcgtggatgaggcccaccggctgaagaatgatgacagcctgctgtacaagaccctgattgacttcaagagcaaccaccggctgctgatcaccggcacccccctgcagaacagcctgaaggagctgtggagcctgctgcacttcatcatgcctgagaagttcagctcctgggaggactttgaggaggagcacggcaagggccgggagtatggctacgccagcctgcacaaggagctggagcccttcctgctgcggcgggtgaagaaggatgtggagaagagcctgcctgccaaggtggagcagatcctgaggatggagatgtctgccctgcagaagcagtactacaagtggatcctgaccaggaactacaaggccctgagcaagggcagcaagggcagcaccagcggcttcctgaacatcatgatggagctgaagaagtgctgcaaccactgctacctgatcaagcccccagacaacaatgagttctacaacaagcaggaggccctgcagcacctgatccgcagcagcggcaagctgatcctgctggacaagctgctgatccggctgcgggagcggggcaacagagtgctgatcttcagccagatggtgaggatgctggacatcctggccgagtacctgaagtaccggcagttccccttccagaggctggatggcagcatcaagggggagctgaggaagcaggccctggaccacttcaatgctgagggcagcgaggacttctgcttcctgctgagcacccgggccggcggcctgggcatcaacctggccagcgctgacacagtggtgatctttgacagcgactggaacccccagaatgacctgcaggcccaggcccgggcccacagaattggccagaagaagcaggtgaacatctaccgcctggtgaccaagggctctgtggaggaggacatcctggagcgggccaagaagaagatggtgctggaccacctggtgatccagaggatggacaccaccgggaagacagtgctgcacacaggcagcgcccccagcagcagcacccccttcaacaaggaggagctgagcgccatcctgaagtttggagctgaggagctgttcaaggagcctgagggggaggagcaggagccccaggagatggacattgatgagatcctgaagagagctgagacccatgaaaatgagcccggccccctgactgtgggagatgagctgctgagccagttcaaggtggccaacttcagcaacatggatgaagatgacatcgagctggagcctgagaggaacagcaagaactgggaggagatcatccctgaggaccagaggcggcggctggaggaggaggagcggcagaaggagctggaggagatctacatgctgcccaggatgaggaactgtgccaagcagatctccttcaatggaagtgagggccgccgcagccgcagccgccgctacagcggcagtgacagcgacagcatcagcgagggcaagaggcccaagaagaggggccggcccaggaccatcccccgggagaacatcaagggcttcagtgatgctgagatccgccgcttcatcaagagctacaagaagtttggaggccccctggagcggctggatgccatcgccagagatgctgagctggtggacaagtcagaaacagacctgcggcggctgggggagctggtgcacaacggctgcatcaaggccctgaaggacagcagcagcggcacagagaggactggaggccgcctgggcaaggtgaagggccccaccttccgcatctctggagtgcaggtgaatgccaagctggtgatcagccatgaggaggagctgatccccctgcacaagagcatccccagcgaccctgaggagaggaagcagtacaccatcccctgccacaccaaggccgcccactttgatattgactggggcaaggaggatgacagcaacctgctgattggcatctatgaatatggctacggctcctgggagatgatcaagatggaccctgacctgagcctgacccacaagatcctgcctgatgatcctgacaagaagccccaggccaagcagctgcagaccagggctgactacctgatcaagctgctgagccgggacctggccaagaaggaggccctgagcggggccggcagcagcaagaggaggaaggcccgggccaagaagaacaaggccatgaagagcatcaaggtgaaggaggagatcaagagtgacagcagccccctgcccagcgagaagagtgatgaagatgatgacaagctgtctgagagcaagagtgatggccgggagaggagcaagaagagctctgtgtctgatgcccctgtgcacatcacagccagcggggagcctgtgcccatcagcgaggagagcgaggagctggaccagaagaccttcagcatctgcaaggagaggatgaggcctgtgaaggccgccctgaagcagctggacaggcctgagaagggcctgtctgagcgggagcagctggagcacacccggcagtgcctgatcaagatcggggaccacatcacagagtgcctgaaggagtacaccaaccctgagcagatcaagcagtggaggaagaacctgtggatctttgtgtccaagttcacagaatttgatgccaggaagctgcacaagctgtacaagcacgccatcaagaagaggcaggagagccagcagaacagcgaccagaacagcaacctgaacccccacgtgatcagaaatccagatgtggagcggctgaaggagaacaccaaccatgatgacagcagccgggacagctacagcagtgacagacacctgacccagtaccatgaccaccacaaggacagacaccagggcgacagctacaagaagagtgacagcaggaagaggccctacagcagcttcagcaatggcaaggaccaccgggactgggaccactacaagcaggacagccgctactacagcgaccgggagaagcacaggaagctggatgaccacaggagccgggaccacaggagcaacctggagggcagcctgaaggacaggagccacagcgaccacaggagccacagcgaccaccggctgcacagcgaccacaggagcagcagcgagtacacccaccacaagagcagccgggactaccgctaccacagcgactggcagatggaccaccgggccagcagcagcggccccaggagccccctggaccagaggagcccctacggcagccgcagcccctttgagcacagcgtggagcacaagagcaccccagagcacacctggagcagcaggaagacctag

SEQ ID NO: 147512 - DNA, 903 bp, Artificial Sequence
  Description of Artificial Sequence: Synthetic coding sequence
atgttctccttcaccggggtgctggtgatctatgaggtgctgaagaagtgcatcggcaagctgatcagcctgcgggtgtgcagcattgagggctgtgtgtgtgtgtatgtgtttgtgcctgggggcaaggagttccacgagaagctgaacatcttccaccagaccaacctgatctgcctcttcctgaacagcagcaggaacctgtggatctttgtgtccaagttcacagaatttgatgccaggaagctgcacaagctgtacaagcacgccatcaagaagaggcaggagagccagcagaacagcgaccagaacagcaacctgaacccccacgtgatcagaaatccagatgtggagcggctgaaggagaacaccaaccatgatgacagcagccgggacagctacagcagtgacagacacctgacccagtaccatgaccaccacaaggacagacaccagggcgacagctacaagaagagtgacagcaggaagaggccctacagcagcttcagcaatggcaaggaccaccgggactgggaccactacaagcaggacagccgctactacagcgaccgggagaagcacaggaagctggatgaccacaggagccgggaccacaggagcaacctggagggcagcctgaaggacaggagccacagcgaccacaggagccacagcgaccaccggctgcacagcgaccacaggagcagcagcgagtacacccaccacaagagcagccgggactaccgctaccacagcgactggcagatggaccaccgggccagcagcagcggccccaggagccccctggaccagaggagcccctacggcagccgcagcccctttgagcacagcgtggagcacaagagcaccccagagcacacctggagcagcaggaagacctag

SEQ ID NO: 147513 - DNA, 624 bp, Artificial Sequence
  Description of Artificial Sequence: Synthetic coding sequence
atgaatggccacagtgatgaggagagcgtgaggaacagcagcggggagagcagccagagtgatgatgacagcggcagcgccagcggcagcggcagcggcagcagcagcggcagcagcagtgatggcagcagcagccagagcggcagcagtgacagcgacagcggcagcgagagcggcagccagagcgagagcgagagtgacaccagccgggagaacaaggtgcaggccaagccacccaaggtggatggagctgagttctggaagagcagccccagcatcctggccgtgcagaggtctgccatcctgaagaagcagcagcagcagcagcagcagcagcagcaccaggccagcagcaacagcggcagcgaggaggacagcagcagcagcgaggacagtgatgacagcagcagcgaggtgaagaggaagaagcacaaggatgaggactggcagatgagcggcagcggcagccccagccagagcggcagtgacagcgagagcgaggaggagcgggagaagagcagctgtgatgaaacagaaagtgactatgagcccaagaacaaggtgaagagcaggaagccccagaacagaagcaagagcaagaatgagaagaagaagaagaagtag

SEQ ID NO: 147514 - DNA, 660 bp, Artificial Sequence
  Description of Artificial Sequence: Synthetic coding sequence
gtgggcgctgaccgggacagccccaccctgctgcctgctgggggcagcaactggctggcccagcgcttccactgccagaatggctgcatcctgggagatgagatgggcctgggcaagacctgccagaccatcgccctcttcatctacctggccggccgcctgaatgatgagggccccttcctgatcctgtgccccctgtctgtggagcagctggagaggagaaatgctgagatctgcagccgctccttcctgtgcaacatctgtggggacaaggaggagcgggcctgcctgcagcaggacctgaagcaggagagccgcttccacgtgctgctgaccacctatgagatctgcctgaaggatgccagcttcctgaagagcttcccctggagcgtgctggtggtggatgaggcccaccggctgaagaaccagagcagcctgctgcacaagaccctgtctgagttctctgtggtgttcagcctgctgctgaccggcacccccatccagaacagcctgcaggagctgtacagcctgctgagctttgtggagccagacctcttcagcaaggaggagtgggagatcctcttcaatgccacccgcatcctgaggaagaacctgagccagcaggtgaactgcaccaacagctgcagccacttctgctag

SEQ ID NO: 147515 - DNA, 1851 bp, Artificial Sequence
  Description of Artificial Sequence: Synthetic coding sequence
atgtctgccctgcagaagaagtactacaaggccatcctgatgaaggacctggatgcctttgaaaatgaaacagccaagaaggtgaagctgcagaacatcctgagccagctgaggaaatgtgtggaccacccctacctgtttgatggagtggagcctgagccctttgaggtgggggaccacctgacagaggccagcggcaagctgcacctgctggacaagctgctggccttcctgtacagcggcggccaccgggtgctgctcttcagccagatgacccagatgctggacatcctgcaggactacatggactaccggggctacagctatgagcgggtggatggctctgtgcggggggaggagcggcacctggccatcaagaactttggccagcagcccatctttgtgttcctgctgagcacccgggccggcggcgtgggcatgaacctgacagctgctgacaccgtcatctttgtggacagcgacttcaacccccagaatgacctgcaggccgccgcccgggcccacagaattggccagaacaagtctgtgaaggtgatccggctgattggccgggacacagtggaggagatcgtgtacaggaaggccgccagcaagctgcagctgaccaacatgatcattgaaggaggccacttcaccctgggcgcccagaagccagctgctgatgctgacctgcagctgtctgagatcctgaagtttggcctggacaagctgctggccagcgagggcagcaccatggatgaaattgacctggagagcatcctgggggagaccaaggatggccagtgggtgtctgatgccctgcctgctgctgagggcggcagccgggaccaggaggagggcaagaaccacatgtacctgtttgagggcaaggactacagcaaggagcccagcaaggaggacaggaagagctttgagcagctggtgaacctgcagaagaccctgctggagaaggccagccaggagggccgcagcctgagaaataaaggatctgtgctgatccctggcctggtggagggcagcaccaagaggaagagggtgctgagccctgaggagctggaggaccggcagaagaagaggcaggaggccgccgccaagagaagaaggctgattgaggagaagaagaggcagaaggaggaggccgagcacaagaagaagatggcctggtgggagagcaacaactaccagagcttctgcctgcccagcgaggagagcgagcctgaggacctggagaatggagaggagagcagcgctgagctggactaccaggaccctgatgccaccagcctgaagtatgtgtctggagatgtgacccacccccaggccggggctgaagatgccctgattgtgcactgtgtggatgacagcggccactggggccggggcggcctcttcaccgccctggagaagaggtctgctgagcccaggaagatctatgagctggccggcaagatgaaggacctgagcctgggcggcgtgctgctcttccctgtggatgacaaggagagcaggaacaagggccaggacctgctggccctgattgtggcccagcaccgggacaggagcaatgtgctgagcggcatcaagatggccgccctggaggagggcctgaagaagatcttcctggccgccaagaagaagaaggcctctgtgcacctgccccgcatcggccacgccaccaagggcttcaactggtacggcacagagcggctcatcaggaagcacctggccgcccggggcatccccacctacatctactacttccccaggagcaagtctgctgtgctgcacgcccagagcagcagcagcagcagccggcagctggtgccctag

SEQ ID NO: 147516 - DNA, 2694 bp, Artificial Sequence
  Description of Artificial Sequence: Synthetic coding sequence
atggagcgggccggggccaccagccggggcggccaggcccctggcttcctgctgcggctgcacacagagggccgggcagaggccgcccgggtgcaggagcaggacctgcggcagtggggcctgaccggcatccacctgcggagctaccagctggagggcgtgaactggctggcccagcgcttccactgccagaatggctgcatcctgggagatgagatgggcctgggcaagacctgccagaccatcgccctcttcatctacctggccggccgcctgaatgatgagggccccttcctgatcctgtgccccctgtctgtgctgagcaactggaaggaggagatgcagagatttgcccctggcctgagctgtgtgacctacgccggggacaaggaggagcgggcctgcctgcagcaggacctgaagcaggagagccgcttccacgtgctgctgaccacctatgagatctgcctgaaggatgccagcttcctgaagagcttcccctggagcgtgctggtggtggatgaggcccaccggctgaagaaccagagcagcctgctgcacaagaccctgtctgagttctctgtggtgttcagcctgctgctgaccggcacccccatccagaacagcctgcaggagctgtacagcctgctgagctttgtggagccagacctcttcagcaaggaggaggtgggggacttcatccagcgctaccaggacatcgagaaggagagcgagagcgccagcgagctgcacaagctgctgcagcccttcctgctgcggcgggtgaaggccgaggtggccacagagctgcccaagaagacagaggtggtgatctaccacggcatgtctgccctgcagaagaagtactacaaggccatcctgatgaaggacctggatgcctttgaaaatgaaacagccaagaaggtgaagctgcagaacatcctgagccagctgaggaaatgtgtggaccacccctacctgtttgatggagtggagcctgagccctttgaggtgggggaccacctgacagaggccagcggcaagctgcacctgctggacaagctgctggccttcctgtacagcggcggccaccgggtgctgctcttcagccagatgacccagatgctggacatcctgcaggactacatggactaccggggctacagctatgaaagagtggatggctctgtgcggggggaggagcggcacctggccatcaagaactttggccagcagcccatctttgtgttcctgctgagcaccagggctggaggagtgggcatgaacctgacagctgctgacaccgtcatctttgtggacagcgacttcaacccccagaatgacctgcaggccgccgcccgggcccaccgcatcggccagaacaagtctgtgaaggtgatccgcctcatcggccgggacacagtggaggagatcgtgtacaggaaggccgccagcaagctgcagctgaccaacatgatcatcgagggcggccacttcaccctgggcgcccagaagccagctgctgatgctgacctgcagctgtctgagatcctgaagtttggcctggacaagctgctggccagcgagggcagcaccatggatgaaattgacctggagagcatcctgggggagaccaaggatggccagtgggtgtctgatgccctgcctgctgctgagggcggcagccgggaccaggaggagggcaagaaccacatgtacctgtttgagggcaaggactacagcaaggagcccagcaaagaagacaggaagagctttgagcagctggtgaacctgcagaagaccctgctggagaaggccagccaggagggccgcagcctgaggaacaagggctctgtgctgatccctggcctggtggagggcagcaccaagaggaagagggtgctgagccctgaggagctggaggaccggcagaagaagaggcaggaggccgccgccaagagaagaagactcatcgaggagaagaagaggcagaaggaggaggccgagcacaagaagaagatggcctggtgggagagcaacaactaccagagcttctgcctgcccagcgaggagagcgagcctgaggacctggagaatggagaggagagcagcgctgagctggactaccaggaccctgatgccaccagcctgaagtatgtgtctggagatgtgacccacccccaggccggggctgaagatgccctgattgtgcactgtgtggatgattctggccactggggccggggcggcctcttcaccgccctggagaagaggtctgctgagcccaggaagatctatgagctggccggcaagatgaaggacctgagcctgggcggcgtgctgctcttccctgtggatgacaaggagagcagaaataaaggccaggacctgctggccctgattgtggcccagcaccgggacaggagcaatgtgctgagcggcatcaagatggccgccctggaggagggcctgaagaagatcttcctggccgccaagaagaagaaggcctctgtgcacctgcccagaattggacatgccaccaagggcttcaactggtatggaacagagcggctcatcaggaagcacctggccgcccggggcatccccacctacatctactacttccccaggagcaagtctgctgtgctgcacgcccagagcagcagcagcagcagccggcagctggtgccctag

SEQ ID NO: 147517 - DNA, 2082 bp, Artificial Sequence
  Description of Artificial Sequence: Synthetic coding sequence
atggagcgggccggggccaccagccggggcggccaggcccctggcttcctgctgcggctgcacacagagggccgggcagaggccgcccgggtgcaggagcaggacctgcggcagtggggcctgacagccagcgagctgcacaagctgctgcagcccttcctgctgcggcgggtgaaggccgaggtggccacagagctgcccaagaagacagaggtggtgatctaccacggcatgtctgccctgcagaagaagtactacaaggccatcctgatgaaggacctggatgcctttgaaaatgaaacagccaagaaggtgaagctgcagaacatcctgagccagctgaggaaatgtgtggaccacccctacctgtttgatggagtggagcctgagccctttgaggtgggggaccacctgacagaggccagcggcaagctgcacctgctggacaagctgctggccttcctgtacagcggcggccaccgggtgctgctcttcagccagatgacccagatgctggacatcctgcaggactacatggactaccggggctacagctatgaaagagtggatggctctgtgcggggggaggagcggcacctggccatcaagaactttggccagcagcccatctttgtgttcctgctgagcaccagggctggaggagtgggcatgaacctgacagctgctgacaccgtcatctttgtggacagcgacttcaacccccagaatgacctgcaggccgccgcccgggcccaccgcatcggccagaacaagtctgtgaaggtgatccgcctcatcggccgggacacagtggaggagatcgtgtacaggaaggccgccagcaagctgcagctgaccaacatgatcatcgagggcggccacttcaccctgggcgcccagaagccagctgctgatgctgacctgcagctgtctgagatcctgaagtttggcctggacaagctgctggccagcgagggcagcaccatggatgaaattgacctggagagcatcctgggggagaccaaggatggccagtgggtgtctgatgccctgcctgctgctgagggcggcagccgggaccaggaggagggcaagaaccacatgtacctgtttgagggcaaggactacagcaaggagcccagcaaagaagacaggaagagctttgagcagctggtgaacctgcagaagaccctgctggagaaggccagccaggagggccgcagcctgaggaacaagggctctgtgctgatccctggcctggtggagggcagcaccaagaggaagagggtgctgagccctgaggagctggaggaccggcagaagaagaggcaggaggccgccgccaagagaagaagactcatcgaggagaagaagaggcagaaggaggaggccgagcacaagaagaagatggcctggtgggagagcaacaactaccagagcttctgcctgcccagcgaggagagcgagcctgaggacctggagaatggagaggagagcagcgctgagctggactaccaggaccctgatgccaccagcctgaagtatgtgtctggagatgtgacccacccccaggccggggctgaagatgccctgattgtgcactgtgtggatgattctggccactggggccggggcggcctcttcaccgccctggagaagaggtctgctgagcccaggaagatctatgagctggccggcaagatgaaggacctgagcctgggcggcgtgctgctcttccctgtggatgacaaggagagcagaaataaaggccaggacctgctggccctgattgtggcccagcaccgggacaggagcaatgtgctgagcggcatcaagatggccgccctggaggagggcctgaagaagatcttcctggccgccaagaagaagaaggcctctgtgcacctgcccagaattggacatgccaccaagggcttcaactggtatggaacagagcggctcatcaggaagcacctggccgcccggggcatccccacctacatctactacttccccaggagcaagtctgctgtgctgcacgcccagagcagcagcagcagcagccggcagctggtgccctag

SEQ ID NO: 147518 - DNA, 2412 bp, Artificial Sequence
  Description of Artificial Sequence: Synthetic coding sequence
atggagcgggccggggccaccagccggggcggccaggcccctggcttcctgctgcggctgcacacagagggccgggcagaggccgcccgggtgcaggagcaggacctgcggcagtggggcctgaccggcatccacctgcggagctaccagctggagggcgtgaactggctggcccagcgcttccactgccagaatggctgcatcctgggagatgagatgggcctgggcaagacctgccagaccatcgccctcttcatctacctggccggccgcctgaatgatgagggccccttcctgatcctgtgccccctgtctgtgctgagcaactggaaggaggagatgcagagatttgcccctggcctgagctgtgtgacctacgccggggacaaggaggagcgggcctgcctgcagcaggacctgaagcaggagagccgcttccacgtgctgctgaccacctatgagatctgcctgaaggatgccagcttcctgaagagcttcccctggagcgtgctggtggtggatgaggcccaccggctgaagaaccagagcagcctgctgcacaagaccctgtctgagttctctgtggtgttcagcctgctgctgaccggcacccccatccagaacagcctgcaggagctgtacagcctgctgagctttgtggagccagacctcttcagcaaggaggaggtgggggacttcatccagcgctaccaggacatcgagaaggagagcgagagcgccagcgagctgcacaagctgctgcagcccttcctgctgcggcgggtgaaggccgaggtggccacagagctgcccaagaagacagaggtggtgatctaccacggcatgtctgccctgcagaagaagtactacaaggccatcctgatgaaggacctggatgcctttgaaaatgaaacagccaagaaggtgaagctgcagaacatcctgagccagctgaggaaatgtgtggaccacccctacctgtttgatggaggagtgggcatgaacctgacagctgctgacaccgtcatctttgtggacagcgacttcaacccccagaatgacctgcaggccgccgcccgggcccaccgcatcggccagaacaagtctgtgaaggtgatccgcctcatcggccgggacacagtggaggagatcgtgtacaggaaggccgccagcaagctgcagctgaccaacatgatcatcgagggcggccacttcaccctgggcgcccagaagccagctgctgatgctgacctgcagctgtctgagatcctgaagtttggcctggacaagctgctggccagcgagggcagcaccatggatgaaattgacctggagagcatcctgggggagaccaaggatggccagtgggtgtctgatgccctgcctgctgctgagggcggcagccgggaccaggaggagggcaagaaccacatgtacctgtttgagggcaaggactacagcaaggagcccagcaaagaagacaggaagagctttgagcagctggtgaacctgcagaagaccctgctggagaaggccagccaggagggccgcagcctgaggaacaagggctctgtgctgatccctggcctggtggagggcagcaccaagaggaagagggtgctgagccctgaggagctggaggaccggcagaagaagaggcaggaggccgccgccaagagaagaagactcatcgaggagaagaagaggcagaaggaggaggccgagcacaagaagaagatggcctggtgggagagcaacaactaccagagcttctgcctgcccagcgaggagagcgagcctgaggacctggagaatggagaggagagcagcgctgagctggactaccaggaccctgatgccaccagcctgaagtatgtgtctggagatgtgacccacccccaggccggggctgaagatgccctgattgtgcactgtgtggatgattctggccactggggccggggcggcctcttcaccgccctggagaagaggtctgctgagcccaggaagatctatgagctggccggcaagatgaaggacctgagcctgggcggcgtgctgctcttccctgtggatgacaaggagagcagaaataaaggccaggacctgctggccctgattgtggcccagcaccgggacaggagcaatgtgctgagcggcatcaagatggccgccctggaggagggcctgaagaagatcttcctggccgccaagaagaagaaggcctctgtgcacctgcccagaattggacatgccaccaagggcttcaactggtatggaacagagcggctcatcaggaagcacctggccgcccggggcatccccacctacatctactacttccccaggagcaagtctgctgtgctgcacgcccagagcagcagcagcagcagccggcagctggtgccctag

SEQ ID NO: 147519 - DNA, 1305 bp, Artificial Sequence
  Description of Artificial Sequence: Synthetic coding sequence
atggctgtgtcctgggagatgcgctgggcctggggccggcctgccaggtttgcccctggcctgagctgtgtgacctacgccggggacaaggaggagcgggcctgcctgcagcaggacctgaagcaggagagccgcttccacgtgctgctgaccacctatgagatctgcctgaaggatgccagcttcctgaagagcttcccctggagcgtgctggtggtggatgaggcccaccggctgaagaaccagagcagcctgctgcacaagaccctgtctgagttctctgtggtgttcagcctgctgctgaccggcacccccatccagaacagcctgcaggagctgtacagcctgctgagctttgtggagccagacctcttcagcaaggaggaggtgggggacttcatccagcgctaccaggacatcgagaaggagagcgagagcgccagcgagctgcacaagctgctgcagcccttcctgctgcggcgggtgaaggccgaggtggccacagagctgcccaagaagacagaggtggtgatctaccacggcatgtctgccctgcagaagaagtactacaaggccatcctgatgaaggacctggatgcctttgaaaatgaaacagccaagaaggtgaagctgcagaacatcctgagccagctgaggaaatgtgtggaccacccctacctgtttgatggagtggagcctgagccctttgaggtgggggaccacctgacagaggccagcggcaagctgcacctgctggacaagctgctggccttcctgtacagcggcggccaccgggtgctgctcttcagccagatgacccagatgctggacatcctgcaggactacatggactaccggggctacagctatgaaagagtggatggctctgtgcggggggaggagcggcacctggccatcaagaactttggccagcagcccatctttgtgttcctgctgagcaccagggctggaggagtgggcatgaacctgacagctgctgacaccgtcatctttgtggacagcgacttcaacccccagaatgacctgcaggccgccgcccgggcccaccgcatcggccagaacaagtctgtgaaggtgatccgcctcatcggccgggacacagtggaggagatcgtgtacaggaaggccgccagcaagctgcagctgaccaacatgatcatcgagggcggccacttcaccctgggcgcccagaagccagctgctgatgctgacctgcaggtgcgctacagcaacctggtgtggatcaactgctggcccctgcggggggccccctggatgaagtag

SEQ ID NO: 147520 - DNA, 5487 bp, Artificial Sequence
  Description of Artificial Sequence: Synthetic coding sequence
atgatgaggaacaaggacaagagccaggaggaggacagcagcctgcacagcaatgccagcagccacagcgccagcgaggaggccagcggcagtgacagcggcagccagagcgagagcgagcagggcagtgaccccggcagcggccacggcagcgagagcaacagcagcagcgagagcagcgagagccagagcgagagcgagagcgagagcgctggcagcaagagccagcctgtgctgcctgaggccaaggagaagccagccagcaagaaggagagaattgctgatgtgaagaagatgtgggaggagtacccagatgtgtatggagtgcggcgcagcaacagaagccggcaggagcccagccgcttcaacatcaaggaggaggccagcagcggcagcgagagcggcagccccaagagaagaggccagaggcagctgaagaagcaggagaagtggaagcaggagcccagtgaagatgagcaggagcagggcaccagcgctgagagcgagcctgagcagaagaaggtgaaggcccggcggcctgtgcccaggagaacagtgcccaagccccgggtgaagaagcagcccaagacccagaggggcaagaggaagaagcaggacagcagtgatgaagatgatgatgatgatgaggcccccaagaggcagacccggcggcgggccgccaagaatgtgtcctacaaggaggatgatgactttgaaacagacagtgatgacctgattgagatgactggagagggcgtggatgagcagcaggacaacagcgagaccatcgagaaggtgctggacagccggctgggcaagaagggggccactggagccagcaccaccgtgtatgccatcgaggccaatggagaccccagcggggactttgacacagagaaggatgaaggagagatccagtacctgatcaagtggaagggctggagctacatccacagcacctgggagagcgaggagagcctgcagcagcagaaggtgaagggcctgaagaagctggagaacttcaagaagaaggaggatgagatcaagcagtggctgggcaaggtgtccccagaagatgtggagtacttcaactgccagcaggagctggccagcgagctgaacaagcagtaccagatcgtggagcgggtgattgctgtgaagaccagcaagagcaccctgggccagacagacttccctgcccacagcaggaagccagcccccagcaatgaacctgagtacctgtgcaagtggatgggcctgccctacagcgagtgctcctgggaggatgaggccctgattggcaagaagttccagaactgcatcgacagcttccacagcaggaacaacagcaagaccatccccacccgggagtgcaaggccctgaagcagaggcccaggtttgtggccctgaagaagcagcctgcctacctgggcggggagaacctggagctgcgggactaccagctggagggcctgaactggctggcccacagctggtgcaagaacaacagcgtcatcctggctgatgagatgggcctgggcaagaccatccagaccatctccttcctgagctacctgttccaccagcaccagctgtatggccccttcctgattgtggtgcccctgagcaccctgacctcctggcagcgggagtttgagatctgggcccctgagatcaacgtggtggtgtacatcggggacctgatgagcaggaacaccatccgggagtatgagtggatccacagccagaccaagaggctgaagttcaatgccctgatcaccacctatgagatcctgctgaaggacaagacagtgctgggcagcatcaactgggccttcctgggcgtggatgaggcccaccggctgaagaatgatgacagcctgctgtacaagaccctgattgacttcaagagcaaccaccggctgctgatcaccggcacccccctgcagaacagcctgaaggagctgtggagcctgctgcacttcatcatgcctgagaagtttgagttctgggaggactttgaggaggaccacggcaagggcagagaaaatggctaccagagcctgcacaaggtgctggagcccttcctgctgcggcgggtgaagaaggatgtggagaagagcctgcctgccaaggtggagcagatcctgcgggtggagatgtctgccctgcagaagcagtactacaagtggatcctgaccaggaactacaaggccctggccaagggcacccggggcagcaccagcggcttcctgaacatcgtgatggagctgaagaagtgctgcaaccactgctacctgatcaagcccccagaagaaaatgaaagagaaaatggccaggagatcctgctgagcctcatccgcagcagcggcaagctgatcctgctggacaagctgctgacccggctgcgggagcggggcaacagagtgctgatcttcagccagatggtgaggatgctggacatcctggccgagtacctgaccatcaagcactaccccttccagaggctggatggcagcatcaagggggagatcaggaagcaggccctggaccacttcaatgctgatggcagcgaggacttctgcttcctgctgagcaccagggctgggggcctgggcatcaacctggccagcgctgacacagtggtgatctttgacagcgactggaacccccagaatgacctgcaggcccaggcccgggcccaccgcatcggccagaagaagcaggtgaacatctaccgcctggtgaccaagggcaccgtggaggaggagatcatcgagcgggccaagaagaagatggtgctggaccacctggtgatccagaggatggacaccaccggccgcaccatcctggagaacaacagcggccgcagcaacagcaaccccttcaacaaggaggagctgacagccatcctgaagtttggagcagaagatctcttcaaggagctggagggggaggagagcgagccccaggagatggacattgatgagatcctgcggctggccgagacccgggagaatgaggtgtccaccagcgccacagatgagctgctgagccagttcaaggtggccaactttgccaccatggaggatgaggaggagctggaggagcggccccacaaggactgggatgagatcatccctgaggagcagaggaagaaggtggaggaggaggagcggcagaaggagctggaggagatctacatgctgccccgcatccgcagcagcaccaagaaggcccagaccaatgacagcgacagcgacacagagagcaagaggcaggcccagaggagcagcgccagcgagagcgagacagaggacagtgatgatgacaagaagcccaagaggcggggccggcccaggtctgtgaggaaggacctggtggagggcttcacagatgctgagatccgccgcttcatcaaggcctacaagaagtttggcctgcccctggagcggctggagtgcatcgccagagatgctgagctggtggacaagtctgtggccgacctgaagaggctgggggagctgatccacaacagctgtgtgtctgccatgcaggagtatgaggagcagctgaaggaaaatgccagcgagggcaagggccctgggaagagaagaggccccaccatcaagatctctggagtgcaggtgaatgtgaagagcatcatccagcacgaggaggagtttgagatgctgcacaagagcatccctgtggaccctgaggagaagaagaagtactgcctgacctgccgggtgaaggccgcccactttgatgtggagtggggcgtggaggatgacagccggctgctgctgggcatctatgagcacggctacggcaactgggagctgatcaagacagatcctgagctgaagctgacagacaagatcctgcctgtggagacagacaagaagccccagggcaagcagctgcagaccagggctgactacctgctgaagctgctgaggaagggcctggagaagaagggagctgtgactggaggagaggaggccaagctgaagaagaggaagccccgggtgaagaaggagaacaaggtgccccggctgaaggaggagcacggcatcgagctgagcagccccaggcacagcgacaaccccagcgaggagggggaggtgaaggatgatggcctggagaagagccccatgaagaagaagcagaagaagaaggagaacaaggagaacaaggagaagcagatgagcagcaggaaggacaaggagggggacaaggagaggaagaagagcaaggacaagaaggagaagcccaagtctggagatgccaagagcagcagcaagagcaagaggagccagggccctgtgcacatcacagctggcagcgagcctgtgcccatcggggaggatgaagatgatgacctggaccaggagaccttcagcatctgcaaggagaggatgaggcctgtgaagaaggccctgaagcagctggacaagccagacaagggcctgaatgtgcaggagcagctggagcacaccaggaactgcctgctgaagattggagacagaattgctgaatgtctgaaggcctacagcgaccaggagcacatcaagctgtggaggaggaacctgtggatctttgtgtccaagttcacagaatttgatgccaggaagctgcacaagctgtacaagatggcccacaagaagaggagccaggaggaggaggagcagaagaagaaggatgatgtgactggaggcaagaagcccttccggcctgaggccagcggcagcagccgggacagcctcatcagccagagccacaccagccacaacctgcacccccagaagccccacctgcctgccagccacggcccccagatgcacggccacccccgggacaactacaaccaccccaacaagaggcacttcagcaatgctgacagaggagactggcagcgggagaggaagttcaactacggcggcggcaacaacaaccccccctggggcagtgacagacaccaccagtatgagcagcactggtacaaggaccaccactatggagaccggcggcacatggatgcccacaggagcggcagctaccggcccaacaacatgagcaggaagaggccctatgaccagtacagcagtgaccgggaccaccggggccaccgggactactatgacagacaccaccacgacagcaagagaagaagaagtgatgagttccggccccagaactaccaccagcaggacttccggaggatgtctgaccacaggcctgccatgggctaccacggccagggccccagcgaccactaccgctccttccacacagacaagctgggggagtacaagcagcccctgccccccctgcaccctgctgtgtctgaccccaggagcccccccagccagaagagcccccatgacagcaagagccccctggaccacaggagccccctggagaggagcctggagcagaagaacaacccagactacaactggaatgtgaggaagacctag

SEQ ID NO: 147521 - DNA, 1506 bp, Artificial Sequence
  Description of Artificial Sequence: Synthetic coding sequence
atgatgaggaacaaggacaagagccaggaggaggacagcagcctgcacagcaatgccagcagccacagcgccagcgaggaggccagcggcagtgacagcggcagccagagcgagagcgagcagggcagtgaccccggcagcggccacggcagcgagagcaacagcagcagcgagagcagcgagagccagagcgagagcgagagcgagagcgctggcagcaagagccagcctgtgctgcctgaggccaaggagaagccagccagcaagaaggagagaattgctgatgtgaagaagatgtgggaggagtacccagatgtgtatggagtgcggcgcagcaacagaagccggcaggagcccagccgcttcaacatcaaggaggaggccagcagcggcagcgagagcggcagccccaagagaagaggccagaggcagctgaagaagcaggagaagtggaagcaggagcccagtgaagatgagcaggagcagggcaccagcgctgagagcgagcctgagcagaagaaggtgaaggcccggcggcctgtgcccaggagaacagtgcccaagccccgggtgaagaagcagcccaagacccagaggggcaagaggaagaagcaggacagcagtgatgaagatgatgatgatgatgaggcccccaagaggcagacccggcggcgggccgccaagaatgtgtcctacaaggaggatgatgactttgaaacagacagtgatgacctgattgagatgactggagagggcgtggatgagcagcaggacaacagcgagaccatcgagaaggtgctggacagccggctgggcaagaagggggccactggagccagcaccaccgtgtatgccatcgaggccaatggagaccccagcggggactttgacacagagaaggatgaaggagagatccagtacctgatcaagtggaagggctggagctacatccacagcacctgggagagcgaggagagcctgcagcagcagaaggtgaagggcctgaagaagctggagaacttcaagaagaaggaggatgagatcaagcagtggctgggcaaggtgtccccagaagatgtggagtacttcaactgccagcaggagctggccagcgagctgaacaagcagtaccagatcgtggagcgggtgattgctgtgaagaccagcaagagcaccctgggccagacagacttccctgcccacagcaggaagccagcccccagcaatgaacctgagtacctgtgcaagtggatgggcctgccctacagcgagtgctcctgggaggatgaggccctgattggcaagaagttccagaactgcatcgacagcttccacagcaggaacaacagcaagaccatccccacccgggagtgcaaggccctgaagcagaggcccaggtttgtggccctgaagaagcagcctgcctacctgggcggggagaacctggagctgcgggactaccagctggagggcctgaactggctggcccacagctggtgcaagtag

SEQ ID NO: 147522 - DNA, 1545 bp, Artificial Sequence
  Description of Artificial Sequence: Synthetic coding sequence
atggcccacaagcagcgggaggactacctgaacctgagcccctgtgtgttcacctggtaccgcaccttcagccagctggcctttgatggagagaagctgagccacagcgccagcgaggaggccagcggcagtgacagcggcagccagagcgagagcgagcagggcagtgaccccggcagcggccacggcagcgagagcaacagcagcagcgagagcagcgagagccagagcgagagcgagagcgagagcgctggcagcaagagccagcctgtgctgcctgaggccaaggagaagccagccagcaagaaggagagaattgctgatgtgaagaagatgtgggaggagtacccagatgtgtatggagtgagaagaagcaacagaagccggcaggagcccagccgcttcaacatcaaggaggaggccagcagcggcagcgagagcggcagccccaagaggcggggccagaggcagctgaagaagcaggagaagtggaagcaggagcccagtgaagatgagcaggagcagggcaccagcgctgagagcgagcctgagcagaagaaggtgaaggcccggcggcctgtgcccaggagaacagtgcccaagccccgggtgaagaagcagcccaagacccagaggggcaagaggaagaagcaggacagcagtgatgaagatgatgatgatgatgaggcccccaagaggcagaccaggagaagagctgccaagaatgtgtcctacaaggaggatgatgactttgaaacagacagtgatgacctgattgagatgaccggggagggcgtggatgagcagcaggacaacagcgagaccatcgagaaggtgctggacagccggctgggcaagaagggggccaccggggccagcaccaccgtgtatgccatcgaggccaacggggaccccagcggggactttgacacagagaaggatgaaggagagatccagtacctgatcaagtggaagggctggagctacatccacagcacctgggagagcgaggagagcctgcagcagcagaaggtgaagggcctgaagaagctggagaacttcaagaagaaggaggatgagatcaagcagtggctgggcaaggtgtccccagaagatgtggagtacttcaactgccagcaggagctggccagcgagctgaacaagcagtaccagatcgtggagcgggtgattgctgtgaagaccagcaagagcaccctgggccagacagacttccctgcccacagcaggaagccagcccccagcaatgaacctgagtacctgtgcaagtggatgggcctgccctacagtgaatgttcctgggaggatgaggccctgattggcaagaagttccagaactgcatcgacagcttccacagcaggaacaacagcaagaccatccccacccgggagtgcaaggccctgaagcagaggcccaggtttgtggccctgaagaagcagcctgcctacctgggcggggagaacctggagctgcgggactaccagctggagggcctgaactggctggcccacagctggtgcaagtag

SEQ ID NO: 147523 - DNA, 552 bp, Artificial Sequence
  Description of Artificial Sequence: Synthetic coding sequence
atgatgaggaacaaggacaagagccaggaggaggacagcagcctgcacagcaatgccagcagccacagcgccagcgaggaggccagcggcagtgacagcggcagccagagcgagagcgagcagggcagtgaccccggcagcggccacggcagcgagagcaacagcagcagcgagagcagcgagagccagagcgagagcgagagcgagagcgctggcagcaagagccagcctgtgctgcctgaggccaaggagaagccagccagcaagaaggagagaattgctgatgtgaagaagatgtgggaggagtacccagatgtgtatggagtgcggcgcagcaacagaagccggcaggagcccagccgcttcaacatcaaggaggaggccagcagcggcagcgagagcggcagccccaagagaagaggccagaggcagctgaagaagcaggagaagtggaagcaggagcccagtgaagatgagcaggagcagggcaccagcgctgagagcgagcctgagcagaagaaggtgaaggcccggcggcctgtgcccaggtag

SEQ ID NO: 147524 - DNA, 5220 bp, Artificial Sequence
  Description of Artificial Sequence: Synthetic coding sequence
atgatgaggaacaaggacaagagccaggaggaggacagcagcctgcacagcaatgccagcagccacagcgccagcgaggaggccagcggcagtgacagcggcagccagagcgagagcgagcagggcagtgaccccggcagcggccacggcagcgagagcaacagcagcagcgagagcagcgagagccagagcgagagcgagagcgagagcgctggcagcaagagccagcctgtgctgcctgaggccaaggagaagccagccagcaagaaggagagaattgctgatgtgaagaagatgtgggaggagtacccagatgtgtatggagtgcggcgcagcaacagaagccggcaggagcccagccgcttcaacatcaaggaggaggccagcagcggcagcgagagcggcagccccaagagaagaggccagaggcagctgaagaagcaggagaagtggaagcaggagcccagtgaagatgagcaggagcagggcaccagcgctgagagcgagcctgagcagaagaaggtgaaggcccggcggcctgtgcccaggagaacagtgcccaagccccgggtgaagaagcagcccaagacccagaggggcaagaggaagaagcaggacagcagtgatgaagatgatgatgatgatgaggcccccaagaggcagacccggcggcgggccgccaagaatgtgtcctacaaggaggatgatgactttgaaacagacagtgatgacctgattgagatgactggagagggcgtggatgagcagcaggacaacagcgagaccatcgagaaggtgctggacagccggctgggcaagaagggggccactggagccagcaccaccgtgtatgccatcgaggccaatggagaccccagcggggactttgacacagagaaggatgaaggagagatccagtacctgatcaagtggaagggctggagctacatccacagcacctgggagagcgaggagagcctgcagcagcagaaggtgaagggcctgaagaagctggagaacttcaagaagaaggaggatgagatcaagcagtggctgggcaaggtgtccccagaagatgtggagtacttcaactgccagcaggagctggccagcgagctgaacaagcagtaccagatcgtggagcgggtgattgctgtgaagaccagcaagagcaccctgggccagacagacttccctgcccacagcaggaagccagcccccagcaatgaacctgagtacctgtgcaagtggatgggcctgccctacagcgagtgctcctgggaggatgaggccctgattggcaagaagttccagaactgcatcgacagcttccacagcaggaacaacagcaagaccatccccacccgggagtgcaaggccctgaagcagaggcccaggtttgtggccctgaagaagcagcctgcctacctgggcggggagaacctggagctgcgggactaccagctggagggcctgaactggctggcccacagctggtgcaagaacaacagcgtcatcctggctgatgagatgggcctgggcaagaccatccagaccatctccttcctgagctacctgttccaccagcaccagctgtatggccccttcctgattgtggtgcccctgagcaccctgacctcctggcagcgggagtttgagatctgggcccctgagatcaacgtggtggtgtacatcggggacctgatgagcaggaacaccatccgggagtatgagtggatccacagccagaccaagaggctgaagttcaatgccctgatcaccacctatgagatcctgctgaaggacaagacagtgctgggcagcatcaactgggccttcctgggcgtggatgaggcccaccggctgaagaatgatgacagcctgctgtacaagaccctgattgacttcaagagcaaccaccggctgctgatcaccggcacccccctgcagaacagcctgaaggagctgtggagcctgctgcacttcatcatgcctgagaagtttgagttctgggaggactttgaggaggaccacggcaagggcagagaaaatggctaccagagcctgcacaaggtgctggagcccttcctgctgcggcgggtgaagaaggatgtggagaagagcctgcctgccaaggtggagcagatcctgcgggtggagatgtctgccctgcagaagcagtactacaagtggatcctgaccaggaactacaaggccctggccaagggcacccggggcagcaccagcggcttcctgaacatcgtgatggagctgaagaagtgctgcaaccactgctacctgatcaagcccccagaagaaaatgaaagagaaaatggccaggagatcctgctgagcctcatccgcagcagcggcaagctgatcctgctggacaagctgctgacccggctgcgggagcggggcaacagagtgctgatcttcagccagatggtgaggatgctggacatcctggccgagtacctgaccatcaagcactaccccttccagaggctggatggcagcatcaagggggagatcaggaagcaggccctggaccacttcaatgctgatggcagcgaggacttctgcttcctgctgagcaccagggctgggggcctgggcatcaacctggccagcgctgacacagtggtgatctttgacagcgactggaacccccagaatgacctgcaggcccaggcccgggcccaccgcatcggccagaagaagcaggtgaacatctaccgcctggtgaccaagggcaccgtggaggaggagatcatcgagcgggccaagaagaagatggtgctggaccacctggtgatccagaggatggacaccaccggccgcaccatcctggagaacaacagcggccgcagcaacagcaaccccttcaacaaggaggagctgacagccatcctgaagtttggagcagaagatctcttcaaggagctggagggggaggagagcgagccccaggagatggacattgatgagatcctgcggctggccgagacccgggagaatgaggtgtccaccagcgccacagatgagctgctgagccagttcaaggtggccaactttgccaccatggaggatgaggaggagctggaggagcggccccacaaggactgggatgagatcatccctgaggagcagaggaagaaggtggaggaggaggagcggcagaaggagctggaggagatctacatgctgccccgcatccgcagcagcaccaagaaggcccagaccaatgacagcgacagcgacacagagagcaagaggcaggcccagaggagcagcgccagcgagagcgagacagaggacagtgatgatgacaagaagcccaagaggcggggccggcccaggtctgtgaggaaggacctggtggagggcttcacagatgctgagatccgccgcttcatcaaggcctacaagaagtttggcctgcccctggagcggctggagtgcatcgccagagatgctgagctggtggacaagtctgtggccgacctgaagaggctgggggagctgatccacaacagctgtgtgtctgccatgcaggagtatgaggagcagctgaaggaaaatgccagcgagggcaagggccctgggaagagaagaggccccaccatcaagatctctggagtgcaggtgaatgtgaagagcatcatccagcacgaggaggagtttgagatgctgcacaagagcatccctgtggaccctgaggagaagaagaagtactgcctgacctgccgggtgaaggccgcccactttgatgtggagtggggcgtggaggatgacagccggctgctgctgggcatctatgagcacggctacggcaactgggagctgatcaagacagatcctgagctgaagctgacagacaagatcctgcctgtggagacagacaagaagccccagggcaagcagctgcagaccagggctgactacctgctgaagctgctgaggaagggcctggagaagaagggagctgtgactggaggagaggaggccaagctgaagaagaggaagccccgggtgaagaaggagaacaaggtgccccggctgaaggaggagcacggcatcgagctgagcagccccaggcacagcgacaaccccagcgaggagggggaggtgaaggatgatggcctggagaagagccccatgaagaagaagcagaagaagaaggagaacaaggagaacaaggagaagcagatgagcagcaggaaggacaaggagggggacaaggagaggaagaagagcaaggacaagaaggagaagcccaagtctggagatgccaagagcagcagcaagagcaagaggagccagggccctgtgcacatcacagctggcagcgagcctgtgcccatcggggaggatgaagatgatgacctggaccaggagaccttcagcatctgcaaggagaggatgaggcctgtgaagaaggccctgaagcagctggacaagccagacaagggcctgaatgtgcaggagcagctggagcacaccaggaactgcctgctgaagattggagacagaattgctgaatgtctgaaggcctacagcgaccaggagcacatcaagctgtggaggaggaacctgtggatctttgtgtccaagttcacagaatttgatgccaggaagctgcacaagctgtacaagatggcccacaagaagaggagccaggaggaggaggagcagaagaagaaggatgatgtgactggaggcaagaagcccttccggcctgaggccagcggcagcagccgggacagcctcatcagccagagccacaccagccacaacctgcacccccagaagccccacctgcctgccagccacggcccccagatgcacggccacccccgggacaactacaaccaccccaacaagaggcacttcagcaatgctgacagaggagactggcagcgggagaggaagttcaactacggcggcggcaacaacaaccccccctggggcagtgacagacaccaccagtatgagcagcactggtacaaggaccaccactatggagaccggcggcacatggatgcccacaggagcggcagctaccggcccaacaacatgagcaggaagaggccctatgaccagtacagcagtgaccgggaccaccggggccaccgggactactatgacagatatgccaagggctgtgagacccctggggccaacctgtgccaggagctgttcctgggcaggaagtag

SEQ ID NO: 147525 - DNA, 6003 bp, Artificial Sequence
  Description of Artificial Sequence: Synthetic coding sequence
atgaaggctgctgacaccgtcatcctgtgggcccggagcaagaatgaccagctgcgcatctccttccccccaggcctgtgctggggagacaggatgccagacaaggatgacatccggctgctgcccagcgccctgggcgtgaagaagaggaagaggggccccaagaagcagaaggagaacaagccaggcaagcccaggaagaggaagaagagggacagcgaggaggagtttggaagtgaaagagatgagtaccgggagaagtctgagagcggcggctctgaatatggaactggacctggcaggaagagaagaaggaagcaccgggagaagaaggagaagaagaccaagaggaggaagaagggggagggagatggcggccagaagcaggtggagcagaagagcagcgccaccctgctgctgacctggggcctggaggatgtggagcacgtgttcagcgaggaggactaccacaccctgaccaactacaaggccttcagccagttcatgaggcccctgattgccaagaagaaccccaagatccccatgagcaagatgatgaccatcctgggcgccaagtggagggagttcagcgccaacaaccccttcaagggcagcgctgctgctgtggccgctgctgctgctgctgctgctgctgctgtggccgagcaggtgtctgctgctgtgagcagcgccacccccatcgcccccagcggccccccagccctgcccccacctcctgctgctgacatccagcccccacccatccggcgggccaagaccaaggagggcaagggccctggccacaagaggaggagcaagagcccccgggtgcctgatggcaggaagaagctgcggggcaagaagatggcccccctgaagatcaagctgggcctgctgggcggcaagaggaagaagggcggcagctatgtgttccagagtgatgagggccctgagcctgaggccgaggagagtgacctggacagcggctctgtgcacagcgccagcggccgcccagatggccctgtgaggaccaagaagctgaagaggggccggcccggcaggaagaagaagaaggtgctgggctgcccagctgtggccggggaggaggaggtggatggctatgaaacagaccaccaggactactgtgaggtgtgccagcagggcggggagatcatcctgtgtgacacctgcccccgggcctaccacctggtgtgcctggaccctgagctggaccgggcccctgagggcaagtggagctgcccccactgtgagaaggagggcgtgcagtgggaggccaaggaggaggaggaggagtatgaggaggagggggaggaggagggggagaaggaggaggaggatgaccacatggagtactgccgggtgtgcaaggatggaggagagctgctgtgctgtgatgcctgcatcagcagctaccacatccactgcctgaacccccccctgcctgacatccccaacggggagtggctgtgcccccgctgcacctgccctgtgctgaagggccgggtgcagaagatcctgcactggcgctggggcgagccccctgtggccgtgcctgccccccagcaggctgatggcaacccagatgtgcccccaccccggcccctgcagggccgctctgagcgggagttctttgtgaagtgggtgggcctgagctactggcactgctcctgggccaaggagctgcagctggagatcttccacctggtgatgtacagaaactaccagaggaagaatgacatggatgagcccccacccctggactatggcagcggagaagatgatggcaagagtgacaagaggaaggtgaaggacccccactatgcagagatggaggagaagtactaccgcttcggcatcaagccagagtggatgacagtgcaccgcatcatcaaccacagcgtggacaagaagggcaactaccactacctggtgaagtggagggacctgccctatgaccagagcacctgggaggaggatgagatgaacatcccagaatatgaggagcacaagcagagctactggaggcaccgggagctgatcatgggagaggaccctgcccagcccaggaagtacaagaagaagaagaaggagctgcagggagatggcccccccagcagccccaccaatgaccccaccgtgaagtatgagacccagccccgcttcatcacagccaccggcggcaccctgcacatgtaccagctggagggcctgaactggctgcgcttctcctgggcccagggcacagacaccatcctggctgatgagatgggcctgggcaagaccatccagaccatcgtgttcctgtacagcctgtacaaggagggccacaccaagggccccttcctggtgtctgcccccctgagcaccatcatcaactgggagcgggagttccagatgtgggcccccaagttctacgtggtgacctacacaggagacaaggacagccgggccatcatccgggagaatgagttctcctttgaggacaatgccatcaagggcggcaagaaggccttcaagatgaagcgggaggcccaggtgaagttccacgtgctgctgaccagctatgagctgatcaccatcgaccaggccgccctgggcagcatccgctgggcctgcctggtggtggatgaggcccaccggctgaagaacaaccagagcaagttcttccgggtgctgaatggctacaagattgaccacaagctgctgctgaccggcacccccctgcagaacaacctggaggagctgttccacctgctgaacttcctgaccccagagcgcttcaacaacctggagggcttcctggaggagtttgctgacatcagcaaggaggaccagatcaagaagctgcatgacctgctgggcccccacatgctgcggcggctgaaggcagatgtgttcaagaacatgcctgccaagacagagctgattgtgcgggtggagctgagccccatgcagaagaagtactacaagtacatcctgaccaggaactttgaggccctgaacagcagaggaggcggcaaccaggtgtccctgctgaacatcatgatggacctgaagaagtgctgcaaccacccctacctgtttcctgtggccgccatggagagccccaagctgcccagcggggcctatgagggcggggccctgatcaagagcagcggcaagctgatgctgctgcagaagatgctgaggaagctgaaggagcagggccaccgggtgctgatcttcagccagatgaccaagatgctggacctgctggaggacttcctggactatgagggctacaagtatgaaagaattgatggcggcatcactggagccctgcggcaggaggccatcgaccgcttcaatgcccctggggcccagcagttctgcttcctgctgagcacccgggccggcggcctgggcatcaacctggccacagctgacaccgtcatcatctttgacagcgactggaacccccacaatgacatccaggccttcagccgggcccacagaattggccaggccaacaaggtgatgatctacagatttgtgacccgggcctctgtggaggagcgcatcacccaggtggccaagaggaagatgatgctgacccacctggtggtgcggcccggcctgggcagcaaggccggctccatgagcaagcaggagctggatgacatcctgaagtttggaacagaggagctgttcaaggatgaaaatgaaggagagaacaaggaggaggacagcagcgtcatccactatgacaatgaggccatcgcccggctgctggacaggaaccaggatgccacagaggacacagatgtgcagaacatgaatgagtacctgagcagcttcaaggtggcccagtatgtggtgcgggaggaggacaagattgaggagattgaaagagagatcatcaagcaggaggagaatgtggaccctgactactgggagaagctgctgcggcaccactatgagcagcagcaggaggacctggccaggaacctgggcaagggcaagagggtgaggaagcaggtgaactacaatgatgctgcccaggaggaccaggacaaccagagcgagtacagcgtgggcagcgaggaggaggatgaggactttgatgagaggcctgagggccggcggcagagcaagaggcagctgagaaatgagaaggacaagcccctgccccccctgctggcccgggtgggcggcaacatcgaggtgctgggcttcaacacccggcagaggaaggccttcctgaatgctgtgatgcgctggggcatgccaccccaggatgccttcaccacccagtggctggtgcgggacctgcggggcaagacagagaaggagttcaaggcctacgtgtccctcttcatgaggcacctgtgtgagcccggggctgatggcagcgagacctttgctgatggagtgccccgggagggcctgagccggcagcaggtgctgacccgcatcggcgtgatgagcctggtgaagaagaaggtgcaggagtttgagcacatcaatggccgctggagcatgcctgagctgatgccagaccccagcgctgacagcaagaggagcagccgggccagcagccccaccaagaccagccccaccaccccagaggccagcgccaccaacagcccctgcaccagcaagccagccaccccagcccccagcgagaagggggagggcatccgcacccccctggagaaggaggaggccgagaaccaggaggagaagccagagaagaacagcagaattggagagaagatggagacagaagcagatgcccccagccctgcccccagcctgggggagcggctggagcccaggaagatccccctggaggatgaggtgcctggggtgcctggagagatggagcctgagcccggctacagaggagaccgggagaagagcgccacagagagcaccccaggagagcggggggaggagaagcccctggatggccaggagcaccgggagaggcctgagggggagactggagacctgggcaagcgggaggatgtgaagggggaccgggagctgcggcccggccccagagatgagcccaggagcaatggaagaagagaggagaagacagagaagccccgcttcatgttcaacattgctgatggcggcttcacagagctgcacaccctgtggcagaatgaggagagagctgccatcagcagcggcaagctgaatgagatctggcacagaagacatgactactggctgctggccggcatcgtgctgcacggctacgcccgctggcaggacatccagaatgatgcccagtttgccatcatcaatgagcccttcaagacagaggccaacaagggcaacttcctggagatgaagaacaagttcctggcccggcgcttcaagctgctggagcaggccctggtgattgaggagcagctgcggcgggccgcctacctgaacctgagccaggagcccgcccacccagccatggccctgcacgccaggtttgctgaggctgaatgtctggccgagagccaccagcacctgagcaaggagagcctggccggcaacaagccagccaatgctgtgctgcacaaggtgctgaaccagctggaggagctgctgagtgacatgaaggcagatgtgacccggctgcctgccaccctgagccgcatcccccccatcgccgcccggctgcagatgtctgagaggagcatcctgagccggctggccagcaagggcacagagccccaccccaccccagcctacccacctggcccctatgccaccccacctggctatggagctgccttctctgctgcccctgtgggcgccctggccgccgccggggccaactacagccagatgcctgctggcagcttcatcacagctgccaccaacggcccccctgtgctggtgaagaaggagaaggagatggtgggcgccctggtgtctgatggcctggacaggaaggagccccgggccggggaggtgatctgcattgatgactag

SEQ ID NO: 147526 - DNA, 5901 bp, Artificial Sequence
  Description of Artificial Sequence: Synthetic coding sequence
atgaaggctgctgacaccgtcatcctgtgggcccggagcaagaatgaccagctgcgcatctccttccccccaggcctgtgctggggagacaggatgccagacaaggatgacatccggctgctgcccagcgccctgggcgtgaagaagaggaagaggggccccaagaagcagaaggagaacaagccaggcaagcccaggaagaggaagaagagggacagcgaggaggagtttggaagtgaaagagatgagtaccgggagaagtctgagagcggcggctctgaatatggaactggacctggcaggaagagaagaaggaagcaccgggagaagaaggagaagaagaccaagaggaggaagaagggggagggagatggcggccagaagcaggtggagcagaagagcagcgccaccctgctgctgacctggggcctggaggatgtggagcacgtgttcagcgaggaggactaccacaccctgaccaactacaaggccttcagccagttcatgaggcccctgattgccaagaagaaccccaagatccccatgagcaagatgatgaccatcctgggcgccaagtggagggagttcagcgccaacaaccccttcaagggcagcgctgctgctgtggccgctgctgctgctgctgctgctgctgctgtggccgagcaggtgtctgctgctgtgagcagcgccacccccatcgcccccagcggccccccagccctgcccccacctcctgctgctgacatccagcccccacccatccggcgggccaagaccaaggagggcaagggccctggccacaagaggaggagcaagagcccccgggtgcctgatggcaggaagaagctgcggggcaagaagatggcccccctgaagatcaagctgggcctgctgggcggcaagaggaagaagggcggcagctatgtgttccagagtgatgagggccctgagcctgaggccgaggagagtgacctggacagcggctctgtgcacagcgccagcggccgcccagatggccctgtgaggaccaagaagctgaagaggggccggcccggcaggaagaagaagaaggtgctgggctgcccagctgtggccggggaggaggaggtggatggctatgaaacagaccaccaggactactgtgaggtgtgccagcagggcggggagatcatcctgtgtgacacctgcccccgggcctaccacctggtgtgcctggaccctgagctggaccgggcccctgagggcaagtggagctgcccccactgtgagaaggagggcgtgcagtgggaggccaaggaggaggaggaggagtatgaggaggagggggaggaggagggggagaaggaggaggaggatgaccacatggagtactgccgggtgtgcaaggatggaggagagctgctgtgctgtgatgcctgcatcagcagctaccacatccactgcctgaacccccccctgcctgacatccccaacggggagtggctgtgcccccgctgcacctgccctgtgctgaagggccgggtgcagaagatcctgcactggcgctggggcgagccccctgtggccgtgcctgccccccagcaggctgatggcaacccagatgtgcccccaccccggcccctgcagggccgctctgagcgggagttctttgtgaagtgggtgggcctgagctactggcactgctcctgggccaaggagctgcagctggagatcttccacctggtgatgtacagaaactaccagaggaagaatgacatggatgagcccccacccctggactatggcagcggagaagatgatggcaagagtgacaagaggaaggtgaaggacccccactatgcagagatggaggagaagtactaccgcttcggcatcaagccagagtggatgacagtgcaccgcatcatcaaccacagcgtggacaagaagggcaactaccactacctggtgaagtggagggacctgccctatgaccagagcacctgggaggaggatgagatgaacatcccagaatatgaggagcacaagcagagctactggaggcaccgggagctgatcatgggagaggaccctgcccagcccaggaagtacaagaagaagaagaaggagctgcagggagatggcccccccagcagccccaccaatgaccccaccgtgaagtatgagacccagccccgcttcatcacagccaccggcggcaccctgcacatgtaccagctggagggcctgaactggctgcgcttctcctgggcccagggcacagacaccatcctggctgatgagatgggcctgggcaagaccatccagaccatcgtgttcctgtacagcctgtacaaggagggccacaccaagggccccttcctggtgtctgcccccctgagcaccatcatcaactgggagcgggagttccagatgtgggcccccaagttctacgtggtgacctacacaggagacaaggacagccgggccatcatccgggagaatgagttctcctttgaggacaatgccatcaagggcggcaagaaggccttcaagatgaagcgggaggcccaggtgaagttccacgtgctgctgaccagctatgagctgatcaccatcgaccaggccgccctgggcagcatccgctgggcctgcctggtggtggatgaggcccaccggctgaagaacaaccagagcaagttcttccgggtgctgaatggctacaagattgaccacaagctgctgctgaccggcacccccctgcagaacaacctggaggagctgttccacctgctgaacttcctgaccccagagcgcttcaacaacctggagggcttcctggaggagtttgctgacatcagcaaggaggaccagatcaagaagctgcatgacctgctgggcccccacatgctgcggcggctgaaggcagatgtgttcaagaacatgcctgccaagacagagctgattgtgcgggtggagctgagccccatgcagaagaagtactacaagtacatcctgaccaggaactttgaggccctgaacagcagaggaggcggcaaccaggtgtccctgctgaacatcatgatggacctgaagaagtgctgcaaccacccctacctgtttcctgtggccgccatggagagccccaagctgcccagcggggcctatgagggcggggccctgatcaagagcagcggcaagctgatgctgctgcagaagatgctgaggaagctgaaggagcagggccaccgggtgctgatcttcagccagatgaccaagatgctggacctgctggaggacttcctggactatgagggctacaagtatgaaagaattgatggcggcatcactggagccctgcggcaggaggccatcgaccgcttcaatgcccctggggcccagcagttctgcttcctgctgagcacccgggccggcggcctgggcatcaacctggccacagctgacaccgtcatcatctttgacagcgactggaacccccacaatgacatccaggccttcagccgggcccacagaattggccaggccaacaaggtgatgatctacagatttgtgacccgggcctctgtggaggagcgcatcacccaggtggccaagaggaagatgatgctgacccacctggtggtgcggcccggcctgggcagcaaggccggctccatgagcaagcaggagctggatgacatcctgaagtttggaacagaggagctgttcaaggatgaaaatgaaggagagaacaaggaggaggacagcagcgtcatccactatgacaatgaggccatcgcccggctgctggacaggaaccaggatgccacagaggacacagatgtgcagaacatgaatgagtacctgagcagcttcaaggtggcccagtatgtggtgcgggaggaggacaagattgaggagattgaaagagagatcatcaagcaggaggagaatgtggaccctgactactgggagaagctgctgcggcaccactatgagcagcagcaggaggacctggccaggaacctgggcaagggcaagagggtgaggaagcaggtgaactacaatgatgctgcccaggaggaccaggacaaccagagcgagtacagcgtgggcagcgaggaggaggatgaggactttgatgagaggcctgagggccggcggcagagcaagaggcagctgagaaatgagaaggacaagcccctgccccccctgctggcccgggtgggcggcaacatcgaggtgctgggcttcaacacccggcagaggaaggccttcctgaatgctgtgatgcgctggggcatgccaccccaggatgccttcaccacccagtggctggtgcgggacctgcggggcaagacagagaaggagttcaaggcctacgtgtccctcttcatgaggcacctgtgtgagcccggggctgatggcagcgagacctttgctgatggagtgccccgggagggcctgagccggcagcaggtgctgacccgcatcggcgtgatgagcctggtgaagaagaaggtgcaggagtttgagcacatcaatggccgctggagcatgcctgagctgatgccagaccccagcgctgacagcaagaggagcagccgggccagcagccccaccaagaccagccccaccaccccagaggccagcgccaccaacagcccctgcaccagcaagccagccaccccagcccccagcgagaagggggagggcatccgcacccccctggagaaggaggaggccgagaaccaggaggagaagccagagaagaacagcagaattggagagaagatggagacagaagcagatgcccccagccctgcccccagcctgggggagcggctggagcccaggaagatccccctggaggatgaggtgcctggggtgcctggagagatggagcctgagcccggctacagaggagaccgggagaagtcagaagatgtgaagggggaccgggagctgcggcccggccccagagatgagcccaggagcaatggaagaagagaggagaagacagagaagccccgcttcatgttcaacattgctgatggcggcttcacagagctgcacaccctgtggcagaatgaggagagagctgccatcagcagcggcaagctgaatgagatctggcacagaagacatgactactggctgctggccggcatcgtgctgcacggctacgcccgctggcaggacatccagaatgatgcccagtttgccatcatcaatgagcccttcaagacagaggccaacaagggcaacttcctggagatgaagaacaagttcctggcccggcgcttcaagctgctggagcaggccctggtgattgaggagcagctgcggcgggccgcctacctgaacctgagccaggagcccgcccacccagccatggccctgcacgccaggtttgctgaggctgaatgtctggccgagagccaccagcacctgagcaaggagagcctggccggcaacaagccagccaatgctgtgctgcacaaggtgctgaaccagctggaggagctgctgagtgacatgaaggcagatgtgacccggctgcctgccaccctgagccgcatcccccccatcgccgcccggctgcagatgtctgagaggagcatcctgagccggctggccagcaagggcacagagccccaccccaccccagcctacccacctggcccctatgccaccccacctggctatggagctgccttctctgctgcccctgtgggcgccctggccgccgccggggccaactacagccagatgcctgctggcagcttcatcacagctgccaccaacggcccccctgtgctggtgaagaaggagaaggagatggtgggcgccctggtgtctgatggcctggacaggaaggagccccgggccggggaggtgatctgcattgatgactag

SEQ ID NO: 147527 - DNA, 6180 bp, Artificial Sequence
  Description of Artificial Sequence: Synthetic coding sequence
atggccagccccctgagagatgaggaggaggaggaggaggagatggtggtgtctgaggaggaggaggaggaggaggaggagggagatgaggaggaggaggaggaggtggaggccgcagatgaagatgatgaagaagatgatgatgagggcgtgctgggccggggccctggccatgaccggggccgggacagacacagccccccaggctgccacctgttccccccacctcctcctcctcctccacccctgcccccacctcctcctcctcctcctccagacaaggatgacatccggctgctgcccagcgccctgggcgtgaagaagaggaagaggggccccaagaagcagaaggagaacaagccaggcaagcccaggaagaggaagaagagggacagcgaggaggagtttggcagcgagagagatgagtaccgggagaagtctgagagcggcggctctgaatatggcaccggccctggcaggaagagaagaaggaagcaccgggagaagaaggagaagaagaccaagaggaggaagaagggggagggagatggcggccagaagcaggtggagcagaagagcagcgccaccctgctgctgacctggggcctggaggatgtggagcacgtgttttctgaggaggactaccacaccctgaccaactacaaggccttcagccagttcatgaggcccctcatcgccaagaagaaccccaagatccccatgagcaagatgatgaccatcctgggcgccaagtggagggagttcagcgccaacaaccccttcaagggcagcgctgctgctgtggccgctgctgctgctgctgctgctgctgctgtggccgagcaggtgtctgctgctgtgtcctctgccacccccatcgcccccagcggccccccagccctgcccccacctcctgctgctgacatccagcccccacccatcagaagagccaagaccaaggagggcaaaggacctggccacaagagaagaagcaagagcccccgggtgcctgatggcaggaagaagctgcggggcaagaagatggcccccctgaagatcaagctgggcctgctgggcggcaagaggaagaagggcggcagctatgtgttccagagtgatgagggccctgagcctgaggccgaggagagtgacctggacagcggctctgtgcacagcgccagcggccgcccagatggccctgtgaggaccaagaagctgaagaggggccggcccggcaggaagaagaagaaggtgctgggctgcccagctgtggccggggaggaggaggtggatggctatgaaacagaccaccaggactactgtgaggtgtgccagcagggcggggagatcatcctgtgtgacacctgcccccgggcctaccacctggtgtgcctggaccctgagctggaccgggcccctgagggcaagtggagctgcccccactgtgagaaggagggcgtgcagtgggaggccaaggaggaggaggaggagtatgaggaggagggggaggaggagggggagaaggaggaggaggatgaccacatggagtactgccgggtgtgcaaggatggaggagagctgctgtgctgtgatgcctgcatcagcagctaccacatccactgcctgaacccccccctgcctgacatccccaatggagagtggctgtgcccccgctgcacctgccctgtgctgaagggccgggtgcagaagatcctgcactggcgctggggcgagccccctgtggccgtgcctgccccccagcaggctgatggcaacccagatgtgcccccaccccggcccctgcagggccgctctgagcgggagttctttgtgaagtgggtgggcctgagctactggcactgctcctgggccaaggagctgcagctggagatcttccacctggtgatgtacagaaactaccagaggaagaatgacatggatgagcccccacccctggactatggcagcggggaggatgatggcaagagtgacaagaggaaggtgaaggacccccactacgccgagatggaggagaagtactacagatttggcatcaagccagagtggatgacagtgcaccgcatcatcaaccacagcgtggacaagaagggcaactaccactacctggtgaagtggagggacctgccctatgaccagagcacctgggaggaggatgagatgaacatcccagaatatgaggagcacaagcagagctactggaggcaccgggagctgatcatgggagaagatcctgcccagcccaggaagtacaagaagaagaagaaggagctgcagggagatggcccccccagcagccccaccaatgaccccaccgtgaagtatgagacccagccccgcttcatcacagccactggaggcaccctgcacatgtaccagctggagggcctgaactggctgcgcttctcctgggcccagggcacagacaccatcctggctgatgagatgggcctgggcaagaccatccagaccatcgtgttcctgtacagcctgtacaaggagggccacaccaagggccccttcctggtgtctgcccccctgagcaccatcatcaactgggagcgggagttccagatgtgggcccccaagttctacgtggtgacctacaccggggacaaggacagccgggccatcatcagagaaaatgagttctcctttgaagataatgccatcaagggcggcaagaaggccttcaagatgaagcgggaggcccaggtgaagttccacgtgctgctgaccagctatgagctgatcaccatcgaccaggccgccctgggcagcatccgctgggcctgcctggtggtggatgaggcccaccggctgaagaacaaccagagcaagttcttccgggtgctgaatggctacaagattgaccacaagctgctgctgaccggcacccccctgcagaacaacctggaggagctgttccacctgctgaacttcctgaccccagagcgcttcaacaacctggagggcttcctggaggagtttgctgacatcagcaaagaagaccagatcaagaagctgcatgacctgctgggcccccacatgctgcggcggctgaaggcagatgtgttcaagaacatgcctgccaagacagagctgattgtgcgggtggagctgagccccatgcagaagaagtactacaagtacatcctgaccaggaactttgaggccctgaacagccggggcggcggcaaccaggtgtccctgctgaacatcatgatggacctgaagaagtgctgcaaccacccctacctgtttcctgtggccgccatggagagccccaagctgcccagcggggcctatgaaggaggagccctgatcaagagcagcggcaagctgatgctgctgcagaagatgctgaggaagctgaaggagcagggccaccgggtgctgatcttcagccagatgaccaagatgctggacctgctggaggacttcctggactatgagggctacaagtatgaaagaattgatggcggcatcaccggggccctgcggcaggaggccatcgaccgcttcaatgcccctggggcccagcagttctgcttcctgctgagcaccagggctgggggcctgggcatcaacctggccacagctgacaccgtcatcatctttgacagcgactggaacccccacaatgacatccaggccttcagccgggcccaccgcatcggccaggccaacaaggtgatgatctacagatttgtgacccgggcctctgtggaggagcgcatcacccaggtggccaagaggaagatgatgctgacccacctggtggtgcggcccggcctgggcagcaaggccggctccatgagcaagcaggagctggatgacatcctgaagtttggaacagaggagctgttcaaggatgaaaatgaaggagagaacaaggaggaggacagcagcgtcatccactatgacaatgaggccatcgcccggctgctggacaggaaccaggatgccacagaggacacagatgtgcagaacatgaatgagtacctgagcagcttcaaggtggcccagtatgtggtgcgggaggaggacaagattgaggagattgagcgggagatcatcaagcaggaggagaatgtggaccctgactactgggagaagctgctgcggcaccactatgagcagcagcaggaggacctggccaggaacctgggcaagggcaagagggtgaggaagcaggtgaactacaatgatgctgcccaggaggaccaggacaaccagagcgagtacagcgtgggcagcgaggaggaggatgaagattttgatgagaggcctgagggccggcggcagagcaagaggcagctgagaaatgagaaggacaagcccctgccccccctgctggcccgggtgggcggcaacatcgaggtgctgggcttcaacacccggcagaggaaggccttcctgaatgctgtgatgcgctggggcatgccaccccaggatgccttcaccacccagtggctggtgcgggacctgcggggcaagacagagaaggagttcaaggcctacgtgtccctcttcatgaggcacctgtgtgagcctggagcagatggcagcgagacctttgctgatggagtgccccgggagggcctgagccggcagcaggtgctgaccagaattggagtgatgagcctggtgaagaagaaggtgcaggagtttgagcacatcaatggccgctggagcatgcctgagctgatgccagaccccagcgctgacagcaagaggagcagccgggccagcagccccaccaagaccagccccaccaccccagaggccagcgccaccaacagcccctgcaccagcaagccagccaccccagcccccagcgagaagggggagggcatccgcacccccctggagaaggaggaggccgagaaccaggaggagaagccagagaagaacagccgcatcggggagaagatggagacagaagcagatgcccccagccctgcccccagcctgggggagcggctggagcccaggaagatccccctggaggatgaggtgcctggggtgcctggagagatggagcctgagcccggctacagaggagaccgggagaagagcgccacagagagcaccccaggagagcggggggaggagaagcccctggatggccaggagcaccgggagaggcctgagggggagaccggggacctgggcaagagagaagatgtgaagggggaccgggagctgcggcccggccccagagatgagcccaggagcaatggccggcgggaggagaagacagagaagccccgcttcatgttcaacattgctgatggcggcttcacagagctgcacaccctgtggcagaatgaggagcgggccgccatcagcagcggcaagctgaatgagatctggcacagaagacatgactactggctgctggccggcatcgtgctgcacggctacgcccgctggcaggacatccagaatgatgcccagtttgccatcatcaatgagcccttcaagacagaggccaacaagggcaacttcctggagatgaagaacaagttcctggcccggcgcttcaagctgctggagcaggccctggtgattgaggagcagctgcggcgggccgcctacctgaacctgagccaggagcccgcccacccagccatggccctgcacgccaggtttgctgaggccgagtgcctggccgagagccaccagcacctgagcaaggagagcctggccggcaacaagccagccaatgctgtgctgcacaaggtgctgaaccagctggaggagctgctgagtgacatgaaggcagatgtgacccggctgcctgccaccctgagccgcatcccccccatcgccgcccggctgcagatgtctgagaggagcatcctgagccggctggccagcaaaggaacagagccccaccccaccccagcctacccacctggcccctatgccaccccacctggctacggggccgccttctctgctgcccctgtgggcgccctggccgctgctggggccaactacagccagatgcctgctggcagcttcatcacagctgccaccaatggacctcctgtgctggtgaagaaggagaaggagatggtgggcgccctggtgtctgatggcctggacaggaaggagcccagggctggggaggtgatctgcattgatgactag

SEQ ID NO: 147528 - DNA, 5865 bp, Artificial Sequence
  Description of Artificial Sequence: Synthetic coding sequence
atgaggggccctgtgggcacagaggaggagctgccccggctgtttgctgaggagatggagaatgaagatgagatgtctgaggaggaggatggcggcctggaggcctttgatgacttcttccctgtggagcctgtgtccctgcccaagaagaagaagcccaagaagctgaaggagaacaagtgcaagggcaagaggaagaagaaggagggcagcaatgatgagctgtctgaaaatgaggaggacctggaggagaagtctgagagcgagggcagtgactacagccccaacaagaagaagaagaagaagctgaaggacaagaaggagaagaaggccaagaggaagaagaaggatgaagatgaagatgacaatgatgatggctgcctgaaggagcccaagagcagcggccagctgatggccgagtggggcctggatgatgtggactacctgttcagcgaggaggactaccacaccctgaccaactacaaggccttcagccagttcctgcggcccctcatcgccaagaagaaccccaagatccccatgagcaagatgatgacagtgctgggcgccaagtggagggagttcagcgccaacaaccccttcaagggcagcagcgctgctgctgctgctgctgctgtggccgctgctgtggagaccgtgaccatcagcccccccctggccgtgagccccccccaggtgccccagcctgtgcccatcaggaaggccaagaccaaggagggcaagggccctggggtgaggaagaagatcaagggcagcaaggatggcaagaagaagggcaagggcaagaagacagctggcctgaagttccgctttggaggcatcagcaacaagaggaagaagggcagcagcagtgaagaagatgagcgggaggagagtgactttgattctgccagcatccacagcgcctctgtgcgctctgagtgcagcgctgccctgggcaagaagagcaagagaagaaggaagaagaagagaattgatgatggagatggctatgaaacagaccaccaggactactgtgaggtgtgccagcagggcggggagatcatcctgtgtgacacctgcccccgggcctaccacctggtgtgcctggaccctgagctggagaaggcccctgagggcaagtggagctgcccccactgtgagaaggagggcatccagtgggagcccaaggatgatgatgatgaggaggaggagggcggctgtgaggaggaggaggatgaccacatggagttctgccgggtgtgcaaggatggaggagagctgctgtgctgtgatgcctgccccagcagctaccacctgcactgcctgaacccccccctgcctgagatccccaacggggagtggctgtgcccccgctgcacctgcccccccctgaagggcaaggtgcagaggatcctgcactggcgctggacagagcccccagcccccttcatggtgggcctgcccggcccagatgtggagcccagcctgcccccacccaagcccctggagggcatccctgagcgggagttctttgtgaagtgggccggcctgagctactggcactgctcctgggtgaaggagctgcagctggagctgtaccacacagtgatgtacagaaactaccagaggaagaatgacatggatgagcccccaccatttgattatggcagcggagatgaagatggcaagtctgagaagaggaagaacaaggaccccctgtatgccaagatggaggagcgcttctaccgctatggcatcaagccagagtggatgatgatccaccgcatcctgaaccacagctttgacaagaagggagatgtgcactacctgatcaagtggaaggacctgccctatgaccagtgcacctgggagattgatgacatcgacatcccctactatgacaacctgaagcaggcctactggggccaccgggagctgatgctgggggaggacacccggctgcccaagaggctgctgaagaagggcaagaagctgagagatgacaagcaggagaagcccccagacacccccatcgtggaccccaccgtgaagtttgacaagcagccctggtacatcgacagcactggaggcaccctgcacccctaccagctggagggcctgaactggctgcgcttctcctgggcccagggcacagacaccatcctggctgatgagatgggcctgggcaagacagtgcagaccatcgtgttcctgtacagcctgtacaaggagggccacagcaagggcccctacctggtgtctgcccccctgagcaccatcatcaactgggagcgggagtttgagatgtgggccccagacttctacgtggtgacctacacaggagacaaggagagccgcagcgtcatccgggagaatgagttctcctttgaggacaatgccatccgcagcggcaagaaggtgttcaggatgaagaaggaggtgcagatcaagttccacgtgctgctgaccagctatgagctgatcaccatcgaccaggccatcctgggcagcattgagtgggcctgcctggtggtggatgaggcccaccggctgaagaacaaccagagcaagttcttccgggtgctgaacagctacaagattgactacaagctgctgctgaccggcacccccctgcagaacaacctggaggagctgttccacctgctgaacttcctgaccccagagcgcttcaacaacctggagggcttcctggaggagtttgctgacatcagcaaggaggaccagatcaagaagctgcatgacctgctgggcccccacatgctgcggcggctgaaggcagatgtgttcaagaacatgcctgccaagacagagctgattgtgcgggtggagctgagccagatgcagaagaagtactacaagttcatcctgaccaggaactttgaggccctgaacagcaagggcggcggcaaccaggtgtccctgctgaacatcatgatggacctgaagaagtgctgcaaccacccctacctgtttcctgtggccgctgtggaggcccctgtgctgcccaacggcagctatgatggcagcagcctggtgaagagcagcggcaagctgatgctgctgcagaagatgctgaagaagctgagagatgagggccaccgggtgctgatcttcagccagatgaccaagatgctggacctgctggaggacttcctggagtatgagggctacaagtatgaaagaattgatggcggcatcactggaggcctgcggcaggaggccatcgaccgcttcaatgcccctggggcccagcagttctgcttcctgctgagcacccgggccggcggcctgggcatcaacctggccacagctgacaccgtcatcatctatgacagcgactggaacccccacaatgacatccaggccttcagccgggcccacagaattggccagaacaagaaggtgatgatctacagatttgtgacccgggcctctgtggaggagcgcatcacccaggtggccaagaggaagatgatgctgacccacctggtggtgcggcccggcctgggcagcaagagcggctccatgaccaagcaggagctggatgacatcctgaagtttggaacagaggagctgttcaaggatgatgtggagggcatgatgagccagggccagaggcctgtgacccccatcccagatgtgcagagcagcaagggcggcaacctggccgccagcgccaagaagaagcacggcagcaccccacctggggacaacaaggatgtggaggacagcagcgtcatccactatgatgatgctgccatcagcaagctgctggacaggaaccaggatgccacagatgacacagagctgcagaacatgaatgagtacctgagcagcttcaaggtggcccagtatgtggtgcgggaggaggatggagtggaggaggtggagcgggagatcatcaagcaggaggagaatgtggaccctgactactgggagaagctgctgcggcaccactatgagcagcagcaggaggacctggccaggaacctgggcaagggcaagaggatcaggaagcaggtgaactacaatgatgccagccaggaggaccaggagtggcaggatgagctgagtgacaaccagagcgagtacagcatcggctctgaagatgaagatgaagattttgaggagaggcctgagggccagagcggccggcggcagagccggcggcagctgaagagtgaccgggacaagcccctgccccccctgctggcccgggtgggcggcaacatcgaggtgctgggcttcaatgcccggcagaggaaggccttcctgaatgccatcatgcgctggggcatgccaccccaggatgccttcaacagccactggctggtgcgggacctgcggggcaagtctgagaaggagttccgggcctacgtgtccctcttcatgaggcacctgtgtgagcccggggctgatggagctgagacctttgctgatggagtgccccgggagggcctgagccggcagcacgtgctgacccgcatcggcgtgatgagcctggtgaggaagaaggtgcaggagtttgaacatgtgaatggcaagtacagcaccccagacctgatccctgagggccctgagggcaagaagtctggagaggtgatcagcagtgaccccaacacccctgtgcctgccagccctgcccacctgctgcctgcccccctgggcctgcctgacaagatggaggcccagctgggctacatggatgagaaggaccccggggcccagaagccccggcagcccctggaggtgcaggccctgcctgctgccctggacagagtggagagcgaggacaagcatgagagccctgccagcaaggagcgggcccgggaggagaggcctgaggagacagagaaggccccacccagccctgagcagctgccccgggaggaggtgctgcctgagaaggagaagatcctggacaagctggagctgagcctcatccacagcagaggagacagcagcgagctgcggccagatgacaccaaggccgaggagaaggagcccatcgagacccagcagaatggagacaaggaggaggatgatgagggcaagaaggaggacaagaagggcaagttcaagttcatgttcaacattgctgatggcggcttcacagagctgcacaccctgtggcagaatgaggagagagctgctgtgtcctctgggaagatctatgacatctggcacagaagacatgactactggctgctggccggcatcgtgacccacggctacgcccgctggcaggacatccagaatgacccccgctacatgatcctgaatgagcccttcaagtctgaggtgcacaagggcaactacctggagatgaagaacaagttcctggcccggcgcttcaagctgctggagcaggccctggtgattgaggagcagctgcggcgggccgcctacctgaacatgacccaggaccccaaccacccagccatggccctgaatgcccggctggccgaggtggagtgcctggccgagagccaccagcacctgagcaaggagagcctggccggcaacaagccagccaatgctgtgctgcacaaggtgctgaaccagctggaggagctgctgagtgacatgaaggcagatgtgacccggctgcccagcatgctgagccgcatcccccctgtggccgcccggctgcagatgtctgagaggagcatcctgagccggctgaccaacagagctggggaccccaccatccagcagggcgccttcggcagcagccagatgtacagcaacaactttggccccaacttccggggccctggccctgggggcatcgtgaactacaaccagatgcccctgggcccctacgtgacagacatctag

SEQ ID NO: 147529 - DNA, 2427 bp, Artificial Sequence
  Description of Artificial Sequence: Synthetic coding sequence
atgatctacagatttgtgacccgggcctctgtggaggagcgcatcacccaggtggccaagaggaagatgatgctgacccacctggtggtgcggcccggcctgggcagcaagagcggctccatgaccaagcaggagctggatgacatcctgaagtttggaacagaggagctgttcaaggatgatgtggagggcatgatgagccagggccagaggcctgtgacccccatcccagatgtgcagagcagcaaaggaggcaacctggccgccagcgccaagaagaagcacggcagcaccccacctggggacaacaaggatgtggaggacagcagcgtcatccactatgatgatgctgccatcagcaagctgctggacaggaaccaggatgccacagatgacacagagctgcagaacatgaatgagtacctgagcagcttcaaggtggcccagtatgtggtgcgggaggaggatggagtggaggaggtggagcgggagatcatcaagcaggaggagaatgtggaccctgactactgggagaagctgctgcggcaccactatgagcagcagcaggaggacctggccaggaacctgggcaagggcaagaggatcaggaagcaggtgaactacaatgatgccagccaggaggaccaggagtggcaggatgagctgagtgacaaccagagcgagtacagcatcggctctgaagatgaagatgaggactttgaggagaggcctgagggccagagcggccggcggcagagccggcggcagctgaagagtgaccgggacaagcccctgccccccctgctggcccgggtgggcggcaacatcgaggtgctgggcttcaatgcccggcagaggaaggccttcctgaatgccatcatgcgctggggcatgccaccccaggatgccttcaacagccactggctggtgcgggacctgcggggcaagtctgagaaggagttccgggcctacgtgtccctcttcatgaggcacctgtgtgagcctggagcagatggagctgagacctttgctgatggagtgccccgggagggcctgagccggcagcacgtgctgaccagaattggagtgatgagcctggtgaggaagaaggtgcaggagtttgagcacgtgaatggcaagtacagcaccccagacctgatccctgagggccctgagggcaagaagagcggggaggtgatcagcagtgaccccaacacccctgtgcctgccagccctgcccacctgctgcctgcccccctgggcctgcctgacaagatggaggcccagctgggctacatggatgagaaggaccccggggcccagaagccccggcagcccctggaggtgcaggccctgcctgctgccctggacagagtggagagcgaggacaagcatgagagccctgccagcaaggagcgggcccgggaggagaggcctgaggagacagagaaggccccacccagccctgagcagctgccccgggaggaggtgctgcctgagaaggagaagatcctggacaagctggagctgagcctcatccacagcagaggagacagcagcgagctgcggccagatgacaccaaggccgaggagaaggagcccatcgagacccagcagaatggagacaaggaggaggatgatgagggcaagaaggaggacaagaagggcaagttcaagttcatgttcaacattgctgatggcggcttcacagagctgcacaccctgtggcagaatgaggagagagctgctgtgagcagcggcaagatctatgacatctggcacagaagacatgactactggctgctggccggcatcgtgacccacggctacgcccgctggcaggacatccagaatgacccccgctacatgatcctgaatgagcccttcaagtctgaggtgcacaagggcaactacctggagatgaagaacaagttcctggcccggcgcttcaagctgctggagcaggccctggtgattgaggagcagctgcggcgggccgcctacctgaacatgacccaggaccccaaccacccagccatggccctgaatgcccggctggccgaggtggagtgcctggccgagagccaccagcacctgagcaaggagagcctggccggcaacaagccagccaatgctgtgctgcacaaggtgctgaaccagctggaggagctgctgagtgacatgaaggcagatgtgacccggctgcccagcatgctgagccgcatcccccctgtggccgcccggctgcagatgtctgagaggagcatcctgagccggctgaccaacagagctggggaccccaccatccagcagatcagcagccggccccgggacttccctgtgctgcagaggagcttccctgctgagccccggctgcccggccacctgcctgacccccacggccgggagaagctgccccccttctag

SEQ ID NO: 147530 - DNA, 3588 bp, Artificial Sequence
  Description of Artificial Sequence: Synthetic coding sequence
atggtgggcctgcccggcccagatgtggagcccagcctgcccccacccaagcccctggagggcatccctgagcgggagttctttgtgaagtgggccggcctgagctactggcactgctcctgggtgaaggagctgcagctggagctgtaccacacagtgatgtacagaaactaccagaggaagaatgacatggatgagcccccaccatttgattatggcagcggagatgaagatggcaagtctgagaagaggaagaacaaggaccccctgtatgccaagatggaggagcgcttctaccgctatggcatcaagccagagtggatgatgatccaccgcatcctgaaccacagctttgacaagaagggagatgtgcactacctgatcaagtggaaggacctgccctatgaccagtgcacctgggagattgatgacatcgacatcccctactatgacaacctgaagcaggcctactggggccaccgggagctgatgctgggggaggacacccggctgcccaagaggctgctgaagaagggcaagaagctgagagatgacaagcaggagaagcccccagacacccccatcgtggaccccaccgtgaagtttgacaagcagccctggtacatcgacagcactggaggcaccctgcacccctaccagctggagggcctgaactggctgcgcttctcctgggcccagggcacagacaccatcctggctgatgagatgggcctgggcaagacagtgcagaccatcgtgttcctgtacagcctgtacaaggagggccacagcaagggcccctacctggtgtctgcccccctgagcaccatcatcaactgggagcgggagtttgagatgtgggccccagacttctacgtggtgacctacacaggagacaaggagagccgcagcgtcatccgggagaatgagttctcctttgaggacaatgccatccgcagcggcaagaaggtgttcaggatgaagaaggaggtgcagatcaagttccacgtgctgctgaccagctatgagctgatcaccatcgaccaggccatcctgggcagcattgagtgggcctgcctggtggtggatgaggcccaccggctgaagaacaaccagagcaagttcttccgggtgctgaacagctacaagattgactacaagctgctgctgaccggcacccccctgcagaacaacctggaggagctgttccacctgctgaacttcctgaccccagagcgcttcaacaacctggagggcttcctggaggagtttgctgacatcagcaaggaggaccagatcaagaagctgcatgacctgctgggcccccacatgctgcggcggctgaaggcagatgtgttcaagaacatgcctgccaagacagagctgattgtgcgggtggagctgagccagatgcagaagaagtactacaagttcatcctgaccaggaactttgaggccctgaacagcaagggcggcggcaaccaggtgtccctgctgaacatcatgatggacctgaagaagtgctgcaaccacccctacctgtttcctgtggccgctgtggaggcccctgtgctgcccaacggcagctatgatggcagcagcctggtgaagagcagcggcaagctgatgctgctgcagaagatgctgaagaagctgagagatgagggccaccgggtgctgatcttcagccagatgaccaagatgctggacctgctggaggacttcctggagtatgagggctacaagtatgaaagaattgatggcggcatcactggaggcctgcggcaggaggccatcgaccgcttcaatgcccctggggcccagcagttctgcttcctgctgagcacccgggccggcggcctgggcatcaacctggccacagctgacaccgtcatcatctatgacagcgactggaacccccacaatgacatccaggccttcagccgggcccacagaattggccagaacaagaaggtgatgatctacagatttgtgacccgggcctctgtggaggagcgcatcacccaggtggccaagaggaagatgatgctgacccacctggtggtgcggcccggcctgggcagcaagagcggctccatgaccaagcaggagctggatgacatcctgaagtttggaacagaggagctgttcaaggatgatgtggagggcatgatgagccagggccagaggcctgtgacccccatcccagatgtgcagagcagcaagggcggcaacctggccgccagcgccaagaagaagcacggcagcaccccacctggggacaacaaggatgtggaggacagcagcgtcatccactatgatgatgctgccatcagcaagctgctggacaggaaccaggatgccacagatgacacagagctgcagaacatgaatgagtacctgagcagcttcaaggtggcccagtatgtggtgcgggaggaggatggagtggaggaggtggagcgggagatcatcaagcaggaggagaatgtggaccctgactactgggagaagctgctgcggcaccactatgagcagcagcaggaggacctggccaggaacctgggcaagggcaagaggatcaggaagcaggtgaactacaatgatgccagccaggaggaccaggagtggcaggatgagctgagtgacaaccagagcgagtacagcatcggctctgaagatgaagatgaagattttgaggagaggcctgagggccagagcggccggcggcagagccggcggcagctgaagagtgaccgggacaagcccctgccccccctgctggcccgggtgggcggcaacatcgaggtgctgggcttcaatgcccggcagaggaaggccttcctgaatgccatcatgcgctggggcatgccaccccaggatgccttcaacagccactggctggtgcgggacctgcggggcaagtctgagaaggagttccgggcctacgtgtccctcttcatgaggcacctgtgtgagcccggggctgatggagctgagacctttgctgatggagtgccccgggagggcctgagccggcagcacgtgctgacccgcatcggcgtgatgagcctggtgaggaagaaggtgcaggagtttgaacatgtgaatggcaagtacagcaccccagacctgatccctgagggccctgagggcaagaagtctggagaggtgatcagcagtgaccccaacacccctgtgcctgccagccctgcccacctgctgcctgcccccctgggcctgcctgacaagatggaggcccagctgggctacatggatgagaaggaccccggggcccagaagccccggcagcccctggaggtgcaggccctgcctgctgccctggacagagtggagagcgaggacaagcatgagagccctgccagcaaggagcgggcccgggaggagaggcctgagcagaccccaccagcccaggcccagctgcggggcggccggcccctgagccctggaacagcccctggctggcagcgggagggccctggcctgggcgcccggcgggcccggagccccagccagggcggccctgggggcggcggcagcagctttggcagccaggcccccctgtag

SEQ ID NO: 147531 - DNA, 2427 bp, Artificial Sequence; identical to SEQ ID NO: 147529
  Description of Artificial Sequence: Synthetic coding sequence

SEQ ID NO: 147532 - DNA, 3288 bp, Artificial Sequence
  Description of Artificial Sequence: Synthetic coding sequence
atgatccaccgcatcctgaaccacagctttgacaagaagggagatgtgcactacctgatcaagtggaaggacctgccctatgaccagtgcacctgggagattgatgacatcgacatcccctactatgacaacctgaagcaggcctactggggccaccgggagctgatgctgggggaggacacccggctgcccaagaggctgctgaagaagggcaagaagctgagagatgacaagcaggagaagcccccagacacccccatcgtggaccccaccgtgaagtttgacaagcagccctggtacatcgacagcactggaggcaccctgcacccctaccagctggagggcctgaactggctgcgcttctcctgggcccagggcacagacaccatcctggctgatgagatgggcctgggcaagacagtgcagaccatcgtgttcctgtacagcctgtacaaggagggccacagcaagggcccctacctggtgtctgcccccctgagcaccatcatcaactgggagcgggagtttgagatgtgggccccagacttctacgtggtgacctacacaggagacaaggagagccgcagcgtcatccgggagaatgagttctcctttgaggacaatgccatccgcagcggcaagaaggtgttcaggatgaagaaggaggtgcagatcaagttccacgtgctgctgaccagctatgagctgatcaccatcgaccaggccatcctgggcagcattgagtgggcctgcctggtggtggatgaggcccaccggctgaagaacaaccagagcaagttcttccgggtgctgaacagctacaagattgactacaagctgctgctgaccggcacccccctgcagaacaacctggaggagctgttccacctgctgaacttcctgaccccagagcgcttcaacaacctggagggcttcctggaggagtttgctgacatcagcaaggaggaccagatcaagaagctgcatgacctgctgggcccccacatgctgcggcggctgaaggcagatgtgttcaagaacatgcctgccaagacagagctgattgtgcgggtggagctgagccagatgcagaagaagtactacaagttcatcctgaccaggaactttgaggccctgaacagcaagggcggcggcaaccaggtgtccctgctgaacatcatgatggacctgaagaagtgctgcaaccacccctacctgtttcctgtggccgctgtggaggcccctgtgctgcccaacggcagctatgatggcagcagcctggtgaagagcagcggcaagctgatgctgctgcagaagatgctgaagaagctgagagatgagggccaccgggtgctgatcttcagccagatgaccaagatgctggacctgctggaggacttcctggagtatgagggctacaagtatgaaagaattgatggcggcatcactggaggcctgcggcaggaggccatcgaccgcttcaatgcccctggggcccagcagttctgcttcctgctgagcacccgggccggcggcctgggcatcaacctggccacagctgacaccgtcatcatctatgacagcgactggaacccccacaatgacatccaggccttcagccgggcccacagaattggccagaacaagaaggtgatgatctacagatttgtgacccgggcctctgtggaggagcgcatcacccaggtggccaagaggaagatgatgctgacccacctggtggtgcggcccggcctgggcagcaagagcggctccatgaccaagcaggagctggatgacatcctgaagtttggaacagaggagctgttcaaggatgatgtggagggcatgatgagccagggccagaggcctgtgacccccatcccagatgtgcagagcagcaagggcggcaacctggccgccagcgccaagaagaagcacggcagcaccccacctggggacaacaaggatgtggaggacagcagcgtcatccactatgatgatgctgccatcagcaagctgctggacaggaaccaggatgccacagatgacacagagctgcagaacatgaatgagtacctgagcagcttcaaggtggcccagtatgtggtgcgggaggaggatggagtggaggaggtggagcgggagatcatcaagcaggaggagaatgtggaccctgactactgggagaagctgctgcggcaccactatgagcagcagcaggaggacctggccaggaacctgggcaagggcaagaggatcaggaagcaggtgaactacaatgatgccagccaggaggaccaggagtggcaggatgagctgagtgacaaccagagcgagtacagcatcggctctgaagatgaagatgaagattttgaggagaggcctgagggccagagcggccggcggcagagccggcggcagctgaagagtgaccgggacaagcccctgccccccctgctggcccgggtgggcggcaacatcgaggtgctgggcttcaatgcccggcagaggaaggccttcctgaatgccatcatgcgctggggcatgccaccccaggatgccttcaacagccactggctggtgcgggacctgcggggcaagtctgagaaggagttccgggcctacgtgtccctcttcatgaggcacctgtgtgagcccggggctgatggagctgagacctttgctgatggagtgccccgggagggcctgagccggcagcacgtgctgacccgcatcggcgtgatgagcctggtgaggaagaaggtgcaggagtttgaacatgtgaatggcaagtacagcaccccagacctgatccctgagggccctgagggcaagaagtctggagaggtgatcagcagtgaccccaacacccctgtgcctgccagccctgcccacctgctgcctgcccccctgggcctgcctgacaagatggaggcccagctgggctacatggatgagaaggaccccggggcccagaagccccggcagcccctggaggtgcaggccctgcctgctgccctggacagagtggagagcgaggacaagcatgagagccctgccagcaaggagcgggcccgggaggagaggcctgaggagacagagaaggccccacccagccctgagcagctgccccgggccagctgcagcgtgacccaggccggcgtgcagtggaggcaccggctgatgggcgccttcatcagcagcgcccaggccaccctgcccccccagctgcctgagcagaggcgctgcttcctgcggcggcggcgctcctggacctcctggagctag

SEQ ID NO: 147533 - DNA, 3258 bp, Artificial Sequence
  Description of Artificial Sequence: Synthetic coding sequence
atgatccaccgcatcctgaaccacagctttgacaagaagggagatgtgcactacctgatcaagtggaaggacctgccctatgaccagtgcacctgggagattgatgacatcgacatcccctactatgacaacctgaagcaggcctactggggccaccgggagctgatgctgggggaggacacccggctgcccaagaggctgctgaagaagggcaagaagctgagagatgacaagcaggagaagcccccagacacccccatcgtggaccccaccgtgaagtttgacaagcagccctggtacatcgacagcactggaggcaccctgcacccctaccagctggagggcctgaactggctgcgcttctcctgggcccagggcacagacaccatcctggctgatgagatgggcctgggcaagacagtgcagaccatcgtgttcctgtacagcctgtacaaggagggccacagcaagggcccctacctggtgtctgcccccctgagcaccatcatcaactgggagcgggagtttgagatgtgggccccagacttctacgtggtgacctacacaggagacaaggagagccgcagcgtcatccgggagaatgagttctcctttgaggacaatgccatccgcagcggcaagaaggtgttcaggatgaagaaggaggtgcagatcaagttccacgtgctgctgaccagctatgagctgatcaccatcgaccaggccatcctgggcagcattgagtgggcctgcctggtggtggatgaggcccaccggctgaagaacaaccagagcaagttcttccgggtgctgaacagctacaagattgactacaagctgctgctgaccggcacccccctgcagaacaacctggaggagctgttccacctgctgaacttcctgaccccagagcgcttcaacaacctggagggcttcctggaggagtttgctgacatcagcaaggaggaccagatcaagaagctgcatgacctgctgggcccccacatgctgcggcggctgaaggcagatgtgttcaagaacatgcctgccaagacagagctgattgtgcgggtggagctgagccagatgcagaagaagtactacaagttcatcctgaccaggaactttgaggccctgaacagcaagggcggcggcaaccaggtgtccctgctgaacatcatgatggacctgaagaagtgctgcaaccacccctacctgtttcctgtggccgctgtggaggcccctgtgctgcccaacggcagctatgatggcagcagcctggtgaagagcagcggcaagctgatgctgctgcagaagatgctgaagaagctgagagatgagggccaccgggtgctgatcttcagccagatgaccaagatgctggacctgctggaggacttcctggagtatgagggctacaagtatgaaagaattgatggcggcatcactggaggcctgcggcaggaggccatcgaccgcttcaatgcccctggggcccagcagttctgcttcctgctgagcacccgggccggcggcctgggcatcaacctggccacagctgacaccgtcatcatctatgacagcgactggaacccccacaatgacatccaggccttcagccgggcccacagaattggccagaacaagaaggtgatgatctacagatttgtgacccgggcctctgtggaggagcgcatcacccaggtggccaagaggaagatgatgctgacccacctggtggtgcggcccggcctgggcagcaagagcggctccatgaccaagcaggagctggatgacatcctgaagtttggaacagaggagctgttcaaggatgatgtggagggcatgatgagccagggccagaggcctgtgacccccatcccagatgtgcagagcagcaagggcggcaacctggccgccagcgccaagaagaagcacggcagcaccccacctggggacaacaaggatgtggaggacagcagcgtcatccactatgatgatgctgccatcagcaagctgctggacaggaaccaggatgccacagatgacacagagctgcagaacatgaatgagtacctgagcagcttcaaggtggcccagtatgtggtgcgggaggaggatggagtggaggaggtggagcgggagatcatcaagcaggaggagaatgtggaccctgactactgggagaagctgctgcggcaccactatgagcagcagcaggaggacctggccaggaacctgggcaagggcaagaggatcaggaagcaggtgaactacaatgatgccagccaggaggaccaggagtggcaggatgagctgagtgacaaccagagcgagtacagcatcggctctgaagatgaagatgaagattttgaggagaggcctgagggccagagcggccggcggcagagccggcggcagctgaagagtgaccgggacaagcccctgccccccctgctggcccgggtgggcggcaacatcgaggtgctgggcttcaatgcccggcagaggaaggccttcctgaatgccatcatgcgctggggcatgccaccccaggatgccttcaacagccactggctggtgcgggacctgcggggcaagtctgagaaggagttccgggcctacgtgtccctcttcatgaggcacctgtgtgagcccggggctgatggagctgagacctttgctgatggagtgccccgggagggcctgagccggcagcacgtgctgacccgcatcggcgtgatgagcctggtgaggaagaaggtgcaggagtttgaacatgtgaatggcaagtacagcaccccagacctgatccctgagggccctgagggcaagaagtctggagaggtgatcagcagtgaccccaacacccctgtgcctgccagccctgcccacctgctgcctgcccccctgggcctgcctgacaagatggaggcccagctgggctacatggatgagaaggaccccggggcccagaagccccggcagcccctggaggtgcaggccctgcctgctgccctggacagagtggagagcgaggacaagcatgagagccctgccagcaaggagcgggcccgggaggagaggcctgaggagacagagaaggccccacccagccctgagcagctgccccgggccagctgcagcgtgacccaggccggcgtgcagtggaggcacctgggctcctgggagcccctgagcccccggctgaagaggcccagccacctgtccttcctgaacagaggaggagccagctag

SEQ ID NO: 147534 - DNA, 8994 bp, Artificial Sequence
  Description of Artificial Sequence: Synthetic coding sequence
atggctgaccccggcatgatgagcctgtttggagaagatggcaacatcttcagcgagggcctggagggcctgggggagtgtggctacccagaaaatcctgtgaaccccatgggccagcagatgcccatcgaccagggctttgccagcctgcagcccagcctgcaccaccccagcaccaaccagaaccagaccaagctgacccactttgaccactacaaccagtatgagcagcagaagatgcacctgatggaccagcccaacaggatgatgagcaacaccccaggaaatggcctggccagcccccacagccagtaccacaccccacctgtgccccaggtgccccatggaggcagcggcggcggccagatgggcgtgtacccaggcatgcagaatgaaagacatggccagagctttgtggacagcagctccatgtggggccccagggctgtgcaggtgcctgaccagatccgggccccctaccagcagcagcagccccagccccagcccccccagcctgcccccagcggccccccagcccagggccacccccagcacatgcagcagatgggcagctacatggcccggggggacttctccatgcagcagcacggccagccccagcagaggatgagccagttcagccagggccaggagggcctgaaccagggcaaccccttcatcgccaccagcggccctggccacctgagccacgtgccccagcagagccccagcatggcccccagcctgcggcacagcgtgcagcagttccaccaccaccccagcacagccctgcatggagagagcgtggcccacagcccccgcttcagccccaaccccccccagcagggcgctgtgcggccccagaccctgaacttcagcagccgcagccagacagtgcccagccccaccatcaacaacagcggccagtacagccgctacccctacagcaacctgaaccagggcctggtgaacaacacaggcatgaaccagaacctgggcctgaccaacaacacccccatgaaccagagcgtgccccgctacccaaatgctgtgggcttccccagcaacagcggccagggcctgatgcaccagcagcccatccaccccagcggcagcctgaaccagatgaacacccagaccatgcaccccagccagccccagggcacctacgccagccccccacccatgagccccatgaaggccatgagcaacccagctggcaccccaccaccccaggtgcggcccggcagcgctggcatccccatggaggtgggcagctaccccaacatgccccacccccagcccagccaccagcccccaggggccatgggcatcggccagaggaacatgggccccaggaacatgcagcagagccggcccttcatcggcatgagcagcgccccccgggagctgaccggccacatgaggcccaacggctgccctggggtgggcctgggggacccccaggccatccaggagcggctcatccctggccagcagcaccctggccagcagcccagcttccagcagctgcccacctgcccccccctgcagccccaccctggcctgcaccaccagagcagccccccccacccccaccaccagccctgggcccagctgcaccccagcccccagaacaccccccagaaggtgcctgtgcaccagcacagccccagcgagcccttcctggagaagcctgtgcctgacatgacccaggtgtctggccccaatgcccagctggtgaagagtgatgactacctgcccagcattgagcagcagccccagcagaagaagaagaagaagaagaacaaccacatcgtggccgaggaccccagcaaaggatttgggaaggatgacttccctggaggagtggacaaccaggagctgaacagaaacagcctggatggcagccaggaggagaagaagaagaagaagaggagcaaggccaagaaggaccccaaggagcccaaggagcccaaggagaagaaggagcccaaggagcccaagacccccaaggcccccaagatccccaaggagcccaaggagaagaaggccaagacagccacccccaagcccaagagcagcaagaagagcagcaacaagaagccagattctgaggccagcgccctgaagaagaaggtgaacaagggcaagacagagggctctgaaaattctgacctggacaagaccccaccacccagccccccaccagaagaagatgaagatcctggggtgcagaagaggaggagcagccggcaggtgaagaggaagcgctacacagaggacctggagttcaagatcagtgatgaggaggctgatgatgctgatgctgctggccgggacagccccagcaacaccagccagagcgagcagcaggagagcgtggatgctgagggccctgtggtggagaagatcatgagcagccgctctgtgaagaagcagaaggagagcggggaggaggtggagattgaggagttctacgtgaagtacaagaacttctcctacctgcactgccagtgggccagcattgaggacctggagaaggacaagaggatccagcagaagatcaagcgcttcaaggccaagcagggccagaacaagttcctgtctgaaattgaagatgagctgttcaacccagactatgtggaggtggaccgcatcatggactttgcccggagcacagatgacagaggagagcctgtgacccactacctggtgaagtggtgcagcctgccctatgaggacagcacctgggagcggcggcaggacatcgaccaggccaagattgaggagtttgagaagctgatgagccgggagcctgagacagagcgggtggagcggcccccagcagatgactggaagaagtctgagagcagccgggagtacaagaacaacaacaagctgcgggagtaccagctggagggcgtgaactggctgctcttcaactggtacaacatgaggaactgcatcctggctgatgagatgggcctgggcaagaccatccagagcatcaccttcctgtatgagatctacctgaagggcatccacggccccttcctggtgattgcccccctgagcaccatccccaactgggagcgggagttccgcacctggacagagctgaatgtggtggtgtaccacggcagccaggccagcaggaggaccatccagctgtatgagatgtacttcaaggacccccagggccgggtcatcaagggcagctacaagttccacgccatcatcaccacctttgagatgatcctgacagactgcccagagctgaggaacatcccctggaggtgtgtggtgattgatgaggcccaccggctgaagaacagaaactgcaagctgctggagggcctgaagatgatggacctggagcacaaggtgctgctgaccggcacccccctgcagaacacagtggaggagctgttcagcctgctgcacttcctggagcccagccgcttccccagcgagaccaccttcatgcaggagtttggagacctgaagacagaggagcaggtgcagaagctgcaggccatcctgaagcccatgatgctgcggcggctgaaggaggatgtggagaagaacctggcccccaaggaggagaccatcatcgaggtggagctgaccaacatccagaagaagtactaccgggccatcctggagaagaacttcaccttcctgagcaaaggaggcggccaggccaacgtgcccaacctgctgaacaccatgatggagctgaggaagtgctgcaaccacccctacctgatcaatggagctgaggagaagatcctggaggagttcaaggagacccacaatgctgagagcccagacttccagctgcaggccatgatccaggccgccggcaagctggtgctgattgacaagctgctgcccaagctgaaggccggcggccaccgggtgctgatcttcagccagatggtgcgctgcctggacatcctggaggactacctgatccagaggcgctacccctatgaaagaattgatggccgggtgcggggcaacctgcggcaggccgccatcgaccgcttcagcaagccagacagcgacagatttgtgttcctgctgtgcacccgggccggcggcctgggcatcaacctgacagctgctgacacctgcatcatctttgacagcgactggaacccccagaatgacctgcaggcccaggcccgctgccacagaattggccagagcaagtctgtgaagatctaccgcctcatcaccagaaattcctatgaaagagagatgtttgacaaggccagcctgaagctgggcctggacaaggctgtgctgcagagcatgagcggccgggagaatgccaccaacggggtgcagcagctgagcaagaaggagattgaggacctgctgaggaagggggcctatggagccctgatggatgaggaggatgagggcagcaagttctgtgaagaagatattgaccagatcctgctgcggaggacccacaccatcaccatcgagagcgagggcaagggcagcacctttgccaaggccagctttgtggccagcggcaacagaacagacatcagcctggatgaccccaacttctggcagaagtgggccaagaaggccgagctggacattgatgccctgaatggaagaaacaacctggtgattgacaccccccgggtgaggaagcagacccggctgtacagcgctgtgaaggaggatgagctgatggagttcagtgacctggagagtgacagcgaggagaagccctgtgccaagccccggcggccccaggacaagagccagggctacgcccggtctgagtgcttccgggtggagaagaacctgctggtgtatggctggggccgctggacagacatcctgagccacggccgctacaagaggcagctgacagagcaggatgtggagaccatctgcaggaccatcctggtgtactgcctgaaccactacaagggagatgagaacatcaagagcttcatctgggacctgatcacccccacagcagatggccagacccgggccctggtgaaccacagcggcctgagcgcccctgtgccccggggcaggaagggcaagaaggtgaaggcccagagcacccagcctgtggtgcaggatgctgactggctggccagctgcaacccagatgccctcttccaggaggacagctacaagaagcacctgaagcaccactgcaacaaggtgctgctgcgggtgaggatgctgtactacctgcggcaggaggtgattggagaccaggccgacaagatcctggagggcgctgacagcagcgaggctgatgtgtggatccctgagcccttccacgccgaggtgcctgctgactggtgggacaaggaggccgacaagagcctgctgattggagtcttcaagcacggctatgagaagtacaacagcatgagagctgaccctgccctgtgcttcctggagcgggtgggcatgccagatgccaaggccatcgctgctgagcagaggggcacagacatgctggctgatggaggagatggaggagaatttgacagagaagatgaagatcctgagtacaagcccaccaggacccccttcaaggatgaaattgatgaatttgccaacagccccagcgaggacaaggaggagagcatggagatccacgccaccgggaagcacagcgagagcaatgctgagctgggccagctgtactggcccaacaccagcaccctgaccacccggctgcggcggctcatcacagcctaccagaggagctacaagaggcagcagatgaggcaggaggccctgatgaagacagacagaagaagaagaagaccccgggaggaggtgcgggccctggaggccgagcgggaggccatcatcagcgagaagaggcagaagtggacccggcgggaggaggccgacttctacagagtggtgtccacctttggagtcatctttgatcctgtgaagcagcagtttgactggaaccagttccgggcctttgcccggctggacaagaagagtgatgagagcctggagaagtacttcagctgctttgtggccatgtgcagaagagtgtgcaggatgcctgtgaagccagatgatgagcccccagacctgagcagcatcatcgagcccatcacagaggagcgggccagcaggaccctgtaccgcatcgagctgctgaggaagatccgggagcaggtgctgcaccacccccagctgggggagcggctgaagctgtgccagcccagcctggacctgcctgagtggtgggagtgtggcagacatgaccgggacctgctggtgggcgccgccaagcatggagtgtccaggacagactaccacatcctgaatgaccctgagctgtccttcctggatgcccacaagaactttgcccagaacagaggagctggcaacaccagcagcctgaaccccctggccgtgggctttgtgcagaccccacctgtgatcagcagcgcccacatccaggatgagcgggtgctggagcaggccgagggcaaggtggaggagccagaaaatcctgctgccaaggagaagtgtgagggcaaggaggaggaggaggagacagatggcagcggcaaggagagcaagcaggagtgtgaggccgaggccagctctgtgaagaatgagctgaagggcgtggaggtgggcgctgacaccggcagcaagagcatcagcgagaagggctctgaagaagatgaggaggagaagctggaggatgatgacaagtctgaggagagcagccagcctgaggccggggctgtgtcccggggcaagaactttgatgaggagagcaatgcctccatgagcacagccagagatgagaccagagatggcttctacatggaggatggagaccccagcgtggcccagctgctgcacgagaggacctttgccttctccttctggcccaaggacagagtgatgatcaaccggctggacaacatctgtgaggccgtgctgaagggcaagtggcctgtgaacagacggcagatgtttgacttccagggcctcatccctggctacacccccaccaccgtggacagccccctgcagaagaggagctttgctgagctgtccatggtgggccaggccagcatcagcggcagcgaggacatcaccaccagcccccagctgagcaaagaagatgccctgaacctgtctgtgccccggcagaggagaagaagaagaaggaagattgaaattgaagctgagcgggccgccaagagaagaaacctgatggagatggtggcccagctgcgggagagccaggtggtgtctgaaaatggccaggagaaggtggtggacctgagcaaggccagccgggaggccaccagcagcaccagcaacttcagcagcctgagcagcaagttcatcctgcccaacgtgtccacccctgtgtctgatgccttcaagacccagatggagctgctgcaggccggcctgagcaggacccccaccaggcacctgctgaatggcagcctggtggatggagagccccccatgaagagaagaagaggaagaaggaagaatgtggagggcctggacctgctcttcatgagccacaagaggaccagcctgtctgcagaagatgctgaggtgaccaaggcctttgaagaagatattgagaccccacccaccaggaacatccccagccctggccagctggaccctgacacccgcatccctgtgatcaacctggaggatggcacccggctggtgggagaagatgcccccaagaacaaggacctggtggagtggctgaagctgcaccccacctacacagtggacatgcccagctatgtgcccaagaatgctgatgtgctcttcagcagcttccagaagcccaagcagaagaggcaccgctgcaggaaccccaacaagctggacatcaacaccctgaccggggaggagcgggtgcctgtggtgaacaagagaaatggcaagaagatgggcggggccatggccccacccatgaaggacctgccccgctggctggaggagaaccctgagtttgctgtggccccagactggacagacatcgtgaagcagagcggctttgtgcctgagagcatgtttgaccggctgctgactggacctgtggtgcggggggagggcgccagccggcggggcagaagacccaagtcagaaattgcccgggctgctgctgctgctgctgctgtggccagcaccagcggcatcaaccccctgctggtgaacagcctgtttgctggcatggacctgaccagcctgcagaacctgcagaacctgcagagcctgcagctggccggcctgatgggcttccccccaggcctggccacagctgccacagctggaggagatgccaagaacccagctgctgtgctgcccctgatgctgcccggcatggccggcctgcccaacgtgtttggcctgggcggcctgctgaacaaccccctgtctgctgccaccggcaacaccaccacagccagcagccagggcgagcctgaggacagcaccagcaagggggaggagaagggaaatgaaaatgaagatgagaacaaggacagcgagaagagcacagatgctgtgtctgctgctgacagcgccaatggatctgtgggcgccgccacagccccagctggcctgcccagcaaccccctggccttcaaccccttcctgctgagcaccatggcccctggcctcttctaccccagcatgttcctgcccccaggcctgggcggcctgaccctgcccggcttccctgccctggccggcctgcagaatgctgtgggcagcagcgaggagaaggctgctgacaaggccgagggcggccccttcaaggatggagagaccctggagggcagtgatgctgaggagagcctggacaagacagctgagagcagcctgctggaggatgaaattgcccagggcgaggagctggacagcctggatggaggagatgaaattgaaaataatgaaaatgatgaatag

SEQ ID NO: 147535 - DNA, 8994 bp, Artificial Sequence; identical to SEQ ID NO: 147534
  Description of Artificial Sequence: Synthetic coding sequence

SEQ ID NO: 147536 - DNA, 102 bp, Artificial Sequence
  Description of Artificial Sequence: Synthetic coding sequence
atggctgaccccggcatgatgagcctgtttggagaagatggcaacatcttcagcgagggcctggagggcctgggggagtgtggctacccagagaacccctag

SEQ ID NO: 147537 - DNA, 6906 bp, Artificial Sequence
  Description of Artificial Sequence: Synthetic coding sequence
aaaggagagagcaagaggatcaccctggtgctgcagcagccccagagcggcggcccccagggccaccgccacgtggtgctgggcagcctgcccgggaagatcgtgctgcagggcaaccagctggccgccctgacccaggccaagaatgcccagggccagcctgccaaggtggtgaccatccagctgcaggtgcagcagccccagcagaagatccagatcgtgccccagccccccagcagccagccccagccccagcagccccccagcacccagcctgtgaccctgagctctgtgcagcaggcccagatcatgggccctggccagagccctggccagaggctgtctgtgcctgtgaaggtggtgctgcagccccaggccggcagcagccagggcgccagcagcggcctgtctgtggtgaaggtgctgagcgccagcgaggtggccgccctgagcagccctgccagcagcgccccccacagcggcggcaagacaggcatggaggagaacagaaggctggagcaccagaagaagcaggagaaggccaaccgcatcgtggccgaggccatcgcccgggcccgggcccggggggagcagaacatcccccgggtgctgaatgaagatgagctgcccagcgtgcggcctgaggaggagggggagaagaagaggaggaagaagtctgctggggagcggctgaaggaggagaagcccaagaagagcaagaccagcggggccagcaagaccaagggcaagagcaagctgaacaccatcacccctgtggtgggcaagaagaggaagaggaacaccagcagtgacaacagtgatgtggaggtgatgcctgcccagagccccagagaagatgaggagagcagcatccagaagaggaggagcaaccggcaggtgaagaggaagaagtacacagaggacctggacatcaagatcacagatgatgaggaggaggaggaggtggatgtgacaggccccatcaagccagagcccatcctgcctgagcctgtgcaggagccagatggagagaccctgcccagcatgcagttctttgtggagaaccccagtgaagaagatgctgccatcgtggacaaggtgctgtccatgagaattgtgaagaaggagctgcccagcggccagtacacagaagctgaggagttctttgtgaagtacaagaactacagctacctgcactgtgagtgggccaccatcagccagctggagaaggacaagaggatccaccagaagctgaagcgcttcaagaccaagatggcccagatgaggcacttcttccatgaagatgaggagcccttcaacccagactatgtggaggtggaccgcatcctggatgagagccacagcattgacaaggacaacggggagcctgtgatctactacctggtgaagtggtgcagcctgccctatgaggacagcacctgggagctgaaggaggatgtggatgagggcaagatccgggagttcaagaggatccagagccgccaccctgagctgaagagggtgaaccggccccaggccagcgcctggaagaagctggagctgagccatgagtacaagaacagaaaccagctgcgggagtaccagctggagggcgtgaactggctgctcttcaactggtacaaccggcagaactgcatcctggctgatgagatgggcctgggcaagaccatccagagcatcgccttcctgcaggaggtgtacaacgtgggcatccacggccccttcctggtgattgcccccctgagcaccatcaccaactgggagcgggagttcaacacctggacagagatgaacaccatcgtgtaccacggcagcctggccagccggcagatgatccagcagtatgagatgtactgcaaggacagccggggccgcctcatccctggggcctacaagtttgatgccctgatcaccacctttgagatgatcctgagtgactgcccagagctgcgggagattgagtggcgctgcgtcatcattgatgaggcccaccggctgaagaacagaaactgcaagctgctggacagcctgaagcacatggacctggagcacaaggtgctgctgaccggcacccccctgcagaacacagtggaggagctgttcagcctgctgcacttcctggagcccagccagttccccagcgagagcgagttcctgaaggactttggagacctgaagacagaggagcaggtgcagaagctgcaggccatcctgaagcccatgatgctgcggcggctgaaggaggatgtggagaagaacctggcccccaagcaggagaccatcatcgaggtggagctgaccaacatccagaagaagtactaccgggccatcctggagaagaacttctccttcctgagcaagggggccggccacaccaacatgcccaacctgctgaacaccatgatggagctgaggaagtgctgcaaccacccctacctgatcaacggggctgaggagaagatcctgacagagttccgggaggcctgccacatcatcccccatgacttccacctgcaggccatggtgcgctctgctgggaagctggtgctgattgacaagctgctgcccaagctgaaggccggcggccacaaggtgctgatcttcagccagatggtgcgctgcctggacatcctggaggactacctgatccagaggcgctacctgtatgaaagaattgatggccgggtgcggggcaacctgcggcaggccgccatcgaccgcttcagcaagccagacagcgacagatttgtgttcctgctgtgcaccagggctgggggcctgggcatcaacctgacagctgctgacacctgcatcatctttgacagcgactggaacccccagaatgacctgcaggcccaggcccgctgccaccgcatcggccagagcaaggctgtgaaggtgtaccgcctcatcaccaggaacagctatgagcgggagatgtttgacaaggccagcctgaagctgggcctggacaaggctgtgctgcagagcatgagcggcagagatggcaacatcaccggcatccagcagttcagcaagaaggagattgaggacctgctgaggaaaggagcctatgctgccatcatggaggaggatgatgagggcagcaagttctgtgaggaggacatcgaccagatcctgctgcggaggaccaccaccatcaccattgaaagtgagggcaagggcagcacctttgccaaggccagctttgtggcctctgaaaatagaacagacatcagcctggatgaccccaacttctggcagaagtgggccaagaaggctgacctggacatggacctgctgaacagcaagaacaacctggtgattgacaccccccgggtgaggaagcagaccaggcacttcagcaccctgaaggatgatgacctggtggagttcagtgacctggagagtgaagatgatgagcggcccaggagcagaagacatgacagacaccacgcctacggccgcacagactgcttccgggtggagaagcacctgctggtgtatggctggggccgctggagggacatcctgagccacggccgcttcaagaggaggatgacagaaagagatgtggagaccatctgccgggccatcctggtgtactgcctgctgcactacagaggagatgagaacatcaagggcttcatctgggacctgatcagccctgcagaaaatggcaagaccaaggagctgcagaaccacagcggcctgagcatccctgtgccccggggcaggaagggcaagaaggtgaagagccagagcacctttgacatccacaaggctgactggatcaggaagtacaacccagacaccctcttccaggatgagagctacaagaagcacctgaagcaccagtgcaacaaggtgctgctgcgggtgaggatgctgtactacctgcggcaggaggtgattggagaccaggccgagaaggtgctgggcggggccatcgccagcgagattgacatctggttccctgtggtggaccagctggaggtgcccaccacctggtgggacagcgaggccgacaagagcctgctgattggagtcttcaagcacggctatgagaagtacaacaccatgagagctgaccctgccctgtgcttcctggagaaggccggccgcccagatgacaaggccatcgctgctgagcaccgggtgctggacaacttcagtgacatcgtggagggcgtggactttgacaaggactgtgaggaccctgagtacaagcccctgcagggcccccccaaggaccaggatgatgaaggagaccccctgatgatgatggatgaggagatctctgtgattgatggagatgaggcccaggtgacccagcagcccggccacctgttctggcccccaggcagcgccctgacagcccggctgcggcggctggtgacagcctaccagaggagctacaagcgggagcagatgaagattgaagctgctgagcggggggacagaagaagaagaagatgtgaggccgccttcaagctgaaggagatcgcccggcgggagaagcagcagcgctggacccggcgggagcagacagacttctacagagtggtgtccacctttggagtggagtatgaccctgacaccatgcagttccactgggaccgcttccgcacctttgcccggctggacaagaagacagatgagagcctgaccaagtacttccacggctttgtggccatgtgccggcaggtgtgccgcctgcccccagctgctggagatgagcccccagaccccaacctcttcatcgagcccatcacagaggagcgggccagcaggaccctgtaccgcatcgagctgctgcggcggctgcgggagcaggtgctgtgccaccccctgctggaggaccggctggccctgtgccagcccccaggccctgagctgcccaagtggtgggagcctgtgagacatgatggagagctgctgcggggagctgcccggcatggagtgtcccagacagactgcaacatcatgcaggaccctgacttctccttcctggccgccaggatgaactacatgcagaaccaccaggccggggccccagcccccagcctgagccgctgcagcacccccctgctgcaccagcagtacaccagcaggacagccagccccctgcccctgcggccagatgcccctgtggagaagagccctgaggagacagccacccaggtgcccagcctggagagcctgaccctgaagctggagcacgaggtggtggcccggagccggcccaccccccaggactatgagatgagggtgagccccagcgacaccacccccctggtgagccgctctgtgccccctgtgaagctggaggatgaagatgacagcgacagcgagctggacctgagcaagctgagccccagcagcagcagcagcagcagcagcagcagcagcagcagcagcacagatgaaagtgaagatgagaaggaggagaagctgacagaccagagccgcagcaagctgtatgatgaggagagcctgctgagcctgaccatgagccaggacggcttccccaatgaagatggagagcagatgaccccagagctgctgctgctgcaggagcggcagagggccagcgagtggcccaaggacagagtgctgatcaacagaattgacctggtgtgccaggccgtgctgagcggcaagtggcccagcagccgccgcagccaggagatggtgactggaggcatcctgggccctggcaaccacctgctggacagccccagcctgaccccaggagaatatggagacagccctgtgcccacccccaggagcagcagcgctgcctccatggccgaggaggaggccagcgctgtgtccacagctgctgcccagttcaccaagctgcggcggggcatggatgagaaggagttcaccgtgcagatcaaggatgaggagggcctgaagctgaccttccagaagcacaagctgatggccaatggagtgatgggagatggccaccccctcttccacaagaagaagggcaacaggaagaagctggtggagctggaggtggagtgcatggaggagcccaaccacctggatgtggacctggagacccgcatccctgtgatcaacaaggtggatggcaccctgctggtgggagaagatgcccccaggagagctgagctggagatgtggctgcagggccaccctgagtttgctgtggacccccgcttcctggcctacatggaggacaggaggaagcagaagtggcagcgctgcaagaagaacaacaaggccgagctgaactgcctgggcatggagcctgtgcagacagccaacagcagaaatggcaagaagggccaccacacagagaccgtcttcaacagagtgctgcccggccccatcgcccctgagagcagcaagaagagggcccggaggatgaggccagacctgagcaagatgatggccctgatgcagggcggcagcacaggcagcctgagcctgcacaacaccttccagcacagcagcagcggcctgcagagcgtgagcagcctgggccacagcagcgccaccagcgccagcctgcccttcatgccctttgtgatgggcggggcccccagcagcccccacgtggacagcagcaccatgctgcaccaccaccaccaccacccccacccccaccaccaccaccaccaccaccctggcctgcgggcccctggctaccccagcagccctgtgaccacagccagcggcaccaccctgcggctgccccccctgcagcctgaggaggatgatgatgaagatgaagaagatgatgatgacctgagccagggctatgacagcagcgagcgggacttcagcctgattgatgaccccatgatgcctgccaacagcgacagcagtgaagatgctgatgactag

SEQ ID NO: 147538 - DNA, 7746 bp, Artificial Sequence
  Description of Artificial Sequence: Synthetic coding sequence
atggctgaccccatcatggacctgtttgatgaccccaacctgtttggcctggacagcctgacagatgacagcttcaaccaggtgacccaggaccccatcgaggaggccctgggcctgcccagcagcctggacagcctggaccagatgaaccaggacggcggcggcggagatgtgggcaacagcagcgccagcgagctggtgcccccacctgaggagacagcccccacagagctgagcaaggagagcacagccccagcccctgagagcatcaccctgcatgactacaccacccagcctgccagccaggagcagcctgcccagcctgtgctgcagaccagcacccccaccagcggcctgctgcaggtgtccaagagccaggagatcctgagccagggcaaccccttcatgggcgtgtctgccacagctgtgagcagcagcagcgctgggggccagcccccccagagcgcccccaagatcgtcatcctgaaggccccacccagcagctctgtgactggagcccacgtggcccagatccaggcccagggcatcaccagcacagcccagcccctggtggccggcacagccaacggcggcaaggtgaccttcaccaaggtgctgaccggcacccccctgcggcctggggtgtccatcgtgtctggcaacacagtgctggccgccaaggtgcccggcaaccaggccgctgtgcagagaattgtgcagcccagcaggcctgtgaagcagctggtgctgcagcctgtgaagggcagcgccccagctggcaaccctggggccactggaccacccctgaagccagctgtgaccctgaccagcacccccacccagggcgagagcaagaggatcaccctggtgctgcagcagccccagagcggcggcccccagggccaccgccacgtggtgctgggcagcctgcccgggaagatcgtgctgcagggcaaccagctggccgccctgacccaggccaagaatgcccagggccagcctgccaaggtggtgaccatccagctgcaggtgcagcagccccagcagaagatccagatcgtgccccagccccccagcagccagccccagccccagcagccccccagcacccagcctgtgaccctgagctctgtgcagcaggcccagatcatgggccctggccagagccctggccagaggctgtctgtgcctgtgaaggtggtgctgcagccccaggccggcagcagccagggcgccagcagcggcctgtctgtggtgaaggtgctgagcgccagcgaggtggccgccctgagcagccctgccagcagcgccccccacagcggcggcaagacaggcatggaggagaacagaaggctggagcaccagaagaagcaggagaaggccaaccgcatcgtggccgaggccatcgcccgggcccgggcccggggggagcagaacatcccccgggtgctgaatgaagatgagctgcccagcgtgcggcctgaggaggagggggagaagaagaggaggaagaagtctgctggggagcggctgaaggaggagaagcccaagaagagcaagaccagcggggccagcaagaccaagggcaagagcaagctgaacaccatcacccctgtggtgggcaagaagaggaagaggaacaccagcagtgacaacagtgatgtggaggtgatgcctgcccagagccccagagaagatgaggagagcagcatccagaagaggaggagcaaccggcaggtgaagaggaagaagtacacagaggacctggacatcaagatcacagatgatgaggaggaggaggaggtggatgtgacaggccccatcaagccagagcccatcctgcctgagcctgtgcaggagccagatggagagaccctgcccagcatgcagttctttgtggagaaccccagtgaagaagatgctgccatcgtggacaaggtgctgtccatgagaattgtgaagaaggagctgcccagcggccagtacacagaagctgaggagttctttgtgaagtacaagaactacagctacctgcactgtgagtgggccaccatcagccagctggagaaggacaagaggatccaccagaagctgaagcgcttcaagaccaagatggcccagatgaggcacttcttccatgaagatgaggagcccttcaacccagactatgtggaggtggaccgcatcctggatgagagccacagcattgacaaggacaacggggagcctgtgatctactacctggtgaagtggtgcagcctgccctatgaggacagcacctgggagctgaaggaggatgtggatgagggcaagatccgggagttcaagaggatccagagccgccaccctgagctgaagagggtgaaccggccccaggccagcgcctggaagaagctggagctgagccatgagtacaagaacagaaaccagctgcgggagtaccagctggagggcgtgaactggctgctcttcaactggtacaaccggcagaactgcatcctggctgatgagatgggcctgggcaagaccatccagagcatcgccttcctgcaggaggtgtacaacgtgggcatccacggccccttcctggtgattgcccccctgagcaccatcaccaactgggagcgggagttcaacacctggacagagatgaacaccatcgtgtaccacggcagcctggccagccggcagatgatccagcagtatgagatgtactgcaaggacagccggggccgcctcatccctggggcctacaagtttgatgccctgatcaccacctttgagatgatcctgagtgactgcccagagctgcgggagattgagtggcgctgcgtcatcattgatgaggcccaccggctgaagaacagaaactgcaagctgctggacagcctgaagcacatggacctggagcacaaggtgctgctgaccggcacccccctgcagaacacagtggaggagctgttcagcctgctgcacttcctggagcccagccagttccccagcgagagcgagttcctgaaggactttggagacctgaagacagaggagcaggtgcagaagctgcaggccatcctgaagcccatgatgctgcggcggctgaaggaggatgtggagaagaacctggcccccaagcaggagaccatcatcgaggtggagctgaccaacatccagaagaagtactaccgggccatcctggagaagaacttctccttcctgagcaagggggccggccacaccaacatgcccaacctgctgaacaccatgatggagctgaggaagtgctgcaaccacccctacctgatcaacggggctgaggagaagatcctgacagagttccgggaggcctgccacatcatcccccatgacttccacctgcaggccatggtgcgctctgctgggaagctggtgctgattgacaagctgctgcccaagctgaaggccggcggccacaaggtgctgatcttcagccagatggtgcgctgcctggacatcctggaggactacctgatccagaggcgctacctgtatgaaagaattgatggccgggtgcggggcaacctgcggcaggccgccatcgaccgcttcagcaagccagacagcgacagatttgtgttcctgctgtgcaccagggctgggggcctgggcatcaacctgacagctgctgacacctgcatcatctttgacagcgactggaacccccagaatgacctgcaggcccaggcccgctgccaccgcatcggccagagcaaggctgtgaaggtgtaccgcctcatcaccaggaacagctatgagcgggagatgtttgacaaggccagcctgaagctgggcctggacaaggctgtgctgcagagcatgagcggcagagatggcaacatcaccggcatccagcagttcagcaagaaggagattgaggacctgctgaggaaaggagcctatgctgccatcatggaggaggatgatgagggcagcaagttctgtgaggaggacatcgaccagatcctgctgcggaggaccaccaccatcaccattgaaagtgagggcaagggcagcacctttgccaaggccagctttgtggcctctgaaaatagaacagacatcagcctggatgaccccaacttctggcagaagtgggccaagaaggctgacctggacatggacctgctgaacagcaagaacaacctggtgattgacaccccccgggtgaggaagcagaccaggcacttcagcaccctgaaggatgatgacctggtggagttcagtgacctggagagtgaagatgatgagcggcccaggagcagaagacatgacagacaccacgcctacggccgcacagactgcttccgggtggagaagcacctgctggtgtatggctggggccgctggagggacatcctgagccacggccgcttcaagaggaggatgacagaaagagatgtggagaccatctgccgggccatcctggtgtactgcctgctgcactacagaggagatgagaacatcaagggcttcatctgggacctgatcagccctgcagaaaatggcaagaccaaggagctgcagaaccacagcggcctgagcatccctgtgccccggggcaggaagggcaagaaggtgaagagccagagcacctttgacatccacaaggctgactggatcaggaagtacaacccagacaccctcttccaggatgagagctacaagaagcacctgaagcaccagtgcaacaaggtgctgctgcgggtgaggatgctgtactacctgcggcaggaggtgattggagaccaggccgagaaggtgctgggcggggccatcgccagcgagattgacatctggttccctgtggtggaccagctggaggtgcccaccacctggtgggacagcgaggccgacaagagcctgctgattggagtcttcaagcacggctatgagaagtacaacaccatgagagctgaccctgccctgtgcttcctggagaaggccggccgcccagatgacaaggccatcgctgctgagcaccgggtgctggacaacttcagtgacatcgtggagggcgtggactttgacaaggactgtgaggaccctgagtacaagcccctgcagggcccccccaaggaccaggatgatgaaggagaccccctgatgatgatggatgaggagatctctgtgattgatggagatgaggcccaggtgacccagcagcccggccacctgttctggcccccaggcagcgccctgacagcccggctgcggcggctggtgacagcctaccagaggagctacaagcgggagcagatgaagattgaagctgctgagcggggggacagaagaagaagaagatgtgaggccgccttcaagctgaaggagatcgcccggcgggagaagcagcagcgctggacccggcgggagcagacagacttctacagagtggtgtccacctttggagtggagtatgaccctgacaccatgcagttccactgggaccgcttccgcacctttgcccggctggacaagaagacagatgagagcctgaccaagtacttccacggctttgtggccatgtgccggcaggtgtgccgcctgcccccagctgctggagatgagcccccagaccccaacctcttcatcgagcccatcacagaggagcgggccagcaggaccctgtaccgcatcgagctgctgcggcggctgcgggagcaggtgctgtgccaccccctgctggaggaccggctggccctgtgccagcccccaggccctgagctgcccaagtggtgggagcctgtgagacatgatggagagctgctgcggggagctgcccggcatggagtgtcccagacagactgcaacatcatgcaggaccctgacttctccttcctggccgccaggatgaactacatgcagaaccaccaggccggggccccagcccccagcctgagccgctgcagcacccccctgctgcaccagcagtacaccagcaggacagccagccccctgcccctgcggccagatgcccctgtggagaagagccctgaggagacagccacccaggtgcccagcctggagagcctgaccctgaagctggagcacgaggtggtggcccggagccggcccaccccccaggactatgagatgagggtgagccccagcgacaccacccccctggtgagccgctctgtgccccctgtgaagctggaggatgaagatgacagcgacagcgagctggacctgagcaagctgagccccagcagcagcagcagcagcagcagcagcagcagcagcagcagcacagatgaaagtgaagatgagaaggaggagaagctgacagaccagagccgcagcaagctgtatgatgaggagagcctgctgagcctgaccatgagccaggacggcttccccaatgaagatggagagcagatgaccccagagctgctgctgctgcaggagcggcagagggccagcgagtggcccaaggacagagtgctgatcaacagaattgacctggtgtgccaggccgtgctgagcggcaagtggcccagcagccgccgcagccaggagatggtgactggaggcatcctgggccctggcaaccacctgctggacagccccagcctgaccccaggagaatatggagacagccctgtgcccacccccaggagcagcagcgctgcctccatggccgaggaggaggccagcgctgtgtccacagctgctgcccagttcaccaagctgcggcggggcatggatgagaaggagttcaccgtgcagatcaaggatgaggagggcctgaagctgaccttccagaagcacaagctgatggccaatggagtgatgggagatggccaccccctcttccacaagaagaagggcaacaggaagaagctggtggagctggaggtggagtgcatggaggagcccaaccacctggatgtggacctggagacccgcatccctgtgatcaacaaggtggatggcaccctgctggtgggagaagatgcccccaggagagctgagctggagatgtggctgcagggccaccctgagtttgctgtggacccccgcttcctggcctacatggaggacaggaggaagcagaagtggcagcgctgcaagaagaacaacaaggccgagctgaactgcctgggcatggagcctgtgcagacagccaacagcagaaatggcaagaagggccaccacacagagaccgtcttcaacagagtgctgcccggccccatcgcccctgagagcagcaagaagagggcccggaggatgaggccagacctgagcaagatgatggccctgatgcagggcggcagcacaggcagcctgagcctgcacaacaccttccagcacagcagcagcggcctgcagagcgtgagcagcctgggccacagcagcgccaccagcgccagcctgcccttcatgccctttgtgatgggcggggcccccagcagcccccacgtggacagcagcaccatgctgcaccaccaccaccaccacccccacccccaccaccaccaccaccaccaccctggcctgcgggcccctggctaccccagcagccctgtgaccacagccagcggcaccaccctgcggctgccccccctgcagcctgaggaggatgatgatgaagatgaagaagatgatgatgacctgagccagggctatgacagcagcgagcgggacttcagcctgattgatgaccccatgatgcctgccaacagcgacagcagtgaagatgctgatgactag

SEQ ID NO: 147539 - DNA, 6909 bp, Artificial Sequence
  Description of Artificial Sequence: Synthetic coding sequence
atgaagggggagagcaagaggatcaccctggtgctgcagcagccccagagcggcggcccccagggccacagacatgtggtgctgggcagcctgcccgggaagatcgtgctgcagggcaaccagctggccgccctgacccaggccaagaatgcccagggccagcctgccaaggtggtgaccatccagctgcaggtgcagcagccccagcagaagatccagatcgtgccccagccccccagcagccagccccagccccagcagccccccagcacccagcctgtgaccctgagctctgtgcagcaggcccagatcatgggccctggccagagccctggccagaggctgtctgtgcctgtgaaggtggtgctgcagccccaggccggcagcagccagggcgccagcagcggcctgtctgtggtgaaggtgctgagcgccagcgaggtggccgccctgagcagccctgccagcagcgccccccacagcggcggcaagacaggcatggaggagaacagaaggctggagcaccagaagaagcaggagaaggccaacagaattgtggccgaggccatcgcccgggcccgggcccggggggagcagaacatcccccgggtgctgaatgaagatgagctgcccagcgtgcggcctgaggaggagggggagaagaagaggaggaagaagtctgctggggagcggctgaaggaggagaagcccaagaagagcaagaccagcggggccagcaagaccaagggcaagagcaagctgaacaccatcacccctgtggtgggcaagaagaggaagaggaacaccagcagtgacaacagtgatgtggaggtgatgcctgcccagagcccccgggaggatgaggagagcagcatccagaagagaagaagcaaccggcaggtgaagaggaagaagtacacagaggacctggacatcaagatcacagatgatgaggaggaggaggaggtggatgtgacaggccccatcaagccagagcccatcctgcctgagcctgtgcaggagccagatggagagaccctgcccagcatgcagttctttgtggagaaccccagcgaggaggatgctgccatcgtggacaaggtgctgtccatgagaattgtgaagaaggagctgcccagcggccagtacacagaggccgaggagttctttgtgaagtacaagaactacagctacctgcactgtgagtgggccaccatcagccagctggagaaggacaagaggatccaccagaagctgaagcgcttcaagaccaagatggcccagatgaggcacttcttccatgaagatgaggagcccttcaacccagactatgtggaggtggaccgcatcctggatgagagccacagcattgacaaggacaatggagagcccgtcatctactacctggtgaagtggtgcagcctgccctatgaggacagcacctgggagctgaaggaggatgtggatgagggcaagatccgggagttcaagaggatccagagccgccaccctgagctgaagagggtgaaccggccccaggccagcgcctggaagaagctggagctgagccatgagtacaagaacagaaaccagctgcgggagtaccagctggagggcgtgaactggctgctcttcaactggtacaaccggcagaactgcatcctggctgatgagatgggcctgggcaagaccatccagagcatcgccttcctgcaggaggtgtacaacgtgggcatccacggccccttcctggtgattgcccccctgagcaccatcaccaactgggagcgggagttcaacacctggacagagatgaacaccatcgtgtaccacggcagcctggccagccggcagatgatccagcagtatgagatgtactgcaaggacagccggggccgcctcatccctggggcctacaagtttgatgccctgatcaccacctttgagatgatcctgagtgactgcccagagctgcgggagattgagtggaggtgtgtgatcattgatgaggcccaccggctgaagaacagaaactgcaagctgctggacagcctgaagcacatggacctggagcacaaggtgctgctgaccggcacccccctgcagaacacagtggaggagctgttcagcctgctgcacttcctggagcccagccagttccccagcgagagcgagttcctgaaggactttggagacctgaagacagaggagcaggtgcagaagctgcaggccatcctgaagcccatgatgctgcggcggctgaaggaggatgtggagaagaacctggcccccaagcaggagaccatcatcgaggtggagctgaccaacatccagaagaagtactaccgggccatcctggagaagaacttctccttcctgagcaaaggagctggccacaccaacatgcccaacctgctgaacaccatgatggagctgaggaagtgctgcaaccacccctacctgatcaatggagctgaggagaagatcctgacagagttccgggaggcctgccacatcatcccccatgacttccacctgcaggccatggtgcgctctgctgggaagctggtgctgattgacaagctgctgcccaagctgaaggccggcggccacaaggtgctgatcttcagccagatggtgcgctgcctggacatcctggaggactacctgatccagaggcgctacctgtatgaaagaattgatggccgggtgcggggcaacctgcggcaggccgccatcgaccgcttcagcaagccagacagcgacagatttgtgttcctgctgtgcacccgggccggcggcctgggcatcaacctgacagctgctgacacctgcatcatctttgacagcgactggaacccccagaatgacctgcaggcccaggcccgctgccacagaattggccagagcaaggctgtgaaggtgtaccgcctcatcaccagaaattcctatgaaagagagatgtttgacaaggccagcctgaagctgggcctggacaaggctgtgctgcagagcatgagcggcagagatggcaacatcaccggcatccagcagttcagcaagaaggagattgaggacctgctgaggaagggggcctatgctgccatcatggaggaggatgatgagggcagcaagttctgtgaagaagatattgaccagatcctgctgcggaggaccaccaccatcaccatcgagagcgagggcaagggcagcacctttgccaaggccagctttgtggccagcgagaacagaacagacatcagcctggatgaccccaacttctggcagaagtgggccaagaaggctgacctggacatggacctgctgaacagcaagaacaacctggtgattgacaccccccgggtgaggaagcagaccaggcacttcagcaccctgaaggatgatgacctggtggagttcagtgacctggagagtgaagatgatgagcggcccaggagcagaagacatgacagacaccacgcctacggccgcacagactgcttccgggtggagaagcacctgctggtgtatggctggggccgctggagggacatcctgagccacggccgcttcaagaggaggatgacagaaagagatgtggagaccatctgccgggccatcctggtgtactgcctgctgcactacagaggagatgagaacatcaagggcttcatctgggacctgatcagccctgcagaaaatggcaagaccaaggagctgcagaaccacagcggcctgagcatccctgtgccccggggcaggaagggcaagaaggtgaagagccagagcacctttgacatccacaaggctgactggatcaggaagtacaacccagacaccctcttccaggatgagagctacaagaagcacctgaagcaccagtgcaacaaggtgctgctgcgggtgaggatgctgtactacctgcggcaggaggtgattggagaccaggccgagaaggtgctgggcggggccatcgccagcgagattgacatctggttccctgtggtggaccagctggaggtgcccaccacctggtgggacagcgaggccgacaagagcctgctgattggagtcttcaagcacggctatgagaagtacaacaccatgagagctgaccctgccctgtgcttcctggagaaggccggccgcccagatgacaaggccatcgctgctgagcaccgggtgctggacaacttcagtgacatcgtggagggcgtggactttgacaaggactgtgaagatcctgagtacaagcccctgcagggcccccccaaggaccaggatgatgaaggagaccccctgatgatgatggatgaggagatctctgtgattgatggagatgaggcccaggtgacccagcagcccggccacctgttctggcccccaggcagcgccctgacagcccggctgcggcggctggtgacagcctaccagaggagctacaagcgggagcagatgaagattgaggccgctgagcggggggacagaagaagaagaagatgtgaggccgccttcaagctgaaggagatcgcccggcgggagaagcagcagcgctggacccggcgggagcagacagacttctacagagtggtgtccaccttcggcgtggagtatgaccctgacaccatgcagttccactgggaccgcttccgcacctttgcccggctggacaagaagacagatgagagcctgaccaagtacttccacggctttgtggccatgtgccggcaggtgtgccgcctgcccccagctgctggagatgagcccccagaccccaacctcttcatcgagcccatcacagaggagcgggccagcaggaccctgtacagaattgagctgctgcggcggctgcgggagcaggtgctgtgccaccccctgctggaggaccggctggccctgtgccagcccccaggccctgagctgcccaagtggtgggagcctgtgagacatgatggagagctgctgcggggggccgcccggcatggagtgtcccagacagactgcaacatcatgcaggaccctgacttctccttcctggccgccaggatgaactacatgcagaaccaccaggccggggccccagcccccagcctgagccgctgcagcacccccctgctgcaccagcagtacaccagcaggacagccagccccctgcccctgcggccagatgcccctgtggagaagagccctgaggagacagccacccaggtgcccagcctggagagcctgaccctgaagctggagcacgaggtggtggcccggagccggcccaccccccaggactatgagatgagggtgagccccagcgacaccacccccctggtgagccgctctgtgccccctgtgaagctggaggatgaagatgacagcgacagcgagctggacctgagcaagctgagccccagcagcagcagcagcagcagcagcagcagcagcagcagcagcacagatgaaagtgaagatgagaaggaggagaagctgacagaccagagccgcagcaagctgtatgatgaggagagcctgctgagcctgaccatgagccaggacggcttccccaatgaagatggagagcagatgaccccagagctgctgctgctgcaggagcggcagagggccagcgagtggcccaaggacagagtgctgatcaacagaattgacctggtgtgccaggccgtgctgagcggcaagtggcccagcagcagaagaagccaggagatggtgactggaggcatcctgggccctggcaaccacctgctggacagccccagcctgaccccaggagaatatggagacagccctgtgcccacccccaggagcagcagcgctgcctccatggccgaggaggaggccagcgctgtgtccacagctgctgcccagttcaccaagctgcggcggggcatggatgagaaggagttcaccgtgcagatcaaggatgaggagggcctgaagctgaccttccagaagcacaagctgatggccaacggggtgatgggagatggccaccccctcttccacaagaagaagggcaacaggaagaagctggtggagctggaggtggagtgcatggaggagcccaaccacctggatgtggacctggagacccgcatccctgtgatcaacaaggtggatggcaccctgctggtgggggaggatgccccccggcgggcagagctggagatgtggctgcagggccaccctgagtttgctgtggacccccgcttcctggcctacatggaggacaggaggaagcagaagtggcagcgctgcaagaagaacaacaaggccgagctgaactgcctgggcatggagcctgtgcagacagccaacagcagaaatggcaagaagggccaccacacagaaacagtgttcaacagagtgctgcccggccccatcgcccctgagagcagcaagaagagggcccggaggatgaggccagacctgagcaagatgatggccctgatgcagggcggcagcacaggcagcctgagcctgcacaacaccttccagcacagcagcagcggcctgcagagcgtgagcagcctgggccacagcagcgccaccagcgccagcctgcccttcatgccctttgtgatgggcggggcccccagcagcccccacgtggacagcagcaccatgctgcaccaccaccaccaccacccccacccccaccaccaccaccaccaccaccctggcctgcgggcccctggctaccccagcagccctgtgaccacagccagcggcaccaccctgcggctgccccccctgcagccagaagaagatgatgatgaagatgaggaggatgatgatgacctgagccagggctatgacagcagcgagcgggacttcagcctgattgatgaccccatgatgcctgccaacagcgacagcagtgaagatgctgatgactag

SEQ ID NO: 147540 - DNA, 7746 bp, Artificial Sequence; identical to SEQ ID NO: 147538
  Description of Artificial Sequence: Synthetic coding sequence

SEQ ID NO: 147541 - DNA, 1797 bp, Artificial Sequence
  Description of Artificial Sequence: Synthetic coding sequence
atgaccttccaggccagccacaggtctgcctggggcaagagcaggaagaagaactggcagtatgagggccccacccagaagctgttcctgaagaggaacaacgtgtctgccccagatggccccagcgaccccagcatctctgtgagcagcgagcagagcggggcccagcagcccccagccctgcaggtggagcgcatcgtggacaagaggaagaacaagaagggcaagacagagtacctggtgcgctggaagggctatgacagtgaagatgacacctgggagcctgagcagcacctggtgaactgtgaggagtacatccatgacttcaacagaagacacacagagaagcagaaggagagcaccctgaccaggaccaacagaaccagccccaacaatgccaggaagcagatcagccgcagcaccaacagcaacttcagcaagaccagccccaaggccctggtgattggcaaggaccacgagagcaagaacagccagctgtttgctgccagccagaagttcaggaagaacacagcccccagcctgagcagcaggaagaacatggacctggccaagagcggcatcaagatcctggtgcccaagagccctgtgaagagcaggacagctgtggatggcttccagagcgagagccctgagaagctggaccctgtggagcagggccaggaggacacagtggcccctgaggtggccgctgagaagcctgtgggcgccctgctgggccctggagctgagcgggccaggatgggcagccggccccgcatccaccccctggtgccccaggtgcccggccctgtgacagctgccatggccaccggcctggccgtgaatggcaagggcaccagccccttcatggatgccctgacagccaacggcaccaccaacatccagacctctgtgactggagtgacagccagcaagaggaagttcattgatgacagaagagaccagccctttgacaagaggctgcgcttctctgtgcggcagacagaaagtgcctaccgctacagagacatcgtggtgaggaagcaggacggcttcacccacatcctgctgagcaccaagagcagcgagaacaacagcctgaaccctgaggtgatgagggaggtgcagagcgccctgagcacagctgctgctgatgacagcaagctggtgctgctgtctgctgtgggctctgtgttctgctgcggcctggacttcatctacttcatccggcggctgacagatgacaggaagcgggagagcaccaagatggccgaggccatccggaactttgtgaacaccttcatccagttcaagaagcccatcatcgtggccgtgaatggacctgccatcggcctgggcgccagcatcctgcccctgtgtgatgtggtgtgggccaatgagaaggcctggttccagaccccctacaccaccttcggccagagcccagatggctgcagcacagtgatgttccccaagatcatgggcggggccagcgccaatgagatgctgctgagcggcaggaagctgacagcccaggaggcctgtgggaagggcctggtgtcccaggtgttctggccaggcaccttcacccaggaggtgatggtgcgcatcaaggagctggccagctgcaaccctgtggtgctggaggagagcaaggccctggtgcgctgcaacatgaagatggagctggagcaggccaatgaaagagaatgtgaggtgctgaagaagatctggggcagcgcccagggcatggacagcatgctgaagtacctgcagaggaagattgatgagttctag

SEQ ID NO: 147542 - DNA, 1239 bp, Artificial Sequence
  Description of Artificial Sequence: Synthetic coding sequence
atggacctggccaagagcggcatcaagatcctggtgcccaagagccctgtgaagagcaggacagctgtggatggcttccagagcgagagccctgagaagctggaccctgtggagcagggccaggaggacacagtggcccctgaggtggccgctgagaagcctgtgggcgccctgctgggccctggagctgagcgggccaggatgggcagccggccccgcatccaccccctggtgccccaggtgcccggccctgtgacagctgccatggccaccggcctggccgtgaatggcaagggcaccagccccttcatggatgccctgacagccaacggcaccaccaacatccagacctctgtgactggagtgacagccagcaagaggaagttcattgatgacagaagagaccagccctttgacaagaggctgcgcttctctgtgcggcagacagaaagtgcctaccgctacagagacatcgtggtgaggaagcaggacggcttcacccacatcctgctgagcaccaagagcagcgagaacaacagcctgaaccctgaggtgatgagggaggtgcagagcgccctgagcacagctgctgctgatgacagcaagctggtgctgctgtctgctgtgggctctgtgttctgctgcggcctggacttcatctacttcatccggcggctgacagatgacaggaagcgggagagcaccaagatggccgaggccatccggaactttgtgaacaccttcatccagttcaagaagcccatcatcgtggccgtgaatggacctgccatcggcctgggcgccagcatcctgcccctgtgtgatgtggtgtgggccaatgagaaggcctggttccagaccccctacaccaccttcggccagagcccagatggctgcagcacagtgatgttccccaagatcatgggcggggccagcgccaatgagatgctgctgagcggcaggaagctgacagcccaggaggcctgtgggaagggcctggtgtcccaggtgttctggccaggcaccttcacccaggaggtgatggtgcgcatcaaggagctggccagctgcaaccctgtggtgctggaggagagcaaggccctggtgcgctgcaacatgaagatggagctggagcaggccaatgaaagagaatgtgaggtgctgaagaagatctggggcagcgcccagggcatggacagcatgctgaagtacctgcagaggaagattgatgagttctag

SEQ ID NO: 147543 - DNA, 1635 bp, Artificial Sequence
  Description of Artificial Sequence: Synthetic coding sequence
atggccagcgaggagctgtatgaggtggagcgcatcgtggacaagaggaagaacaagaagggcaagacagagtacctggtgcgctggaagggctatgacagtgaagatgacacctgggagcctgagcagcacctggtgaactgtgaggagtacatccatgacttcaacagaagacacacagagaagcagaaggagagcaccctgaccaggaccaacagaaccagccccaacaatgccaggaagcagatcagccgcagcaccaacagcaacttcagcaagaccagccccaaggccctggtgattggcaaggaccacgagagcaagaacagccagctgtttgctgccagccagaagttcaggaagaacacagcccccagcctgagcagcaggaagaacatggacctggccaagagcggcatcaagatcctggtgcccaagagccctgtgaagagcaggacagctgtggatggcttccagagcgagagccctgagaagctggaccctgtggagcagggccaggaggacacagtggcccctgaggtggccgctgagaagcctgtgggcgccctgctgggccctggagctgagcgggccaggatgggcagccggccccgcatccaccccctggtgccccaggtgcccggccctgtgacagctgccatggccaccggcctggccgtgaatggcaagggcaccagccccttcatggatgccctgacagccaacggcaccaccaacatccagacctctgtgactggagtgacagccagcaagaggaagttcattgatgacagaagagaccagccctttgacaagaggctgcgcttctctgtgcggcagacagaaagtgcctaccgctacagagacatcgtggtgaggaagcaggacggcttcacccacatcctgctgagcaccaagagcagcgagaacaacagcctgaaccctgaggtgatgagggaggtgcagagcgccctgagcacagctgctgctgatgacagcaagctggtgctgctgtctgctgtgggctctgtgttctgctgcggcctggacttcatctacttcatccggcggctgacagatgacaggaagcgggagagcaccaagatggccgaggccatccggaactttgtgaacaccttcatccagttcaagaagcccatcatcgtggccgtgaatggacctgccatcggcctgggcgccagcatcctgcccctgtgtgatgtggtgtgggccaatgagaaggcctggttccagaccccctacaccaccttcggccagagcccagatggctgcagcacagtgatgttccccaagatcatgggcggggccagcgccaatgagatgctgctgagcggcaggaagctgacagcccaggaggcctgtgggaagggcctggtgtcccaggtgttctggccaggcaccttcacccaggaggtgatggtgcgcatcaaggagctggccagctgcaaccctgtggtgctggaggagagcaaggccctggtgcgctgcaacatgaagatggagctggagcaggccaatgaaagagaatgtgaggtgctgaagaagatctggggcagcgcccagggcatggacagcatgctgaagtacctgcagaggaagattgatgagttctag

SEQ ID NO: 147544 - DNA, 1239 bp, Artificial Sequence; identical to SEQ ID NO: 147542
  Description of Artificial Sequence: Synthetic coding sequence

SEQ ID NO: 147545 - DNA, 1665 bp, Artificial Sequence
  Description of Artificial Sequence: Synthetic coding sequence
atggccagccaggagtttgaggtggaggccatcgtggacaagaggcaggacaagaatggaaacacccagtacctggtgcgctggaagggctatgacaagcaggatgacacctgggagcctgagcagcacctgatgaactgtgagaagtgtgtgcatgacttcaacagacggcagacagagaagcagaagaagctgacctggaccaccaccagccgcatcttcagcaacaatgcccggcggaggaccagccgcagcaccaaggccaactacagcaagaacagccccaagacccctgtgacagacaagcaccacaggagcaagaacaggaagctgtttgctgccagcaagaatgtgcggaggaaggccgccagcatcctgagtgacaccaagaacatggagatcatcaacagcaccatcgagaccctggccccagacagcccctttgaccacaagacagtgtctggcttccagaagctggagaagctggaccccatcgctgctgaccagcaggacacagtggtgttcaaggtgacagagggcaagctgctgcgggaccccctgagcaggcctggagctgagcagacaggcatccagaacaagacccagatccaccccctgatgagccagatgagcggctctgtgacagcctccatggccaccggcagcgccaccaggaagggcatcgtggtgctgattgaccccctggccgccaacggcaccacagacatgcacacctctgtgccccgggtgaagggcggccagaggaacatcacagatgacagccgggaccagcccttcatcaagaagatgcacttcaccatccggctgacagaaagtgccagcacctacagagacatcgtggtgaagaaggaggatggcttcacccagatcgtgctgagcaccaggagcacagagaagaatgccctgaacacagaggtgatcaaggagatcgtgaatgccctgaacagcgctgctgctgatgacagcaagctggtgctcttctctgctgctggctctgtgttctgctgcggcctggactttggctactttgtgaagcacctgaggaacaacagaaacacagccagcctggagatggtggacaccatcaagaactttgtgaacaccttcatccagttcaagaagcccatcgtggtgtctgtgaatggacctgccatcggcctgggcgccagcatcctgcccctgtgtgacctggtgtgggccaatgagaaggcctggttccagaccccctacaccaccttcggccagagcccagatggctgcagcagcatcaccttccccaagatgatgggcaaggccagcgccaatgagatgctgattgctggcaggaagctgacagcccgggaggcctgtgccaagggcctggtgtcccaggtgttcctgaccggcaccttcacccaggaggtgatgatccagatcaaggagctggccagctacaaccccatcgtgctggaggagtgcaaggccctggtgcgctgcaacatcaagctggagctggagcaggccaatgaaagagaatgtgaggtgctgaggaagatctggagcagcgcccagggcatcgagagcatgctgaagatccccctgctgggctacaaggccgccttcccccccaggaagacccagaatgaccagcgctggtgcccctag

SEQ ID NO: 147546 - DNA, 1623 bp, Artificial Sequence
  Description of Artificial Sequence: Synthetic coding sequence
atggccagccaggagtttgaggtggaggccatcgtggacaagaggcaggacaagaatggaaacacccagtacctggtgcgctggaagggctatgacaagcaggatgacacctgggagcctgagcagcacctgatgaactgtgagaagtgtgtgcatgacttcaacagacggcagacagagaagcagaagaagctgacctggaccaccaccagccgcatcttcagcaacaatgcccggcggaggaccagccgcagcaccaaggccaactacagcaagaacagccccaagacccctgtgacagacaagcaccacaggagcaagaacaggaagctgtttgctgccagcaagaatgtgcggaggaaggccgccagcatcctgagtgacaccaagaacatggagatcatcaacagcaccatcgagaccctggccccagacagcccctttgaccacaagacagtgtctggcttccagaagctggagaagctggaccccatcgctgctgaccagcaggacacagtggtgttcaaggtgacagagggcaagctgctgcgggaccccctgagcaggcctggagctgagcagacaggcatccagaacaagacccagatccaccccctgatgagccagatgagcggctctgtgacagcctccatggccaccggcagcgccaccaggaagggcatcgtggtgctgattgaccccctggccgccaacggcaccacagacatgcacacctctgtgccccgggtgaagggcggccagaggaacatcacagatgacagccgggaccagcccttcatcaagaagatgcacttcaccatccggctgacagaaagtgccagcacctacagagacatcgtggtgaagaaggaggatggcttcacccagatcgtgctgagcaccaggagcacagagaagaatgccctgaacacagaggtgatcaaggagatcgtgaatgccctgaacagcgctgctgctgatgacagcaagctggtgctcttctctgctgctggctctgtgttctgctgcggcctggactttggctactttgtgaagcacctgaggaacaacagaaacacagccagcctggagatggtggacaccatcaagaactttgtgaacaccttcatccagttcaagaagcccatcgtggtgtctgtgaatggacctgccatcggcctgggcgccagcatcctgcccctgtgtgacctggtgtgggccaatgagaaggcctggttccagaccccctacaccaccttcggccagagcccagatggctgcagcagcatcaccttccccaagatgatgggcaaggccagcgccaatgagatgctgattgctggcaggaagctgacagcccgggaggcctgtgccaagggcctggtgtcccaggtgttcctgaccggcaccttcacccaggaggtgatgatccagatcaaggagctggccagctacaaccccatcgtgctggaggagtgcaaggccctggtgcgctgcaacatcaagctggagctggagcaggccaatgaaagagaatgtgaggtgctgaggaagatctggagcagcgcccagggcatcgagagcatgctgaagtatgtggagaacaagattgatgagttctag

SEQ ID NO: 147547 - DNA, 1170 bp, Artificial Sequence
  Description of Artificial Sequence: Synthetic coding sequence
atgggcaagatggctgctgctgtgggctctgtggccaccctggccacagagcccggggaggatgccttcaggaagctgttccgcttctaccggcagagcaggcctggaacagctgacctggagggcgtcatcgacttctctgctgcccatgctgcccggggcaaaggacctggggcccagaaggtgatcaagagccagctgaatgtgtcctctgtgtctgagcagaatgcctaccgggccggcctgcagcctgtgtccaagtggcaggcctacggcctgaagggctacccaggcttcatcttcatccccaaccccttcctgcccggctaccagtggcactgggtgaagcagtgcctgaagctgtacagccagaagcccaacgtgtgcaacctggacaagcacatgagcaaggaggagacccaggacctgtgggagcagagcaaggagttcctgcgctacaaggaggccaccaagagaagacccaggagcctgctggagaagctgcgctgggtgacagtgggctaccactacaactgggacagcaagaagtacagcgctgaccactacacccccttccccagcgacctgggcttcctgtctgagcaggtggccgccgcctgtggctttgaggacttccgggcagaggccggcatcctgaactactaccgcctggacagcaccctgggcatccacgtggacagaagtgagctggaccacagcaagcccctgctgtccttctcctttggccagagcgccatcttcctgctgggcggcctgcagagagatgaggcccccacagccatgttcatgcacagcggggacatcatgatcatgagcggcttcagccggctgctgaaccacgctgtgccccgggtgctgcccaaccctgagggggagggcctgccccactgcctggaggcccccctgcctgctgtgctgccccgggacagcatggtggagccctgcagcatggaggactggcaggtgtgtgccagctacctgaagacagcccgggtgaacatgacagtgcggcaggtgctggccacagaccagaacttccccctggagcccattgaagatgagaagagggacatcagcacagagggcttctgccacctggatgaccagaacagcgaggtgaagagggcccgcatcaacccagacagctag

SEQ ID NO: 147548 - DNA, 921 bp, Artificial Sequence
  Description of Artificial Sequence: Synthetic coding sequence
atgaggtctgctgctgtgctggccctgctgctgtgtgccggccaggtgacagccctgcctgtgaacagccccatgaacaagggggacacagaggtgatgaagtgcatcgtggaggtgatcagtgacaccctgagcaagcccagccccatgcctgtgtcccaggagtgctttgagaccctgcggggagatgagcgcatcctgagcatcctgcggcaccagaacctgctgaaggagctgcaggacctggccctgcagggcgccaaggagcgggcccaccagcagaagaagcacagcggctttgaagatgagctgtctgaggtgctggagaaccagagcagccaggccgagctgaagggccgctctgaggccctggccgtggatggagctgggaagccaggagctgaggaggcccaggaccctgagggcaaaggagagcaggagcacagccagcagaaggaggaggaggaggagatggctgtggtgccccagggcctcttccggggcggcaagtctggagagctggagcaggaggaggagcggctgagcaaggagtgggaggacagcaagcgctggagcaagatggaccagctggccaaggagctgacagctgagaagaggctggagggccaggaggaggaggaggacaacagagacagctccatgaagctgtccttccgggcccgggcctacggcttccggggccctggcccccagctgcggcggggctggaggcccagcagccgggaggacagcctggaggccggcctgcccctgcaggtgcggggctacccagaggagaagaaggaggaggagggcagcgccaacagaagacctgaggaccaggagctggagagcctgagcgccattgaagctgagctggagaaggtggcccaccagctgcaggccctgcggcggggctag

SEQ ID NO: 147549 - DNA, 2034 bp, Artificial Sequence
  Description of Artificial Sequence: Synthetic coding sequence
atgcagcccaccctgctgctgagcctgctgggcgctgtgggcctggccgctgtgaacagcatgcctgtggacaacagaaaccacaatgaaggcatggtgacccgctgcatcatcgaggtgctgagcaatgccctgagcaagagcagcgccccacccatcaccccagagtgccggcaggtgctgaagaccagcaggaaggatgtgaaggacaaggagaccacagaaaatgaaaacaccaagtttgaggtgcggctgctgcgggaccctgcagatgccagcgaggcccacgagagcagcagcagaggagaggccggggcccctggagaggaggacatccagggccccaccaaggctgacacagagaagtgggccgagggcggcggccacagccgggagcgggcagatgagccccagtggagcctgtaccccagcgacagccaggtgtctgaggaggtgaagaccaggcacagcgagaagagccagagagaagatgaggaggaggaggagggggagaactaccagaagggggagcggggggaggacagcagcgaggagaagcacctggaggagcctggagagacccagaatgccttcctgaatgaaaggaagcaggccagcgccatcaagaaggaggagctggtggcccggtctgagacccatgctgctggccacagccaggagaagacccacagccgggagaagagcagccaggagagcggggaggagaccggcagccaggagaaccacccccaggagagcaagggccagcccaggagccaggaggagagcgaggagggggaggaggatgccaccagcgaggtggacaagaggaggacccggcccaggcaccaccacggccgcagcaggccagacaggagcagccagggcggcagcctgcccagcgaggagaagggccacccccaggaggagagcgaggagagcaatgtgtccatggccagcctgggggagaagagggaccaccacagcacccactaccgggccagcgaggaggagccagaatatggagaggagatcaagggctacccaggagtgcaggcccctgaggacctggagtgggagcgctaccggggccggggcagcgaggagtaccgggccccccggccccagagcgaggagagctgggatgaggaggacaagaggaactaccccagcctggagctggacaagatggcccacggctatggagaggagagcgaggaggagcggggcctggagcccgggaagggccgccaccaccggggccggggcggggagccccgggcctacttcatgtctgacacccgggaggagaagcgcttcctgggggagggccaccaccgggtgcaggagaaccagatggacaaggcccggcggcacccccagggcgcctggaaggagctggacaggaactacctgaactacggggaggagggcgcccctgggaagtggcagcagcagggcgacctgcaggacaccaaggagaaccgggaggaggcccgcttccaggacaagcagtacagcagccaccacacagctgagaagaggaagaggctgggggagctgttcaacccctactatgaccccctgcagtggaagagcagccactttgagcggcgggacaacatgaatgacaacttcctggagggggaggaggagaatgagctgaccctgaatgagaagaacttcttccctgagtacaactatgactggtgggagaagaagcccttctctgaagatgtgaactggggctatgagaagaggaacctggcccgggtgcccaagctggacctgaagaggcagtatgacagagtggcccagctggaccagctgctgcactacaggaagaagtctgctgagttcccagacttctatgacagcgaggagcctgtgtccacccaccaggaggctgaaaatgagaaggacagagctgaccagacagtgctgacagaagatgagaagaaggagctggagaacctggccgccatggacctggagctgcagaagattgctgagaagttcagccagaggggctag

SEQ ID NO: 147550 - DNA, 870 bp, Artificial Sequence
  Description of Artificial Sequence: Synthetic coding sequence
atgcctgtggacaacagaaaccacaatgaaggcatggtgacccgctgcatcatcgaggtgctgagcaatgccctgagcaagagcagcgccccacccatcaccccagagtgccggcaggtgctgaagaccagcaggaaggatgtgaaggacaaggagaccacagaaaatgaaaacaccaagtttgaggtgcggctgctgcgggaccctgcagatgccagcgaggcccacgagagcagcagcagaggagaggccggggcccctggagaggaggacatccagggccccaccaaggctgacacagagaagtgggccgagggcggcggccacagccgggagcgggcagatgagccccagtggagcctgtaccccagcgacagccaggtgtctgaggaggtgaagaccaggcacagcgagaagagccagagagaagatgaggaggaggaggagggggagaactaccagaagggggagcggggggaggacagcagcgaggagaagcacctggaggagcctggagagacccagaatgccttcctgaatgaaaggaagcaggccagcgccatcaagaaggaggagctggtggcccggtctgagacccatgctgctggccacagccaggagaagacccacagccgggagaagagcagccaggagagcggggaggagaccggcagccaggagaaccacccccaggagagcaagggccagcccaggagccaggaggagagcgaggagggggaggaggatgccaccagcgaggtggacaagaggaggacccggcccaggcaccaccacggccgcagcaggccagacaggagcagccagggcggcagcctgcccagcgaggagaagggccacccccaggagtag

SEQ ID NO: 147551 - DNA, 1806 bp, Artificial Sequence
  Description of Artificial Sequence: Synthetic coding sequence
atgcctgagcgggagctgtggccagctggcactggaagtgagcctgtgaccagggtgggcagctgtgacagcatgatgagcagcaccagcaccaggagcggcagcagtgacagcagctatgacttcctgagcacagaggagaaggaatgtctgctcttcctggaggagaccatcggcagcctggacacagaagctgacagcggcctgagcacagatgagagcgagcccgccaccaccccccggggcttccgggccctgcccatcacccagcccaccccccggggcggccctgaggagaccatcacccagcagggccgcacccccaggacagtgacagagagcagcagcagccaccccccagagccccagggcctgggcctgcggagcggcagctacagcctgcccaggaacatccacatcgcccggagccagaacttcaggaagagcaccacccaggccagcagccacaaccctggagagcccggccgcctggcccctgagcctgagaaggagcaggtgtcccagagcagccagccccggcaggccccagccagcccccaggaggccgccctggacctggatgtggtgctgatccccccacctgaggccttccgggacacccagcctgagcagtgccgggaggccagcctgcctgagggccctggccagcagggccacaccccccagctgcacacccccagcagcagccaggagcgggagcagacccccagcgaggccatgagccagaaggccaaggagaccgtgtccacccgctacacccagccccagcccccacctgctggcctgccccagaatgcccgggcagaagatgcccccctgagcagcggggaggaccccaacagccggctggcccccctgaccacccccaagcccaggaagctgccccccaacatcgtgctgaagagcagccgcagcagcttccacagcgacccccagcactggctgagccgccacacagaggccgcccctggggacagcggcctcatcagctgcagcctgcaggagcagaggaaggccaggaaggaggccctggagaagctgggcctgccccaggaccaggatgagcccggcctgcacctgagcaagcccaccagcagcatccggcccaaggagacccgggcccagcacctgagccctgcccctggcctggcccagcctgctgccccagcccaggccagcgctgccatcccagctgctgggaaggccctggcccaggccccagccccagcccctggccctgcccagggccccctgcccatgaagagccctgcccctggaaatgtggccgccagcaagtccatgcccatcagcatccccaaggccccccgggccaacagcgccctgaccccacccaagccagagagcggcctgaccctgcaggagagcaacaccccaggcctgcggcagatgaacttcaagagcaacaccctggagaggtctggagtgggcctgagcagctacctgagcacagagaaggatgccagccccaagaccagcaccagcctgggcaagggcagcttcctggacaagatcagccccagcgtgctgaggaacagccggcccaggcctgccagcctgggcaccgggaaggactttgctggcatccaggtgggcaagctggccgacctggagcaggagcagagcagcaagaggctgagctaccagggccagagccgggacaagctgccccggcccccctgtgtgtctgtgaagatcagccccaagggcgtgcccaatgagcacagaagagaggccctgaagaagctgggcctgctgaaggagtag

SEQ ID NO: 147552 - DNA, 1068 bp, Artificial Sequence
  Description of Artificial Sequence: Synthetic coding sequence
atgagccagaaggccaaggagaccgtgtccacccgctacacccagccccagcccccacctgctggcctgccccagaatgcccgggcagaagatgcccccctgagcagcggggaggaccccaacagccggctggcccccctgaccacccccaagcccaggaagctgccccccaacatcgtgctgaagagcagccgcagcagcttccacagcgacccccagcactggctgagccgccacacagaggccgcccctggggacagcggcctcatcagctgcagcctgcaggagcagaggaaggccaggaaggaggccctggagaagctgggcctgccccaggaccaggatgagcccggcctgcacctgagcaagcccaccagcagcatccggcccaaggagacccgggcccagcacctgagccctgcccctggcctggcccagcctgctgccccagcccaggccagcgctgccatcccagctgctgggaaggccctggcccaggccccagccccagcccctggccctgcccagggccccctgcccatgaagagccctgcccctggaaatgtggccgccagcaagtccatgcccatcagcatccccaaggccccccgggccaacagcgccctgaccccacccaagccagagagcggcctgaccctgcaggagagcaacaccccaggcctgcggcagatgaacttcaagagcaacaccctggagaggtctggagtgggcctgagcagctacctgagcacagagaaggatgccagccccaagaccagcaccagcctgggcaagggcagcttcctggacaagatcagccccagcgtgctgaggaacagccggcccaggcctgccagcctgggcaccgggaaggactttgctggcatccaggtgggcaagctggccgacctggagcaggagcagagcagcaagaggctgagctaccagggccagagccgggacaagctgccccggcccccctgtgtgtctgtgaagatcagccccaagggcgtgcccaatgagcacagaagagaggccctgaagaagctgggcctgctgaaggagtag

SEQ ID NO: 147553 - DNA, 1050 bp, Artificial Sequence
  Description of Artificial Sequence: Synthetic coding sequence
atggccggccctgccatccacacagcccccatgctgttcctggtgctgctgctgcccctggagctgagcctggccggggccctggcccctggcaccccagccaggaacctgcctgagaaccacatcgacctgcccggccctgccctgtggaccccccaggccagccaccacagaagaagaggccctgggaagaaggagtggggccctggcctgcccagccaggcccaggatggagctgtggtgacagccacccggcaggccagccggctgcctgaggccgagggcctgctgcctgagcagagccctgctggcctgctgcaggacaaggacctgctgctgggcctggccctgccctacccagagaaggaaaatcggcccccaggctgggagaggaccaggaagaggagccgggagcacaagagaagaagagaccggctgcggctgcaccagggccgggccctggtgcggggccccagcagcctgatgaagaaggccgagctgtctgaggcccaggtgctggatgctgccatggaggagagcagcaccagcctggcccccaccatgttcttcctgaccacctttgaggccgccccagccacagaggagagcctcatcctgcctgtgaccagcctgcggccccagcaggcccagcccaggagtgatggagaggtgatgcccaccctggacatggccctgtttgactggacagattatgaggacctgaagccagatggctggcccagcgccaagaagaaggagaagcaccggggcaagctgagcagtgatggaaatgagaccagccctgctgagggggagccctgtgaccaccaccaggactgcctgcccggcacctgctgtgacctgcgggagcacctgtgcaccccccacaacagaggcctgaacaacaagtgctttgatgactgcatgtgtgtggagggcctgcgctgctacgccaagttccacaggaacagaagagtgaccaggaggaagggccgctgtgtggagcctgagacagccaacggggaccagggcagcttcatcaacgtgtag

SEQ ID NO: 147554 - DNA, 477 bp, Artificial Sequence
  Description of Artificial Sequence: Synthetic coding sequence
atgtgcttcagcagagcagatgctgctgacaactaccccttcggcacctgccagcagaggaagctgttcccccacttccacccccccaacctgattggcaacaagtttgtgcccctgcggggcagcccccaccggggccctggctgctacttcagtgatgagatgacccctcatgctggccgctaccagaaggtgagcccccagcaggagaagcacaagcagaactttgcccccttcaacgtgctggtgccccgcttcaagaactaccccaaggacacctactaccccagccctggggcctacaaccctgagaagaagcccccacccaagatcgcctggcccatgaagtttggcagcccagactgggcccaggtgccctgcctgcagaagaggaccctgaaggccgagctgagcacagacaaggacttcaggaagcacaggaacagagtggcctacctgagcctgtactacaactag

SEQ ID NO: 147555 - DNA, 576 bp, Artificial Sequence
  Description of Artificial Sequence: Synthetic coding sequence
atgtgcttcagcagagcagatgctgctgacaactaccccttcggcacctgccagcagaggaagctgttcccccacttccacccccccaacctgattggcaacaagtttgtgcccctgcggggcagcccccaccggggccctggctgctacttcagtgatggctacggcctggcctatgacctgagcaagatccccaccagcatcaagggctacaccctgggcgccaggacagctgtgcgcttcaagcccatccagaaggagatgacccctcatgctggccgctaccagaaggtgagcccccagcaggagaagcacaagcagaactttgcccccttcaacgtgctggtgccccgcttcaagaactaccccaaggacacctactaccccagccctggggcctacaaccctgagaagaagcccccacccaagatcgcctggcccatgaagtttggcagcccagactgggcccaggtgccctgcctgcagaagaggaccctgaaggccgagctgagcacagacaaggacttcaggaagcacaggaacagagtggcctacctgagcctgtactacaactag

SEQ ID NO: 147556 - DNA, 2055 bp, Artificial Sequence
  Description of Artificial Sequence: Synthetic coding sequence
atgtgggtgctgctgcggagcggctaccccctgcgcatcctgctgcccctgcggggggagtggatgggccggcggggcctgcccaggaacctggcccctggccccccaagaagacgctacaggaaggagaccctgcaggccctggacatgcctgtgctgcctgtgacagccacagagatccggcagtacctgcggggccacggcatccccttccaggacggccacagctgcctgcgggccctgagcccctttgctgagagcagccagctgaagggccagacaggagtgaccaccagcttcagcctcttcatcgacaagaccaccggccacttcctgtgcatgaccagcctggccgagggctcctgggaggacttccaggcctctgtggagggcagaggagatggagcccgggagggcttcctgctgagcaaggcccctgagtttgaagattctgaggaggtgcggcgcatctggaacagagccatccccctgtgggagctgcctgaccaggaggaggtgcagctggccgacaccatgtttggcctgaccaaggtgacagatgacaccctgaagcgcttctctgtgcgctacctgcggcctgcccggagcctggtgttcccctggttcagccctgggggcagcggcctgcggggcctgaagctgctggaggccaagtgccagggagatggagtgtcctatgaggagaccaccatcccccggcccagcgcctaccacaacctgtttggcctgcccctcatcagcagaagagatgctgaggtggtgctgaccagccgggagctggacagcctggccctgaaccagagcacaggcctgcccaccctgaccctgccccggggcaccacctgcctgcccccagccctgctgccctacctggagcagttccgccgcatcgtgttctggctgggagatgacctgcgctcctgggaggccgccaagctgtttgccaggaagctgaaccccaagcgctgcttcctggtgcggcctggggaccagcagccccggcccctggaggccctgaatggaggcttcaacctgagccgcatcctgaggacagccctgcctgcctggcacaagagcatcgtgtccttccggcagctgcgggaggaggtgctgggggagctgagcaatgtggagcaggccgccggcctgcgctggagccgcttcccagacctgaaccgcatcctgaagggccacaggaaaggagagctgactgtgttcaccggccccactggaagtggcaagaccaccttcatcagtgaatatgccctggacctgtgcagccagggcgtgaacaccctgtggggcagctttgagatcagcaatgtgcggctggcccgggtgatgctgacccagtttgctgagggccgcctggaggaccagctggacaagtatgaccactgggccgacagatttgaggacctgcccctgtacttcatgaccttccacggccagcagagcatccgcaccgtcatcgacaccatgcagcacgctgtgtatgtgtatgacatctgccacgtgatcatcgacaacctgcagttcatgatgggccacgagcagctgagcacagacagaattgctgcccaggactacatcattggagtcttcaggaagtttgccacagacaacaactgccacgtgaccctggtgatccaccccaggaaggaggatgatgacaaggagctgcagacagccagcatcttcggcagcgccaaggccagccaggaggccgacaacgtgctgatcctgcaggacaggaagctggtgacaggccctgggaagcgctacctgcaggtgtccaagaacagatttgatggagatgtgggcgtcttccccctggagttcaacaagaacagcctgaccttcagcatcccccccaagaacaaggcccggctgaagaagatcaaggatgacaccggccctgtggccaagaagcccagcagcggcaagaagggggccaccacccagaacagcgagatctgcagcggccaggcccccaccccagaccagcctgacaccagcaagaggagcaagtag

SEQ ID NO: 147557 - DNA, 1749 bp, Artificial Sequence
  Description of Artificial Sequence: Synthetic coding sequence
atgtgggtgctgctgcggagcggctaccccctgcgcatcctgctgcccctgcggggggagtggatgggccggcggggcctgcccaggaacctggcccctggccccccaagaagacgctacaggaaggagaccctgcaggccctggacatgcctgtgctgcctgtgacagccacagagatccggcagtacctgcggggccacggcatccccttccaggacggccacagctgcctgcgggccctgagcccctttgctgagagcagccagctgaagggccagacaggagtgaccaccagcttcagcctcttcatcgacaagaccaccggccacttcctgtgcatgaccagcctggccgagggctcctgggaggacttccaggcctctgtggagggcagaggagatggagcccgggagggcttcctgctgagcaaggcccctgagtttgaagattctgaggaggtgcggcgcatctggaacagagccatccccctgtgggagctgcctgaccaggaggaggtgcagctggccgacaccatgtttggcctgaccaaggtgacagatgacaccctgaagcgcttctctgtgcgctacctgcggcctgcccggagcctggtgttcccctggttcagccctgggggcagcggcctgcggggcctgaagctgctggaggccaagtgccagggagatggagtgtcctatgaggagaccaccatcccccggcccagcgcctaccacaacctgtttggcctgcccctcatcagcagaagagatgctgaggtggtgctgaccagccgggagctggacagcctggccctgaaccagagcacaggcctgcccaccctgaccctgccccggggcaccacctgcctgcccccagccctgctgccctacctggagcagttccgccgcatcgtgttctggctgggagatgacctgcgctcctgggaggccgccaagctgtttgccaggaagctgaaccccaagcgctgcttcctggtgcggcctggggaccagcagccccggcccctggaggccctgaatggaggcttcaacctgagccgcatcctgaggacagccctgcctgcctggcacaagagcatcgtgtccttccggcagctgcgggaggaggtgctgggggagctgagcaatgtggagcaggccgccggcctgcgctggagccgcttcccagacctgaaccgcatcctgaagggccacaggaaaggagagctgactgtgttcaccggccccactggaagtggcaagaccaccttcatcagtgaatatgccctggacctgtgcagccagggcgtgaacaccctgtggggcagctttgagatcagcaatgtgcggctggcccgggtgatgctgacccagtttgctgagggccgcctggaggaccagctggacaagtatgaccactgggccgacagatttgaggacctgcccctgtacttcatgaccttccacggccagcagagcatccgcaccgtcatcgacaccatgcagcacgctgtgtatgtgtatgacatctgccacgtgatcatcgacaacctgcagttcatgatgggccacgagcagctgagcacagacagaattgctgcccaggactacatcattggagtcttcaggaagtttgccacagacaacaactgccacgtgaccctggtgatccaccccaggaaggaggatgatgacaaggagctgcagacagccagcatcttcggcagcgccaaggtgtctggcctgtag

SEQ ID NO: 147558 - DNA, 1029 bp, Artificial Sequence
  Description of Artificial Sequence: Synthetic coding sequence
atgcccttcctgctgggcctgcggcaggacaaggaggcctgtgtgggcaccaacaaccagagctacatctgtgacaccggccactgctgcggccagagccagtgctgcaactactactatgagctgtggtggttctggctggtgtggaccatcatcatcatcctgagctgctgctgcgtgtgccaccaccggcgggccaagcaccggctgcaggcccagcagaggcagcacgagatcaacctgattgcctaccgggaggcccacaactacagcgccctgcccttctacttccgcttcctgcccaactacctgctgcccccctatgaggaggtggtgaacagaccacccaccccacctccaccctacagcgccttccagctgcagcagcagcagctgctgcccccccagtgtggccctgctgggggcagccccccaggcatcgaccccacccggggcagccagggcgcccagagcagccccctgtctgagcccagccgcagcagcaccaggcctccttccattgctgaccctgaccccagcgacctgcctgtggacagagctgccaccaaggcccctggcatggagcccagcggctctgtggccggcctgggggagctggaccccggggccttcctggacaaggatgctgaatgtcgggaggagctgctgaaggatgacagcagcgagcacggggccccagacagcaaggagaagaccccaggccgccaccggcgcttcaccggggacagcggcatcgaggtgtgtgtgtgcaacagaggccaccatgatgatgacctgaaggagttcaacaccctgattgatgatgccctggatggccccctggacttctgtgacagctgccacgtgcggcccccaggagatgaggaggagggcctgtgccagagcagcgaggagcaggcccgggagcccggccacccccacctgccccggcccccagcctgcctgctgctgaacaccatcaatgagcaggacagccccaacagccagagcagcagcagccccagctag

SEQ ID NO: 147559 - DNA, 1092 bp, Artificial Sequence
  Description of Artificial Sequence: Synthetic coding sequence
atggagcggcggcggctgctgggcggcatggccctgctgctgctgcaggccctgcccagccccctgagcgcccgggcagagcccccccaggacaaggaggcctgtgtgggcaccaacaaccagagctacatctgtgacaccggccactgctgcggccagagccagtgctgcaactactactatgagctgtggtggttctggctggtgtggaccatcatcatcatcctgagctgctgctgcgtgtgccaccacagaagagccaagcaccggctgcaggcccagcagaggcagcacgagatcaacctgattgcctaccgggaggcccacaactacagcgccctgcccttctacttccgcttcctgcccaactacctgctgcccccctatgaggaggtggtgaaccggccccccaccccacctccaccctacagcgccttccagctgcagcagcagcagctgctgcccccccagtgtggccctgctgggggcagccccccaggcatcgaccccacccggggcagccagggcgcccagagcagccccctgtctgagcccagccgcagcagcacccggccccccagcattgctgaccctgaccccagcgacctgcctgtggaccgggccgccaccaaggcccctggcatggagcccagcggctctgtggccggcctgggggagctggaccccggggccttcctggacaaggatgctgagtgccgggaggagctgctgaaggatgacagcagcgagcacggggccccagacagcaaggagaagaccccaggccgccaccggcgcttcaccggggacagcggcatcgaggtgtgtgtgtgcaacagaggccaccatgatgatgacctgaaggagttcaacaccctgattgatgatgccctggatggccccctggacttctgtgacagctgccacgtgcggcccccaggagatgaggaggagggcctgtgccagagcagcgaggagcaggcccgggagcccggccacccccacctgccccggcccccagcctgcctgctgctgaacaccatcaatgagcaggacagccccaacagccagagcagcagcagccccagctag

SEQ ID NO: 147560 - DNA, 1056 bp, Artificial Sequence
  Description of Artificial Sequence: Synthetic coding sequence
atggccacagatgtgcagctggccgactaccccctgatgagccccaaggccgagctgaagctggagaagaagagcggcaggaagcccaggagcccccgggacagcggcccccagaaggagctggtgattcctggcatcgtggactttgagcgcatcagaagagccctgcggacccccaagccccagaccccaggcacctactgcttcggccgcctgagccaccacagcttcttcagccgccaccacccccacccccagcacgtgacccacatccaggacctgaccgggaagcctgtgtgtgtggtgcgggacttccctgcccccctgcctgagagcacagtgttcagcggctgccagatgggcatccccaccatctctgtgcccatcggggacccccagagcaacagaaacccccagctgagcagcgaggcctggaagaaggagctgaaggagctggccagccgggtggccttcctgaccaaggaggatgagctgaagaagaaggagaaggagcagaaggaggagcccctgcgggagcagggcgccaagtacagcgctgagaccggccgcctcatcccagccagcaccagggctgtgggcagaagaagaagccaccagggccagcagagccagagcagcagcagacatgagggcgtgcaggccttcctgctgcaggaccaggagctgctggtgctggagctgctgtgccgcatcctggagacagacctgctgagcgccatccagttctggctgctgtatgccccacccaaggagaaggacctggccctgggcctgctgcagacagctgtggcccagctgctgccccagcccctggtgtccatccccacagagaagctgctgagccagctgcctgaggtgcatgagcccccccaggagaagcaggagcccccctgcagccagagccccaagaagaccaagatcagccccttcaccaagtctgagaagccagagtacatcggggaggcccaggtgctgcagatgcacagcagccagaacacagagaagaagaccagcaagcccagggctgagagctag

SEQ ID NO: 147561 - DNA, 321 bp, Artificial Sequence
  Description of Artificial Sequence: Synthetic coding sequence
cagtgtgccgagctgtggggctctgtgaggaagaacagcgacaagttcctgctgagcaggaacctgcaccccagcaaggaggagtaccggcagcagatcaagaccccaggagaggagtggaggcagatcctggtgcactggaggagcagcagccccccagatgccttcaagccagagcaccgggaggaggacattgaagctgagggccgggagctgcggggccccaacacctgcacctgcctggcccaggagcagccccagggcttccggggcgtgtctgtgtccaccaccttcaccgctgtgcctgacagcctgccctag

SEQ ID NO: 147562 - DNA, 753 bp, Artificial Sequence
  Description of Artificial Sequence: Synthetic coding sequence
atggccacagatgtgcagctggccgactaccccctgatgagccccaaggccgagctgaagctggagaagaagagcggcaggaagcccaggagcccccgggacagcggcccccagaaggagctggtgattcctggcatcgtggactttgagcgcatcagaagagccctgcggacccccaagccccagaccccaggcacctactgcttcggccgcctgagccaccacagcttcttcagccgccaccacccccacccccagcacgtgacccacatccaggacctgaccgggaagcctgtgtgtgtggtgcgggacttccctgcccccctgcctgagagcacagtgttcagcggctgccagatgggcatccccaccatctctgtgcccatcggggacccccagagcaacagaaacccccagctgagcagcgaggcctggaagaaggagctgaaggagctggccagccgggtggccttcctgaccaaggaggatgagctgaagaagaaggagaaggagcagaaggaggagcccctgcgggagcagggcgccaagtacagcgctgagaccggccgcctcatcccagccagcaccagggctgtgggcagaagaagaagccaccagggccagcagagccagagcagcagcagacatgagggcgtgcaggccttcctgctgcaggaccaggagctgctgaagaagaccagcctgtgggacagctgccggcagcagtggctgagcagcttccccagcccctag

SEQ ID NO: 147563 - DNA, 951 bp, Artificial Sequence
  Description of Artificial Sequence: Synthetic coding sequence
agccccaaggccgagctgaagctggagaagaagagcggcaggaagcccaggagcccccgggacagcggcccccagaaggagctggtgattcctggcatcgtggactttgagcgcatccggcgggccctgcggacccccaagccccagaccccaggcacctactgcttcggccgcctgagccaccacagcttcttcagccgccaccacccccacccccagcacgtgacccacatccaggacctgaccgggaagcctgtgtgtgtggtgcgggacttccctgcccccctgcctgagagcaccgtcttcagcggctgccagatgggcatccccaccatctctgtgcccatcggggacccccagagcaacagaaacccccagctgagcagcgcctggaagaaggagctgaaggagctggccagccgggtggccttcctgaccaaggaggatgagctgaagaagaaggaggacaccaccagcctgaactggaactgcaagagcagaagaccccaggcccctggcctgtctggaacagacctgggcgctgctgagctgggcatcaagaaggagcagaaggaggagcccctgcgggagcagggcgccaagtacagcgctgagaccggccgcctcatcccagccagcaccagggctgtgggcagaagaagaagccaccagggccagcagagccagagcagcagcagacatgagggcgtgcaggccttcctgctgcaggaccaggagctgctgggcggcctgaccagccctggggcccctgtgtctgaccccggcaaccggctggccaagaggaaccctgtgctggccgccctgcggagcgcccagggcaagaggcccaggagcggcaccccagctgacagcagcggcagcgcccccagccctgcccccagcctgcacccctacaggaaggcccccaagccagccagccgcagcgcctag

SEQ ID NO: 147564 - DNA, 498 bp, Artificial Sequence
  Description of Artificial Sequence: Synthetic coding sequence
atgtacatcagccccaaggccgagctgaagctggagaagaagagcggcaggaagcccaggagcccccgggacagcggcccccagaaggagctggtgattcctggcatcgtggactttgagcgcatcagaagagccctgcggacccccaagccccagaccccaggcacctactgcttcggccgcctgagccaccacagcttcttcagccgccaccacccccacccccagcacgtgacccacatccaggacctgaccgggaagcctgtgtgtgtggtgcgggacttccctgcccccctgcctgagagcacagtgttcagcggctgccagatgggcatccccaccatctctgtgcccatcggggacccccagagcaacagaaacccccagctgagcagcgcctggaagaaggagctgaaggagctggccagccgggtggccttcctgaccaaggaggatgagctgaagaagaaggaggtgggcgctgagcacaggagctag

SEQ ID NO: 147565 - DNA, 672 bp, Artificial Sequence
  Description of Artificial Sequence: Synthetic coding sequence
atgctgtgggtgcagaggaagagaagaaggaaggagaccagtgaatgtcccagcgacaaggacaagagccctgagagccacaaggccaagaatgaatcctggatcaagagccacttcagccggctgtctgaggagaagctggccctggacaacaatgccagcgccagcggaaatgccacccagacagagagcggcagcgaggaggtgagcagcacagtgcacatcgagaccttcaccaccaggcatggagaggtgggcagcgccctgcaccgggagagcttcaccagccggcagaagaccagcggccccagcgtcatccaggagatccaccaggagagcggcaaggcccccagcacagatgaggccacctgggccgctgtggccgcctgcaccaaggagattgacacccagggccgccacctggcccacagcatgctgcagagggccatcgcctaccagcacagcggccacctggagagcaaggacatcaaccaggaggagctgcgggccctggaggaggtggagatgaagctgcagaagaacttcctgacccagcgggagaacaccatcgccggggccaaccacacccacaccttctacggccacagccaccacagccaccacggccaccccagccaccagagccacagcctgcccaacagaagacactag

SEQ ID NO: 147566 - DNA, 399 bp, Artificial Sequence
  Description of Artificial Sequence: Synthetic coding sequence
atgggccgcacctggtgtggcatgtggaggagaagaagacctggccgccgctctgctgtgccccgctggccccacctgagcagccagagcggcgtggagcccccagaccgctggacaggcaccccaggctggcccagccgggaccaggaggcccctggctccatgatgcctcctgctgctgcccagcccagcgcccacggggccctggtgcccccagccacagcccacgagcctgtggaccacccagccctgcactggctggcctgctgctgctgcctgagcctgcccggccagctgcccctggccatccggctgggctgggacctggacctggaggccggccccagcagcggcaagctgtgcccccgggcccggcgctggcagcccctgcccagctag

SEQ ID NO: 147567 - DNA, 537 bp, Artificial Sequence
  Description of Artificial Sequence: Synthetic coding sequence
atggccagcttcctggtgtggcccctgaggacagccctgcggggcggcaagtcctgggccggccctggggtgggctgtggaggagatggagcccggggcggcggggagctgagcctgagcaacctggacctgcctggagctggggaggccggcctggagcaccaccccctgctgggccacctgttcatctctgctgtgccccgctggccccacctgagcagccagagcggcgtggagcccccagaccgctggacaggcaccccaggctggcccagccgggaccaggaggcccctggctccatgatgcctcctgctgctgcccagcccagcgcccacggggccctggtgcccccagccacagcccacgagcctgtggaccacccagccctgcactggctggcctgctgctgctgcctgagcctgcccggccagctgcccctggccatccggctgggctgggacctggacctggaggccggccccagcagcggcaagctgtgcccccgggcccggcgctggcagcccctgcccagctag

SEQ ID NO: 147568 - DNA, 1350 bp, Artificial Sequence
  Description of Artificial Sequence: Synthetic coding sequence
atgtggacagccctggtgctgatctggatcttcagcctgagcctgtctgagagccacgccgccagcaatgaccccaggaactttgtgcccaacaagatgtggaagggcctggtgaagagaaatgcctctgtggagaccgtggacaacaagaccagtgaagatgtgaccatggctgctgccagccctgtgaccctgaccaagggcaccagcgctgcccacctgaacagcatggaggtgaccacagaggacaccagcaggacagatgtgtctgagcccgccaccagcggcggcgctgctgatggagtgaccagcatcgcccccacagctgtggccagcagcaccacagctgccagcatcaccacagctgccagctccatgacagtggccagcagcgcccccaccacagctgccagcagcaccaccgtggccagcatcgcccccaccacagctgccagctccatgacagctgccagcagcacccccatgaccctggccctgcctgcccccaccagcaccagcacaggccgcacccccagcaccacagccaccggccaccccagcctgagcacagccctggcccaggtgcccaagagcagcgccctgcccaggacagccaccctggccaccctggccacccgggcccagacagtggccaccacagccaacaccagcagccccatgagcacccggcccagccccagcaagcacatgcccagcgacacagctgccagccctgtgccccccatgaggccccaggcccagggccccatcagccaggtgtctgtggaccagcctgtggtgaacaccaccaacaagagcacccccatgcccagcaacaccaccccagagcccgcccccacccccaccgtggtgaccaccaccaaggcccaggcccgggagcccacagccagccctgtgcctgtgccccacaccagccccatccctgagatggaggccatgagccccaccacccagcccagccccatgccctacacccagagagctgctggccctggcaccagccaggcccctgagcaggtggagacagaggccaccccaggcacagacagcacaggccccacccccaggagcagcggcggcaccaagatgcctgccacagacagctgccagcccagcacccagggccagtacatggtggtgaccacagagcccctgacccaggccgtggtggacaagaccctgctgctggtggtgctgctgctgggcgtgaccctcttcatcaccgtgctggtgctgtttgccctgcaggcctatgagagctacaagaagaaggactacacccaggtggactacctgatcaatggcatgtatgctgacagcgagatgtag

SEQ ID NO: 147569 - DNA, 78 bp, Artificial Sequence
  Description of Artificial Sequence: Synthetic coding sequence
atgtggacagccctggtgctgatctggatcttcagcctgagcctgtctgagagccacgccgccagcaatgacccctag

SEQ ID NO: 147570 - DNA, 3969 bp, Artificial Sequence
  Description of Artificial Sequence: Synthetic coding sequence
atgcctgtggtgtggcccaccctgctggacctgagcagagatgagtgcaagaggatcctgaggaagctggagctggaggcctatgctggggtcatcagcgccctgcgggcccagggcgacctgaccaaggagaagaaggacctgctgggggagctgagcaaggtgctgagcatcagcacagagcggcacagagctgaggtgcggcgggctgtgaatgatgagcggctgaccaccatcgcccacaacatgagcggccccaacagcagcagcgagtggagcattgagggccgccgcctggtgcccctgatgccccggctggtgccccagacagccttcaccgtgacagccaatgctgtggccaatgctgccatccagcacaatgccagcctgcctgtgcctgctgagaccggcagcaaggaggtggtgtgctacagctacaccagcaccaccagcacccccaccagcacccctgtgcccagcggcagcatcgccaccgtgaagagccccaggcctgccagccctgccagcaatgtggtggtgctgcccagcggcagcacagtgtatgtgaagtctgtgtcctgcagtgatgaagatgagaagcccaggaagagaagaaggaccaacagcagcagcagcagccctgtggtgctgaaggaggtgcccaaggctgtggtgcctgtgtccaagaccatcaccgtgcctgtgtctggcagccccaagatgagcaacatcatgcagagcatcgccaacagcctgcccccccacatgagccctgtgaagatcaccttcaccaagcccagcacccagaccaccaacaccaccacccagaaggtgatcatcgtgaccaccagccccagcagcacctttgtgcccaacatcctgagcaagagccacaactatgctgctgtgaccaagctggtgcccaccagcgtcatcgccagcaccacccagaagccccctgtggtgatcacagccagccagagcagcctggtgagcaacagcagcagcggcagcagcagcagcacccccagccccatccccaacacagtggccgtgacagctgtggtgagcagcaccccatctgtggtgatgagcacagtggcccagggcgtgtccaccagcgccatcaagatggccagcacccggctgcccagccccaagagcctggtgtctgcccccacccagatcctggcccagttccccaagcagcaccagcagagccccaagcagcagctgtaccaggtgcagcagcagacccagcagcaggtggcccagcccagccctgtgagccaccagcagcagccccagcagagccccctgcccccaggcatcaagcccaccatccagatcaagcaggagagcggcgtgaagatcatcacccagcaggtgcagcccagcaagatcctgcccaagcctgtgacagccaccctgcccaccagcagcaacagccccatcatggtggtgagcagcaatggagccatcatgaccaccaagctggtgaccacccccaccggcacccaggccacctacacccggcccaccgtgagccccagcattggaaggatggccgccacccctggggccgccacctacgtgaagaccaccagcggcagcatcatcaccgtggtgcccaagagcctggccaccctgggcggcaagatcatcagcagcaacatcgtgtctggcaccaccaccaagatcaccaccatccccatgaccagcaagcccaacgtgattgtggtgcagaagaccaccgggaagggcaccaccatccagggcctgcccgggaagaatgtggtgaccaccctgctgaatgctggaggagagaagaccatccagacagtgcccactggagccaagccagccatcctgacagccacccggcccatcaccaagatgattgtgacccagcccaagggcatcggcagcacagtgcagcctgctgccaagatcatccccaccaagatcgtgtatggccagcagggcaagacccaggtgctgatcaagcccaagcctgtgaccttccaggccaccgtggtgtctgagcagacccggcagctggtgacagagaccctgcagcaggccagccgggtggccgaggccggcaacagcagcatccaggagggcaaggaggagccccagaactacacagacagcagcagcagcagcacagagagcagccagagcagccaggacagccagcctgtggtgcacgtgattgccagccggcggcaggactggagcgagcacgagatcgccatggagaccagccccaccatcatctaccaggatgtgtcctctgagagccagagcgccaccagcaccatcaaggccctgctggagctgcagcagaccaccgtgaaggagaagctggagagcaagccccggcagcccaccatcgacctgagccagatggctgtgcccatccagatgacccaggagaagaggcacagccctgagagccccagcattgctgtggtggagagcgagctggtggccgagtacatcaccacagagaggacagatgagggcacagaggtggccttccccctgctggtgagccacaggagccagccccagcagcccagccagccccagaggaccctgctgcagcacgtggcccagagccagacagccacccagacctctgtggtggtgaagagcatcccagccagcagccctggggccatcacccacatcatgcagcaggccctgagcagccacacagccttcaccaagcacagcgaggagctgggcacagaggagggggaggtggaggagatggacaccctggacccccagacaggcctcttctacagaagtgccctgacccagagccagagcgccaagcagcagaagctgagccagccccccctggagcagacccagctgcaggtgaagaccctgcagtgcttccagaccaagcagaagcagaccatccacctgcaggccgaccagctgcagcacaagctgccccagatgccccagctgagcatccgccaccagaagctgacccccctgcagcaggagcaggcccagcccaagccagatgtgcagcacacccagcaccccatggtggccaaggaccggcagctgcccaccctgatggcccagcccccccagacagtggtgcaggtgctggccgtgaagaccacccagcagctgcccaagctgcagcaggcccccaaccagcccaagatctacgtgcagccccagaccccccagagccagatgagcctgcctgccagcagcgagaagcagacagccagccaggtggagcagcccatcatcacccagggcagctctgtgaccaagatcacctttgagggccggcagcccccaacagtgaccaagatcaccggcggcagctctgtgcccaagctgaccagccctgtgaccagcatcagccccatccaggccagcgagaagacagctgtgtctgacatcctgaagatgagcctgatggaggcccagattgacaccaacgtggagcacatgattgtggacccccccaagaaggccctggccacctccatgctgactggagaggccggcagcctgcccagcacccacatggtggtggccggcatggccaacagcaccccccagcagcagaagtgccgggagagctgcagcagccccagcacagtgggcagcagcctgaccaccaggaagattgaccccccagctgtgcctgccaccggccagttcatgaggatccagaatgtgggccagaagaaggccgaggagagccctgctgagatcatcatccaggccatcccccagtatgccatcccctgccacagcagcagcaatgtggtggtggagcccagcggcctgctggagctgaacaacttcaccagccagcagctggatgatgaggagacagccatggagcaggacatcgacagcagcacagaagatggaacagagcccagccccagccagagcagcgctgagaggagctag

SEQ ID NO: 147571 - DNA, 3468 bp, Artificial Sequence
  Description of Artificial Sequence: Synthetic coding sequence
atgcctgtggtgtggcccaccctgctggacctgagcagagatgagtgcaagaggatcctgaggaagctggagctggaggcctatgctggggtcatcagcgccctgcgggcccagggcgacctgaccaaggagaagaaggacctgctgggggagctgagcaaggtgctgagcatcagcacagagcggcacagagctgaggtgcggcgggctgtgaatgatgagcggctgaccaccatcgcccacaacatgagcggccccaacagcagcagcgagtggagcattgagggccgccgcctggtgcccctgatgccccggctggtgccccagacagccttcaccgtgacagccaatgctgtggccaatgctgccatccagcacaatgccagcctgcctgtgcctgctgagaccggcagcaaggaggtggtgtgctacagctacaccagcaccaccagcacccccaccagcacccctgtgcccagcggcagcatcgccaccgtgaagagccccaggcctgccagccctgccagcaatgtggtggtgctgcccagcggcagcacagtgtatgtgaagtctgtgtcctgcagtgatgaagatgagaagcccaggaagagaagaaggaccaacagcagcagcagcagccctgtggtgctgaaggaggtgcccaaggctgtggtgcctgtgtccaagaccatcaccgtgcctgtgtctggcagccccaagatgagcaacatcatgcagagcatcgccaacagcctgcccccccacatgagccctgtgaagatcaccttcaccaagcccagcacccagaccaccaacaccaccacccagaaggtgatcatcgtgaccaccagccccagcagcacctttgtgcccaacatcctgagcaagagccacaactatgctgctgtgaccaagctggtgcccaccagcgtcatcgccagcaccacccagaagccccctgtggtgatcacagccagccagagcagcctggtgagcaacagcagcagcggcagcagcagcagcacccccagccccatccccaacacagtggccgtgacagctgtggtgagcagcaccccatctgtggtgatgagcacagtggcccagggcgtgtccaccagcgccatcaagatggccagcacccggctgcccagccccaagagcctggtgtctgcccccacccagatcctggcccagttccccaagcagcaccagcagagccccaagcagcagctgtaccaggtgcagcagcagacccagcagcaggtggcccagcccagccctgtgagccaccagcagcagccccagcagagccccctgcccccaggcatcaagcccaccatccagatcaagcaggagagcggcgtgaagatcatcacccagcaggtgcagcccagcaagatcctgcccaagcctgtgacagccaccctgcccaccagcagcaacagccccatcatggtggtgagcagcaatggagccatcatgaccaccaagctggtgaccacccccaccggcacccaggccacctacacccggcccaccgtgagccccagcattggaaggatggccgccacccctggggccgccacctacgtgaagaccaccagcggcagcatcatcaccgtggtgcccaagagcctggccaccctgggcggcaagatcatcagcagcaacatcgtgtctggcaccaccaccaagatcaccaccatccccatgaccagcaagcccaacgtgattgtggtgcagaagaccaccgggaagggcaccaccatccagggcctgcccgggaagaatgtggtgaccaccctgctgaatgctggaggagagaagaccatccagacagtgcccactggagccaagccagccatcctgacagccacccggcccatcaccaagatgattgtgacccagcccaagggcatcggcagcacagtgcagcctgctgccaagatcatccccaccaagatcgtgtatggccagcagggcaagacccaggtgctgatcaagcccaagcctgtgaccttccaggccaccgtggtgtctgagcagacccggcagctggtgacagagaccctgcagcaggccagccgggtggccgaggccggcaacagcagcatccaggagggcaaggaggagccccagaactacacagacagcagcagcagcagcacagagagcagccagagcagccaggacagccagcctgtggtgcacgtgattgccagccggcggcaggactggagcgagcacgagatcgccatggagaccagccccaccatcatctaccaggatgtgtcctctgagagccagagcgccaccagcaccatcaaggccctgctggagctgcagcagaccaccgtgaaggagaagctggagagcaagccccggcagcccaccatcgacctgagccagatggctgtgcccatccagatgacccaggagaagaggcacagccctgagagccccagcattgctgtggtggagagcgagctggtggccgagtacatcaccacagagaggacagatgagggcacagaggtggccttccccctgctggtgagccacaggagccagccccagcagcccagccagccccagaggaccctgctgcagcacgtggcccagagccagacagccacccagacctctgtggtggtgaagagcatcccagccagcagccctggggccatcacccacatcatgcagcaggccctgagcagccacacagccttcaccaagcacagcgaggagctgggcacagaggagggggaggtggaggagatggacaccctggacccccagacaggcctcttctacagaagtgccctgacccagagccagagcgccaagcagcagaagctgagccagccccccctggagcagacccagctgcaggtgaagaccctgcagtgcttccagaccaagcagaagcagaccatccacctgcaggccgaccagctgcagcacaagctgccccagatgccccagctgagcatccgccaccagaagctgacccccctgcagcaggagcaggcccagcccaagccagatgtgcagcacacccagcaccccatggtggccaaggaccggcagctgcccaccctgatggcccagcccccccagacagtggtgcaggtgctggccgtgaagaccacccagcagctgcccaagctgcagcaggcccccaaccagcccaagatctacgtgcagccccagaccccccagagccagatgagcctgcctgccagcagcgagaagcagacagccagccaggccatcccccagtatgccatcccctgccacagcagcagcaatgtggtggtggagcccagcggcctgctggagctgaacaacttcaccagccagcagctggatgatgaggagacagccatggagcaggacatcgacagcagcacagaagatggaacagagcccagccccagccagagcagcgctgagaggagctag

SEQ ID NO: 147572 - DNA, 3015 bp, Artificial Sequence
  Description of Artificial Sequence: Synthetic coding sequence
atgcctgtggtgtggcccaccctgctggacctgagcagagatgagtgcaagaggatcctgaggaagctggagctggaggcctatgctggggtcatcagcgccctgcgggcccagggcgacctgaccaaggagaagaaggacctgctgggggagctgagcaaggtgctgagcatcagcacagagcggcacagagctgaggtgcggcgggctgtgaatgatgagcggctgaccaccatcgcccacaacatgagcggccccaacagcagcagcgagtggagcattgagggccgccgcctggtgcccctgatgccccggctggtgccccagacagccttcaccgtgacagccaatgctgtggccaatgctgccatccagcacaatgccagcctgcctgtgcctgctgagaccggcagcaaggagggcgtgtcctgcagtgatgaagatgagaagcccaggaagagaagaaggaccaacagcagcagcagcagccctgtggtgctgaaggaggtgcccaaggctgtggtgcctgtgtccaagaccatcaccgtgcctgtgtctggcagccccaagatgagcaacatcatgcagagcatcgccaacagcctgcccccccacatgagccctgtgaagatcaccttcaccaagcccagcacccagaccaccaacaccaccacccagaaggtgatcatcgtgaccaccagccccagcagcacctttgtgcccaacatcctgagcaagagccacaactatgctgctgtgaccaagctggtgcccaccagcgtcatcgccagcaccacccagaagccccctgtggtgatcacagccagccagagcagcctggtgagcaacagcagcagcggcagcagcagcagcacccccagccccatccccaacacagtggccgtgacagctgtggtgagcagcaccccatctgtggtgatgagcacagtggcccagggcgtgtccaccagcgccatcaagatggccagcacccggctgcccagccccaagagcctggtgtctgcccccacccagatcctggcccagttccccaagcagcaccagcagagccccaagcagcagctgtaccaggtgcagcagcagacccagcagcaggtggcccagcccagccctgtgagccaccagcagcagccccagcagagccccctgcccccaggcatcaagcccaccatccagatcaagcaggagagcggcgtgaagatcatcacccagcaggtgcagcccagcaagatcctgcccaagcctgtgacagccatcctgacagccacccggcccatcaccaagatgattgtgacccagcccaagggcatcggcagcacagtgcagcctgctgccaagatcatccccaccaagatcgtgtatggccagcagggcaagacccaggtgctgatcaagcccaagcctgtgaccttccaggccaccgtggtgtctgagcagacccggcagctggtgacagagaccctgcagcaggccagccgggtggccgaggccggcaacagcagcatccaggagggcaaggaggagccccagaactacacagacagcagcagcagcagcacagagagcagccagagcagccaggtgagccacaggagccagccccagcagcccagccagccccagaggaccctgctgcagcacgtggcccagagccagacagccacccagacctctgtggtggtgaagagcatcccagccagcagccctggggccatcacccacatcatgcagcaggccctgagcagccacacagccttcaccaagcacagcgaggagctgggcacagaggagggggaggtggaggagatggacaccctggacccccagacaggcctcttctacagaagtgccctgacccagagccagagcgccaagcagcagaagctgagccagccccccctggagcagacccagctgcaggtgaagaccctgcagtgcttccagaccaagcagaagcagaccatccacctgcaggccgaccagctgcagcacaagctgccccagatgccccagctgagcatccgccaccagaagctgacccccctgcagcaggagcaggcccagcccaagccagatgtgcagcacacccagcaccccatggtggccaaggaccggcagctgcccaccctgatggcccagcccccccagacagtggtgcaggtgctggccgtgaagaccacccagcagctgcccaagctgcagcaggcccccaaccagcccaagatctacgtgcagccccagaccccccagagccagatgagcctgcctgccagcagcgagaagcagacagccagccaggtggagcagcccatcatcacccagggcagctctgtgaccaagatcacctttgagggccggcagcccccaacagtgaccaagatcaccggcggcagctctgtgcccaagctgaccagccctgtgaccagcatcagccccatccaggccagcgagaagacagctgtgtctgacatcctgaagatgagcctgatggaggcccagattgacaccaacgtggagcacatgattgtggacccccccaagaaggccctggccacctccatgctgactggagaggccggcagcctgcccagcacccacatggtggtggccggcatggccaacagcaccccccagcagcagaagtgccgggagagctgcagcagccccagcacagtgggcagcagcctgaccaccaggaagattgaccccccagctgtgcctgccaccggccagttcatgaggatccagaatgtgggccagaagaaggccgaggagagccctgctgagatcatcatccaggccatcccccagtatgccatcccctgccacagcagcagcaatgtggtggtggagcccagcggcctgctggagctgaacaacttcaccagccagcagctggatgatgaggagacagccatggagcaggacatcgacagcagcacagaagatggaacagagcccagccccagccagagcagcgctgagaggagctag

SEQ ID NO: 147573 - DNA, 3969 bp, Artificial Sequence; identical to SEQ ID NO: 147570
  Description of Artificial Sequence: Synthetic coding sequence

SEQ ID NO: 147574 - DNA, 624 bp, Artificial Sequence
  Description of Artificial Sequence: Synthetic coding sequence
atggctgtgttccatgacatgctgctgcagcccctgggcatgttcctgtgcctgagcctgcagctgagcagcgccaccttcatccgctacagcagcacctgcttcacctttgatgagtactacaccatcaccctggacatcaaggccagcagccacatctatgagagcaatgctgtgtacagcgtgtttgtgcctgtgaatgattctgtgtatgctgtggtgatgaagaccctggatgagaacagcgacagcgctggcctgtggcagagagctgacaagaactgctacagcaacagcacctactacgtgaaggaccagtacatgacagtgctggaggcccagtggcaggcccctgagcctgagaacatcacagaggtggagatccaggccttcaccgtgcagatccgggccctgcccatcctgagcaccctgaagctgcgggagaagctgagcaccctggccctggccgccaagatcccccagagcagcgccttcaagcccttcttcatgatcacccccaagagcatccggctggagggcctggccaaccaggtgttcagcagccccatcacagaggccatctacatcctgctggccttcctgaccagcaccctgctcttctag

SEQ ID NO: 147575 - DNA, 3708 bp, Artificial Sequence
  Description of Artificial Sequence: Synthetic coding sequence
atggaccacacagccagccagaatgcccaggacctgattggcatcccccacctgggcgtgtctggcagcagcaccaagtggcacagcgagctgagccccacagagggcccccacagcgctggcagcagcaccccaggcttcctgagccccatggccgagctgagccaccccagccccccacctccagccctgggcagcctgctgcagctgcctgatggcagccccagctggagcatgctggaggtggccagcggccctgccagcacccagcagatcaaggccggcgtgcccggccgggtgcacaacggggtgtccctgcccaccttcaagaacacagaaacagccacccatgaagctgagcccccactcttccagacagctgagagcggggccatcgagatgaccagcaggaagctggccagcgccacagccaatgattctgccaaccccctgcacctgtctgctgcccctgagaacagccggggccctgccctgtctgctgagcacaccagcagcctggtgcccagcctgcacatcaccaccctgggccaggagcaggccatcctgagcggggctgtgcctgccagccccagcactggaacagctgacttccccagcatcctgaccttcctgcagcccacagaaaatcatgccagccccagccctgtgcctgagatgcccaccctgcctgctgagggcagtgatggcagccccccagccacccgggacctgctgctgagcagcaaggtgcccaacctgctgagcacctcctggaccttcccccgctggaagaaggacagcgtgacagccatcctgggcaagaatgaggaggccaacgtgaccatccccctgcaggccttccccaggaaggaggtgctgagcctgcacacagtgaatggatttgtgtctgacttcagcactggatctgtgagcagccccatcatcacagcccccaggaccaaccccctgcccagcggcccccccctgcccagcatcctgagcatccaggccacccagaccgtcttccccagcctgggcttcagcagcaccaagccagaggcctatgctgctgctgtggaccacagcggcctgcctgccagcgccagcaagcaggtgcgggccagccccagctccatggatgtgtatgacagcctgaccatcggggacatgaagaagccagccaccacagatgtgttctggagcagcctgtctgctgagaccggcagcctgagcacagagagcatcatcagcggcctgcagcagcagaccaactatgacctgaatggccacaccatcagcaccacctcctgggagacccacctggcccccacagccccacccaacggcctgaccagcgctgctgatgccatcaagagccaggacttcaaggacacagctggccacagcgtgacagctgagggcttcagcatccaggacctggtgctgggcaccagcattgagcagcctgtgcagcagagcgacatgaccatggtgggcagccacatcgacctgtggcccaccagcaacaacaaccacagccgggacttccagacagctgaggtggcctactacagccccaccaccaggcacagcgtgagccacccccagctgcagctgcccaaccagcctgcccaccccctgctgctgaccagccctggccccaccagcacaggcagcctgcaggagatgctgagtgatggaacagacaccggcagcgagatcagcagtgacatcaacagcagccctgagagaaatgccagcacccccttccagaacatcctgggctaccacagcgctgctgagagcagcatcagcacctctgtgttccccaggaccagcagccgggtgctgcgggccagccagcaccccaagaagtggacaggagctgccaccaatgctgctgacacagtgagcagcaaggtgcagcccacagctgctgctgctgtgaccctcttcctgaggaagagcagccccccagccctgtctgctgccctggtggccaagggcaccagcagcagccccctggccgtggccagcggccctgccaagagcagctccatgaccaccctggccaagaatgtgaccaacaaggccgccagcggccccaagaggaccccaggagctgtgcacacagccttccccttcacccccacctacatgtatgccaggacaggccacaccaccagcacccacacagccatgcagggcaacatggacacagccagcggcctgctgagcaccacctacctgcccaggaagccccaggccatgcacacaggcctgcccaaccccaccaacctggagatgccccgggccagcaccccccggcccctgactgtgacagctgccctgaccagcatcacagcctctgtgaaggccacccggctgccccccctgcgggcagagaacacagatgctgtgctgcctgctgccagcgctgctgtggtgaccaccgggaagatggccagcaacctggagtgccagatgagcagcaagctgctggtgaagacagtgctcttcctgacccagaggagagtgcagatcagcgagagcctgaagttcagcatcgccaagggcctgacccaggccctgaggaaggccttccaccagaatgatgtgtctgcccacgtggacatcctggagtacagccacaacgtgacagtgggctactatgccaccaagggcaagctggtgtacctgcctgctgtggtgattgagatgctgggcgtgtatggagtgtccaatgtgacagctgacctgaagcagcacaccccccacctgcagagcgtggccgtgctggccagcccctggaacccccagcctgctggctacttccagctgaagacagtgctgcagtttgtgtcccaggccgacaacatccagagctgcaagtttgcccagaccatggagcagaggctgcagaaggccttccaggatgctgagaggaaggtgctgaacaccaagagcaacctgaccatccagatcgtgtccaccagcaatgccagccaggccgtgaccctggtgtatgtggtgggcaaccagagcaccttcctgaatggaacagtggccagcagcctgctgagccagctgtctgctgagctggtgggcttctacctgacctacccacccctgaccatcgccgagcccctggagtaccccaacctggacatcagcgagaccacccgggactactgggtgatcaccgtgctgcagggcgtggacaacagcctggtgggcctgcacaaccagagctttgcccgggtgatggagcagaggctggcccagctgttcatgatgagccagcagcagggccgccgcttcaagagggccaccaccctgggcagctacacagtgcagatggtgaagatgcagagggtgcccggccccaaggaccctgctgagctgacctactacaccctgtacaacgggaagcccctgctgggcacagctgctgccaagatcctgagcaccatcgacagccagaggatggccctgaccctgcaccacgtggtgctgctgcaggccgaccctgtggtgaagaacccccccaacaacctgtggatcatcgctgctgtgctggcccccatcgctgtggtgaccgtcatcatcatcatcatcacagctgtgctgtgcaggaagaacaagaatgacttcaagccagacaccatgatcaacctgccccagagggccaagcaggtggcccagtag

SEQ ID NO: 147576 - DNA, 5550 bp, Artificial Sequence
  Description of Artificial Sequence: Synthetic coding sequence
atggaccacacagccagccagaatgcccaggacctgattggcatcccccacctgggcgtgtctggcagcagcaccaagtggcacagcgagctgagccccacagagggcccccacagcgctggcagcagcaccccaggcttcctgagccccatggccgagctgagccaccccagccccccacctccagccctgggcagcctgctgcagctgcctgatggcagccccagctggagcatgctggaggtggccagcggccctgccagcacccagcagatcaaggccggcgtgcccggccgggtgcacaacggggtgtccctgcccaccttcaagaacacagaaacagccacccatgaagctgagcccccactcttccagacagctgagagcggggccatcgagatgaccagcaggaagctggccagcgccacagccaatgattctgccaaccccctgcacctgtctgctgcccctgagaacagccggggccctgccctgtctgctgagcacaccagcagcctggtgcccagcctgcacatcaccaccctgggccaggagcaggccatcctgagcggggctgtgcctgccagccccagcactggaacagctgacttccccagcatcctgaccttcctgcagcccacagaaaatcatgccagccccagccctgtgcctgagatgcccaccctgcctgctgagggcagtgatggcagccccccagccacccgggacctgctgctgagcagcaaggtgcccaacctgctgagcacctcctggaccttcccccgctggaagaaggacagcgtgacagccatcctgggcaagaatgaggaggccaacgtgaccatccccctgcaggccttccccaggaaggaggtgctgagcctgcacacagtgaatggatttgtgtctgacttcagcactggatctgtgagcagccccatcatcacagcccccaggaccaaccccctgcccagcggcccccccctgcccagcatcctgagcatccaggccacccagaccgtcttccccagcctgggcttcagcagcaccaagccagaggcctatgctgctgctgtggaccacagcggcctgcctgccagcgccagcaagcaggtgcgggccagccccagctccatggatgtgtatgacagcctgaccatcggggacatgaagaagccagccaccacagatgtgttctggagcagcctgtctgctgagaccggcagcctgagcacagagagcatcatcagcggcctgcagcagcagaccaactatgacctgaatggccacaccatcagcaccacctcctgggagacccacctggcccccacagccccacccaacggcctgaccagcgctgctgatgccatcaagagccaggacttcaaggacacagctggccacagcgtgacagctgagggcttcagcatccaggacctggtgctgggcaccagcattgagcagcctgtgcagcagagcgacatgaccatggtgggcagccacatcgacctgtggcccaccagcaacaacaaccacagccgggacttccagacagctgaggtggcctactacagccccaccaccaggcacagcgtgagccacccccagctgcagctgcccaaccagcctgcccaccccctgctgctgaccagccctggccccaccagcacaggcagcctgcaggagatgctgagtgatggaacagacaccggcagcgagatcagcagtgacatcaacagcagccctgagagaaatgccagcacccccttccagaacatcctgggctaccacagcgctgctgagagcagcatcagcacctctgtgttccccaggaccagcagccgggtgctgcgggccagccagcaccccaagaagtggacagctgacacagtgagcagcaaggtgcagcccacagctgctgctgctgtgaccctcttcctgaggaagagcagccccccagccctgtctgctgccctggtggccaagggcaccagcagcagccccctggccgtggccagcggccctgccaagagcagctccatgaccaccctggccaagaatgtgaccaacaaggccgccagcggccccaagaggaccccaggagctgtgcacacagccttccccttcacccccacctacatgtatgccaggacaggccacaccaccagcacccacacagccatgcagggcaacatggacacagccagcggcctgctgagcaccacctacctgcccaggaagccccaggccatgcacacaggcctgcccaaccccaccaacctggagatgccccgggccagcaccccccggcccctgactgtgacagctgccctgaccagcatcacagcctctgtgaaggccacccggctgccccccctgcgggcagagaacacagatgctgtgctgcctgctgccagcgctgctgtggtgaccaccgggaagatggccagcaacctggagtgccagatgagcagcaagctgctggtgaagacagtgctcttcctgacccagaggagagtgcagatcagcgagagcctgaagttcagcatcgccaagggcctgacccaggccctgaggaaggccttccaccagaatgatgtgtctgcccacgtggacatcctggagtacagccacaacgtgacagtgggctactatgccaccaagggcaagctggtgtacctgcctgctgtggtgattgagatgctgggcgtgtatggagtgtccaatgtgacagctgacctgaagcagcacaccccccacctgcagagcgtggccgtgctggccagcccctggaacccccagcctgctggctacttccagctgaagacagtgctgcagtttgtgtcccaggccgacaacatccagagctgcaagtttgcccagaccatggagcagaggctgcagaaggccttccaggatgctgagaggaaggtgctgaacaccaagagcaacctgaccatccagatcgtgtccaccagcaatgccagccaggccgtgaccctggtgtatgtggtgggcaaccagagcaccttcctgaatggaacagtggccagcagcctgctgagccagctgtctgctgagctggtgggcttctacctgacctacccacccctgaccatcgccgagcccctggagtaccccaacctggacatcagcgagaccacccgggactactgggtgatcaccgtgctgcagggcgtggacaacagcctggtgggcctgcacaaccagagctttgcccgggtgatggagcagaggctggcccagctgttcatgatgagccagcagcagggccgccgcttcaagagggccaccaccctgggcagctacacagtgcagatggtgaagatgcagagggtgcccggccccaaggaccctgctgagctgacctactacaccctgtacaacgggaagcccctgctgggcacagctgctgccaagatcctgagcaccatcgacagccagaggatggccctgaccctgcaccacgtggtgctgctgcaggccgaccctgtggtgaagaacccccccaacaacctgtggatcatcgctgctgtgctggcccccatcgctgtggtgaccgtcatcatcatcatcatcacagctgtgctgtgcaggaagaacaagaatgacttcaagccagacaccatgatcaacctgccccagagggccaagcctgtgcagggctttgattatgccaagcagcacctgggccagcagggcgcagatgaggaggtgattcctgtgacccaggagaccgtggtgctgcccctgcccatcagagatgccccccaggagagagatgtggcccaggacggcagcaccatcaagacagccaagagcacagagaccaggaagagccgcagccccagtgaaaatggatctgtcatcagcaatgaaagtggcaagcccagcagcggccgccgcagcccccagaatgtgatggcccagcagaaggtgaccaaggaggaggccaggaagagaaatgtgcctgccagtgatgaggaggagggcgctgtgctgtttgacaacagcagcaaggtggccgctgagccctttgacaccagcagcggctctgtgcagctgattgccatcaagcccacagccctgcccatggtgccccccaccagtgacaggagccaggagagcagcgctgtgctgaatggagaggtgaacaaggccctgaagcagaagagtgacatcgagcactacagaaacaagctgcggctgaaggccaagaggaagggctactatgacttccctgctgtggagaccagcaagggcctgacagagaggaagaagatgtatgagaaggcccccaaggagatggagcacgtgctggaccctgattctgagctgtgtgcccccttcacagagagcaagaaccggcagcagatgaagaacagcgtgtaccgcagccggcagagcctgaacagccccagccctggagaaacagagatggacctgctggtgacccgggagcggccccggcggggcatcagaaattctggctatgacacagagcctgagatcatcgaggagaccaacatcgacagagtgcctgagccccggggctacagccgcagccggcaggtgaagggccacagcgagaccagcaccctgagcagccagcccagcattgatgaggtgcggcagcagatgcacatgctgctggaggaggccttcagcctggccagcgctggccacgccggccagagccgccaccaggaggcctacggcagcgcccagcacctgccctacagcgaggtggtgaccagcgcccctggcaccatgacccggcccagggctggggtgcagtgggtgcccacctacagacctgagatgtaccagtacagcctgcccaggcctgcctaccgcttcagccagctgcctgagatggtgatgggcagccccccacctcctgtgccccccaggacaggccctgtggccgtggccagcctgcggcgcagcaccagtgacatcggcagcaagaccaggatggccgagagcactggacctgagcccgcccagctgcatgattctgccagcttcacccagatgagccggggccctgtgtctgtgacccagctggaccagagcgccctgaactacagcggcaacacagtgcctgctgtgtttgccatcccagctgccaacagacctggcttcaccggctacttcatccccaccccacccagcagctacagaaaccaggcctggatgtcctatgctggggagaatgagctgcccagccagtgggccgacagcgtgcccctgcccggctacatcgaggcctaccccaggagccgctacccccagagcagccccagccggctgccccggcagtacagccagcctgccaacctgcaccccagcctggagcaggccccagcccccagcacagctgccagccagcagagcctggccgagaatgaccccagtgatgcccccctgaccaacatcagcacagctgccctggtgaaggccatccgggaggaggtggccaagctggccaagaagcagacagacatgtttgagttccaggtgtag

SEQ ID NO: 147577 - DNA, 5568 bp, Artificial Sequence
  Description of Artificial Sequence: Synthetic coding sequence
atggaccacacagccagccagaatgcccaggacctgattggcatcccccacctgggcgtgtctggcagcagcaccaagtggcacagcgagctgagccccacagagggcccccacagcgctggcagcagcaccccaggcttcctgagccccatggccgagctgagccaccccagccccccacctccagccctgggcagcctgctgcagctgcctgatggcagccccagctggagcatgctggaggtggccagcggccctgccagcacccagcagatcaaggccggcgtgcccggccgggtgcacaacggggtgtccctgcccaccttcaagaacacagaaacagccacccatgaagctgagcccccactcttccagacagctgagagcggggccatcgagatgaccagcaggaagctggccagcgccacagccaatgattctgccaaccccctgcacctgtctgctgcccctgagaacagccggggccctgccctgtctgctgagcacaccagcagcctggtgcccagcctgcacatcaccaccctgggccaggagcaggccatcctgagcggggctgtgcctgccagccccagcactggaacagctgacttccccagcatcctgaccttcctgcagcccacagaaaatcatgccagccccagccctgtgcctgagatgcccaccctgcctgctgagggcagtgatggcagccccccagccacccgggacctgctgctgagcagcaaggtgcccaacctgctgagcacctcctggaccttcccccgctggaagaaggacagcgtgacagccatcctgggcaagaatgaggaggccaacgtgaccatccccctgcaggccttccccaggaaggaggtgctgagcctgcacacagtgaatggatttgtgtctgacttcagcactggatctgtgagcagccccatcatcacagcccccaggaccaaccccctgcccagcggcccccccctgcccagcatcctgagcatccaggccacccagaccgtcttccccagcctgggcttcagcagcaccaagccagaggcctatgctgctgctgtggaccacagcggcctgcctgccagcgccagcaagcaggtgcgggccagccccagctccatggatgtgtatgacagcctgaccatcggggacatgaagaagccagccaccacagatgtgttctggagcagcctgtctgctgagaccggcagcctgagcacagagagcatcatcagcggcctgcagcagcagaccaactatgacctgaatggccacaccatcagcaccacctcctgggagacccacctggcccccacagccccacccaacggcctgaccagcgctgctgatgccatcaagagccaggacttcaaggacacagctggccacagcgtgacagctgagggcttcagcatccaggacctggtgctgggcaccagcattgagcagcctgtgcagcagagcgacatgaccatggtgggcagccacatcgacctgtggcccaccagcaacaacaaccacagccgggacttccagacagctgaggtggcctactacagccccaccaccaggcacagcgtgagccacccccagctgcagctgcccaaccagcctgcccaccccctgctgctgaccagccctggccccaccagcacaggcagcctgcaggagatgctgagtgatggaacagacaccggcagcgagatcagcagtgacatcaacagcagccctgagagaaatgccagcacccccttccagaacatcctgggctaccacagcgctgctgagagcagcatcagcacctctgtgttccccaggaccagcagccgggtgctgcgggccagccagcaccccaagaagtggacaggagctgccaccaatgctgctgacacagtgagcagcaaggtgcagcccacagctgctgctgctgtgaccctcttcctgaggaagagcagccccccagccctgtctgctgccctggtggccaagggcaccagcagcagccccctggccgtggccagcggccctgccaagagcagctccatgaccaccctggccaagaatgtgaccaacaaggccgccagcggccccaagaggaccccaggagctgtgcacacagccttccccttcacccccacctacatgtatgccaggacaggccacaccaccagcacccacacagccatgcagggcaacatggacacagccagcggcctgctgagcaccacctacctgcccaggaagccccaggccatgcacacaggcctgcccaaccccaccaacctggagatgccccgggccagcaccccccggcccctgactgtgacagctgccctgaccagcatcacagcctctgtgaaggccacccggctgccccccctgcgggcagagaacacagatgctgtgctgcctgctgccagcgctgctgtggtgaccaccgggaagatggccagcaacctggagtgccagatgagcagcaagctgctggtgaagacagtgctcttcctgacccagaggagagtgcagatcagcgagagcctgaagttcagcatcgccaagggcctgacccaggccctgaggaaggccttccaccagaatgatgtgtctgcccacgtggacatcctggagtacagccacaacgtgacagtgggctactatgccaccaagggcaagctggtgtacctgcctgctgtggtgattgagatgctgggcgtgtatggagtgtccaatgtgacagctgacctgaagcagcacaccccccacctgcagagcgtggccgtgctggccagcccctggaacccccagcctgctggctacttccagctgaagacagtgctgcagtttgtgtcccaggccgacaacatccagagctgcaagtttgcccagaccatggagcagaggctgcagaaggccttccaggatgctgagaggaaggtgctgaacaccaagagcaacctgaccatccagatcgtgtccaccagcaatgccagccaggccgtgaccctggtgtatgtggtgggcaaccagagcaccttcctgaatggaacagtggccagcagcctgctgagccagctgtctgctgagctggtgggcttctacctgacctacccacccctgaccatcgccgagcccctggagtaccccaacctggacatcagcgagaccacccgggactactgggtgatcaccgtgctgcagggcgtggacaacagcctggtgggcctgcacaaccagagctttgcccgggtgatggagcagaggctggcccagctgttcatgatgagccagcagcagggccgccgcttcaagagggccaccaccctgggcagctacacagtgcagatggtgaagatgcagagggtgcccggccccaaggaccctgctgagctgacctactacaccctgtacaacgggaagcccctgctgggcacagctgctgccaagatcctgagcaccatcgacagccagaggatggccctgaccctgcaccacgtggtgctgctgcaggccgaccctgtggtgaagaacccccccaacaacctgtggatcatcgctgctgtgctggcccccatcgctgtggtgaccgtcatcatcatcatcatcacagctgtgctgtgcaggaagaacaagaatgacttcaagccagacaccatgatcaacctgccccagagggccaagcctgtgcagggctttgattatgccaagcagcacctgggccagcagggcgcagatgaggaggtgattcctgtgacccaggagaccgtggtgctgcccctgcccatcagagatgccccccaggagagagatgtggcccaggacggcagcaccatcaagacagccaagagcacagagaccaggaagagccgcagccccagtgaaaatggatctgtcatcagcaatgaaagtggcaagcccagcagcggccgccgcagcccccagaatgtgatggcccagcagaaggtgaccaaggaggaggccaggaagagaaatgtgcctgccagtgatgaggaggagggcgctgtgctgtttgacaacagcagcaaggtggccgctgagccctttgacaccagcagcggctctgtgcagctgattgccatcaagcccacagccctgcccatggtgccccccaccagtgacaggagccaggagagcagcgctgtgctgaatggagaggtgaacaaggccctgaagcagaagagtgacatcgagcactacagaaacaagctgcggctgaaggccaagaggaagggctactatgacttccctgctgtggagaccagcaagggcctgacagagaggaagaagatgtatgagaaggcccccaaggagatggagcacgtgctggaccctgattctgagctgtgtgcccccttcacagagagcaagaaccggcagcagatgaagaacagcgtgtaccgcagccggcagagcctgaacagccccagccctggagaaacagagatggacctgctggtgacccgggagcggccccggcggggcatcagaaattctggctatgacacagagcctgagatcatcgaggagaccaacatcgacagagtgcctgagccccggggctacagccgcagccggcaggtgaagggccacagcgagaccagcaccctgagcagccagcccagcattgatgaggtgcggcagcagatgcacatgctgctggaggaggccttcagcctggccagcgctggccacgccggccagagccgccaccaggaggcctacggcagcgcccagcacctgccctacagcgaggtggtgaccagcgcccctggcaccatgacccggcccagggctggggtgcagtgggtgcccacctacagacctgagatgtaccagtacagcctgcccaggcctgcctaccgcttcagccagctgcctgagatggtgatgggcagccccccacctcctgtgccccccaggacaggccctgtggccgtggccagcctgcggcgcagcaccagtgacatcggcagcaagaccaggatggccgagagcactggacctgagcccgcccagctgcatgattctgccagcttcacccagatgagccggggccctgtgtctgtgacccagctggaccagagcgccctgaactacagcggcaacacagtgcctgctgtgtttgccatcccagctgccaacagacctggcttcaccggctacttcatccccaccccacccagcagctacagaaaccaggcctggatgtcctatgctggggagaatgagctgcccagccagtgggccgacagcgtgcccctgcccggctacatcgaggcctaccccaggagccgctacccccagagcagccccagccggctgccccggcagtacagccagcctgccaacctgcaccccagcctggagcaggccccagcccccagcacagctgccagccagcagagcctggccgagaatgaccccagtgatgcccccctgaccaacatcagcacagctgccctggtgaaggccatccgggaggaggtggccaagctggccaagaagcagacagacatgtttgagttccaggtgtag

SEQ ID NO: 147578 - DNA, 5067 bp, Artificial Sequence
  Description of Artificial Sequence: Synthetic coding sequence
atccctgagggcctgtctgctgagcacaccagcagcctggtgcccagcctgcacatcaccaccctgggccaggagcaggccatcctgagcggggctgtgcctgccagccccagcactggaacagctgacttccccagcatcctgaccttcctgcagcccacagaaaatcatgccagccccagccctgtgcctgagatgcccaccctgcctgctgagggcagtgatggcagccccccagccacccgggacctgctgctgagcagcaaggtgcccaacctgctgagcacctcctggaccttcccccgctggaagaaggacagcgtgacagccatcctgggcaagaatgaggaggccaacgtgaccatccccctgcaggccttccccaggaaggaggtgctgagcctgcacacagtgaatggatttgtgtctgacttcagcactggatctgtgagcagccccatcatcacagcccccaggaccaaccccctgcccagcggcccccccctgcccagcatcctgagcatccaggccacccagaccgtcttccccagcctgggcttcagcagcaccaagccagaggcctatgctgctgctgtggaccacagcggcctgcctgccagcgccagcaagcaggtgcgggccagccccagctccatggatgtgtatgacagcctgaccatcggggacatgaagaagccagccaccacagatgtgttctggagcagcctgtctgctgagaccggcagcctgagcacagagagcatcatcagcggcctgcagcagcagaccaactatgacctgaatggccacaccatcagcaccacctcctgggagacccacctggcccccacagccccacccaacggcctgaccagcgctgctgatgccatcaagagccaggacttcaaggacacagctggccacagcgtgacagctgagggcttcagcatccaggacctggtgctgggcaccagcattgagcagcctgtgcagcagagcgacatgaccatggtgggcagccacatcgacctgtggcccaccagcaacaacaaccacagccgggacttccagacagctgaggtggcctactacagccccaccaccaggcacagcgtgagccacccccagctgcagctgcccaaccagcctgcccaccccctgctgctgaccagccctggccccaccagcacaggcagcctgcaggagatgctgagtgatggaacagacaccggcagcgagatcagcagtgacatcaacagcagccctgagagaaatgccagcacccccttccagaacatcctgggctaccacagcgctgctgagagcagcatcagcacctctgtgttccccaggaccagcagccgggtgctgcgggccagccagcaccccaagaagtggacagctgacacagtgagcagcaaggtgcagcccacagctgctgctgctgtgaccctcttcctgaggaagagcagccccccagccctgtctgctgccctggtggccaagggcaccagcagcagccccctggccgtggccagcggccctgccaagagcagctccatgaccaccctggccaagaatgtgaccaacaaggccgccagcggccccaagaggaccccaggagctgtgcacacagccttccccttcacccccacctacatgtatgccaggacaggccacaccaccagcacccacacagctgccaggaagcacggccactgcctgtggcctgtggtgtacaacctgccccccaggaagccccaggccatgcacacaggcctgcccaaccccaccaacctggagatgccccgggccagcaccccccggcccctgactgtgacagctgccctgaccagcatcacagcctctgtgaaggccacccggctgccccccctgcgggcagaaaatacagatgctgtgctgcctgctgccagcgctgctgtggtgaccaccgggaagatggccagcaacctggagtgccagatgagcagcaagctgctggtgaagacagtgctcttcctgacccagaggagagtgcagatcagcgagagcctgaagttcagcatcgccaagggcctgacccaggccctgaggaaggccttccaccagaatgatgtgtctgcccacgtggacatcctggagtacagccacaacgtgacagtgggctactatgccaccaagggcaagctggtgtacctgcctgctgtggtgattgagatgctgggcgtgtatggagtgtccaatgtgacagctgacctgaagcagcacaccccccacctgcagagcgtggccgtgctggccagcccctggaacccccagcctgctggctacttccagctgaagacagtgctgcagtttgtgtcccaggccgacaacatccagagctgcaagtttgcccagaccatggagcagaggctgcagaaggccttccaggatgctgagaggaaggtgctgaacaccaagagcaacctgaccatccagatcgtgtccaccagcaatgccagccaggccgtgaccctggtgtatgtggtgggcaaccagagcaccttcctgaatggcaccgtggccagcagcctgctgagccagctgtctgctgagctggtgggcttctacctgacctacccacccctgaccatcgccgagcccctggagtaccccaacctggacatcagcgagaccacccgggactactgggtgatcaccgtgctgcagggcgtggacaacagcctggtgggcctgcacaaccagagctttgcccgggtgatggagcagaggctggcccagctgttcatgatgagccagcagcagggccgccgcttcaagagggccaccaccctgggcagctacacagtgcagatggtgaagatgcagagggtgcccggccccaaggaccctgctgagctgacctactacaccctgtacaacgggaagcccctgctgggcacagctgctgccaagatcctgagcaccatcgacagccagaggatggccctgaccctgcaccacgtggtgctgctgcaggccgaccctgtggtgaagaacccccccaacaacctgtggatcatcgctgctgtgctggcccccatcgctgtggtgaccgtcatcatcatcatcatcacagctgtgctgtgcaggaagaacaagaatgacttcaagccagacaccatgatcaacctgccccagagggccaagcctgtgcagggctttgattatgccaagcagcacctgggccagcagggcgcagatgaggaggtgattcctgtgacccaggagaccgtggtgctgcccctgcccatcagagatgccccccaggagagagatgtggcccaggacggcagcaccatcaagacagccaagagcacagagaccaggaagagccgcagccccagtgaaaatggcagcgtcatcagcaatgaaagtggcaagcccagcagtggaagaagaagcccccagaatgtgatggcccagcagaaggtgaccaaggaggaggccaggaagagaaatgtgcctgccagtgatgaggaggagggcgctgtgctgtttgacaacagcagcaaggtggccgctgagccctttgacaccagcagcggctctgtgcagctgattgccatcaagcccacagccctgcccatggtgccccccaccagtgacaggagccaggagagcagcgctgtgctgaatggagaggtgaacaaggccctgaagcagaagagtgacatcgagcactacagaaacaagctgcggctgaaggccaagaggaagggctactatgacttccctgctgtggagaccagcaagggcctgacagagaggaagaagatgtatgagaaggcccccaaggagatggagcacgtgctggaccctgacagcgagctgtgtgcccccttcacagagagcaagaaccggcagcagatgaagaacagcgtgtaccgcagccggcagagcctgaacagccccagccctggagaaacagagatggacctgctggtgacccgggagcggccccggcggggcatccggaacagcggctatgacacagagcctgagatcatcgaggagaccaacatcgacagagtgcctgagccccggggctacagccgcagccggcaggtgaagggccacagcgagaccagcaccctgagcagccagcccagcattgatgaggtgcggcagcagatgcacatgctgctggaggaggccttcagcctggccagcgctggccatgctggccagagccgccaccaggaggcctacggcagcgcccagcacctgccctacagcgaggtggtgaccagcgcccctggcaccatgacccggccccgggccggcgtgcagtgggtgcccacctacagacctgagatgtaccagtacagcctgcccaggcctgcctaccgcttcagccagctgcctgagatggtgatgggcagccccccacctcctgtgccccccaggactggacctgtggccgtggccagcctgcggcgcagcaccagtgacatcggcagcaagaccaggatggccgagagcacaggccctgagcccgcccagctgcatgacagcgccagcttcacccagatgagccggggccctgtgtctgtgacccagctggaccagagcgccctgaactacagcggcaacacagtgcctgctgtgtttgccatcccagctgccaaccggcccggcttcaccggctacttcatccccaccccacccagcagctacagaaaccaggcctggatgtcctatgctggagaaaatgagctgcccagccagtgggccgacagcgtgcccctgcccggctacatcgaggcctaccccaggagccgctacccccagagcagccccagccggctgccccggcagtacagccagcctgccaacctgcaccccagcctggagcaggccccagcccccagcacagctgccagccagcagagcctggctgaaaatgaccccagtgatgcccccctgaccaacatcagcacagctgccctggtgaaggccatccgggaggaggtggccaagctggccaagaagcagacagacatgtttgagttccaggtgtag

SEQ ID NO: 147579 - DNA, 783 bp, Artificial Sequence
  Description of Artificial Sequence: Synthetic coding sequence
atgatggacccctgcagcgtgggcgtgcagctgcggaccaccaatgaatgccacaagacctactacaccaggcacacaggcttcaagaccctgcaggagctgagcagcaatgacatgctgctgctgcagctgaggacaggcatgaccctgagcggcaacaacaccatctgcttccaccacgtgaagatctacatcgacagatttgaggacctgcagaagagctgctgtgaccccttcaacatccacaagaagctggccaagaagaacctgcacgtgattgacctggatgatgccaccttcctgagcgccaagtttggccggcagctggtgcccggctggaagctgtgccccaagtgcacccagatcatcaatggatctgtggatgtggacacagaggaccggcagaagaggaagccagagagtgatggccgcacagccaaggccctgcggagcctgcagttcaccaaccctggccggcagacagaatttgcccctgagaccgggaagcgggagaagaggcggctgaccaagaatgccacagctggcagtgaccggcaggtgatcccagccaagagcaaggtgtatgacagccagggcctgctgatcttcagcggcatggacctgtgtgactgcctggatgaggactgcctgggctgcttctacgcctgcccagcctgtggcagcaccaagtgtggggctgagtgccgctgtgacaggaagtggctgtatgagcagatcgagattgagggcggggagatcatccacaacaagcatgctggatag

SEQ ID NO: 147580 - DNA, 507 bp, Artificial Sequence
  Description of Artificial Sequence: Synthetic coding sequence
atgatggacccctgcagcgtgggcgtgcagctgcggaccaccaatgaatgccacaagacctactacaccaggcacacaggcttcaagaccctgcaggagctgagcagcaatgacatgctgctgctgcagctgaggacaggcatgaccctgagcggcaacaacaccatctgcttccaccacgtgaagatctacatcgacagatttgaggacctgcagaagagctgctgtgaccccttcaacatccacaagaagctggccaagaagaacctgcacgtgattgacctggatgatgccaccttcctgagcgccaagtttggccggcagctggtgcccggctggaagctgtgccccaagtgcacccagatcatcaatggatctgtggatgtggacacagaggaccggcagaagaggaagccagagagtgatggccgcacagccaaggccctgcggagcctgcagttcaccaaccctggccggcagacagaatttgcccctgagactggatag

SEQ ID NO: 147581 - DNA, 180 bp, Artificial Sequence
  Description of Artificial Sequence: Synthetic coding sequence
atgaggcagctgaagggcaagcccaagaaggagaccagcaaggacaagaaggagaggaagcaggccatgcaggaggcccggcagcagatcaccaccgtggtgctgcccaccctggccgtggtggtgctgctgattgtggtgtttgtgtatgtggccacccggcccaccatcacagaatag

SEQ ID NO: 147582 - DNA, 180 bp, Artificial Sequence; identical to SEQ ID NO: 147581
  Description of Artificial Sequence: Synthetic coding sequence

SEQ ID NO: 147583 - DNA, 144 bp, Artificial Sequence
  Description of Artificial Sequence: Synthetic coding sequence
atgaggcagctgaagggcaagcccaagaaggagaccagcaaggacaagaaggagaggaagcaggccatgcaggaggcccggcagcagatcaccaccgtggtgctgcccaccctggccgtggtggtgctgctgattgtggtgtag

SEQ ID NO: 147584 - DNA, 180 bp, Artificial Sequence; identical to SEQ ID NO: 147581
  Description of Artificial Sequence: Synthetic coding sequence

SEQ ID NO: 147585 - DNA, 159 bp, Artificial Sequence
  Description of Artificial Sequence: Synthetic coding sequence
atgaggcagctgaagggcaagcccaagaaggagaccagcaaggacaagaaggagaggaagcaggccatgcaggaggcccggcagcagatcaccaccgtggtgctgcccaccctggccgtggtggtgctgctgattgtggtgtttgtgtatgtggcctag

SEQ ID NO: 147586 - DNA, 3336 bp, Artificial Sequence
  Description of Artificial Sequence: Synthetic coding sequence
atgcactggctgcctgctggccatgacatcaatggagccctggagcccagcaacatcgacaccagcatcctggaggagtacatcagcaaagaagatgccagtgacctgtgcttcccagacatcagcgccccagccagcagcgccagctacagccacggccagcctgccatgcctggcagcagtggagtgcaccacctgagccccccaggcggcggccccagccctggccgccacggccccctgcccccacctggctacggcacccccctgaactgcaacaacaacaacggcatgggcgccgcccccaagcccttccctgggggcactggaccacccatcaaggccgagcccaaggccccctatgcccctggcaccctgcctgacagccccccagattctggcagcgaggcctacagcccccagcaggtgaatgagccccacctgctgcggaccatcaccccagagaccctgtgccacgtgggcgtgcccagccggctggagcaccccccacctcctccagcccacctgcccggccccccacctcctcctcctcctccaccccactaccctgtgctgcagagggacctgtacatgaaggccgagccccccatcccccactacgccgccatgggccagggcctggtgcccacagacctgcaccacacccagcagagccagatgctgcaccagctgctgcagcagcacggggctgagctgcccacccaccccagcaagaagaggaagcacagcgagagcccccccagcaccctgaatgcccagatgctgaatggcatgatcaagcaggagcccggcaccgtgacagccctgcccctgcaccccacccgggcccccagccccccctggccaccccagggccccctgagccctggccctggcagcctgcccctgagcatcgcccgggtgcagaccccaccctggcaccccccaggggcccccagccctggcctgctgcaggacagcgacagcctgagcggcagctacctggaccccaactaccagagcatcaagtggcagccccaccagcagaacaagtgggccaccctgtatgatgccaactacaaggagctgcccatgctgacctacagagtggatgctgacaagggcttcaacttctctgtgggagatgatgcctttgtgtgccagaagaagaaccacttccaggtgacagtgtacatcggcatgctgggggagcccaagtatgtgaagaccccagagggcctgaagcccctggactgcttctacctgaagctgcatggagtgaagctggaggccctgaaccagagcatcaacatcgagcagagccagagcgacaggagcaagaggcccttcaaccctgtgacagtgaacctgcccccagagcaggtgaccaaggtgacagtgggccgcctgcacttcagcgagaccacagccaacaacatgaggaagaagggcaagcccaacccagaccagcgctacttcatgctggtggtggccctgcaggcccacgcccagaaccagaactacaccctggccgcccagatcagcgagcgcatcatcgtgcgggccagcaaccctggccagtttgaaagtgacagtgatgtgctgtggcagagggcccaggtgcctgacaccgtcttccaccacggccgggtgggcatcaacacagacagaccagatgaggccctggtggtgcatggaaatgtgaaggtgatgggcagcctgatgcaccccagcgacctgcgggccaaggagcacgtgcaggaggtggacaccacagagcagctgaagaggatcagcaggatgaggctggtgcactaccgctacaagccagagtttgctgccagcgctggcatcgaggccacagcccctgagactggagtcatcgcccaggaggtgaaggagatcctgcctgaggccgtgaaggacacaggagacatggtgtttgccaacgggaagaccatcgagaacttcctggtggtgaacaaggagcgcatcttcatggagaatgtgggcgctgtgaaggagctgtgcaagctgacagacaacctggagaccagaattgatgagctggagcgctggagccacaagctggccaagctgcggcggctggacagcctgaagagcacaggcagcagcggggccttcagccacgccggcagccagttcagcagagctggctctgtgccccacaagaagaggcctcccaaggtggccagcaagagcagctctgtggtgcctgaccaggcctgcatcagccagcgcttcctgcagggcaccatcatcgccctggtggtggtgatggccttctctgtggtgtccatgagcaccctgtatgtgctgagcctgaggacagaggaggacctggtggacacagatggccgcagcagccagagctttggcaccacccagctgcggcagagccccctgaccaccggcctgcccggcatccagcccagcctgctgctggtgaccaccagcctgaccagcagcgcccctggcagcgctgtgaggaccctggacatgtgcagcagccacccctgccctgtgatctgctgcagcagccccaccaccaaccccaccaccggccccagcctgggccccagcttcaaccctggccacgtgctgagccccagccccagccccagcaccaacagaagtggccccagccagatggccctgctgcctgtgaccaacatccgggccaagtcctggggcctgtctgtgaatggaattggccacagcaagcaccacaagagcctggagcccctggccagccctgctgtgcccttccctgggggccagggcaaggccaagaacagccccagcctgggcttccacggccgggcccggcggggggccctgcagagctctgtgggccctgctgagcccacctgggcccagggccagagcgagcctgtgcccagcctgaccagcatccaggtgctggagaacagcatgagcatcaccagccagtactgtgcccctggagatgcctgcaggcctggcaacttcacctaccacatccctgtgagcagcggcacccccctgcacctgagcctgaccctgcagatgaacagcagcagccctgtgtctgtggtgctgtgcagcctgcggagcaaggaggagccctgtgaggagggcagcctgccccagagcctgcacacccaccaggacacccagggcaccagccaccgctggcccatcaccatcctgtccttccgggagttcacctaccacttccgggtggccctgctgggccaggccaactgcagcagcgaggccctggcccagcctgccacagactaccacttccacttctaccgcctgtgtgactag

SEQ ID NO: 147587 - DNA, 3456 bp, Artificial Sequence
  Description of Artificial Sequence: Synthetic coding sequence
atggaggtggtggatgaaacagaggccctgcagcgcttctttgagggccatgacatcaacggggccctggagcccagcaacatcgacaccagcatcctggaggagtacatcagcaaggaggatgccagtgacctgtgcttcccagacatcagcgccccagccagcagcgccagctacagccacggccagcctgccatgcctggcagcagcggcgtgcaccacctgagccccccaggcggcggccccagccctggaagacatggccccctgcccccacctggctacggcacccccctgaactgcaacaacaacaacggcatgggcgccgcccccaagcccttccctgggggcaccggcccccccatcaaggccgagcccaaggccccctatgcccctggcaccctgcctgacagccccccagacagcggcagcgaggcctacagcccccagcaggtgaatgagccccacctgctgcggaccatcaccccagagaccctgtgccacgtgggcgtgcccagccggctggagcaccccccacctcctccagcccacctgcccggccccccacctcctcctcctcctccaccccactaccctgtgctgcagagggacctgtacatgaaggccgagccccccatcccccactatgctgccatgggccagggcctggtgcccacagacctgcaccacacccagcagagccagatgctgcaccagctgctgcagcagcacggggctgagctgcccacccaccccagcaagaagaggaagcacagcgagagcccccccagcaccctgaatgcccagatgctgaatggcatgatcaagcaggagcccggcaccgtgacagccctgcccctgcaccccacccgggcccccagccccccctggccaccccagggccccctgagccctggccctggcagcctgcccctgagcatcgcccgggtgcagaccccaccctggcaccccccaggggcccccagccctggcctgctgcaggacagcgacagcctgagcggcagctacctggaccccaactaccagagcatcaagtggcagccccaccagcagaacaagtgggccaccctgtatgatgccaactacaaggagctgcccatgctgacctacagagtggatgctgacaagggcttcaacttctctgtgggagatgatgcctttgtgtgccagaagaagaaccacttccaggtgacagtgtacatcggcatgctgggggagcccaagtatgtgaagaccccagagggcctgaagcccctggactgcttctacctgaagctgcacggcgtgaagctggaggccctgaaccagagcatcaacatcgagcagagccagagcgacaggagcaagaggcccttcaaccctgtgacagtgaacctgcccccagagcaggtgaccaaggtgacagtgggccgcctgcacttcagcgagaccacagccaacaacatgaggaagaagggcaagcccaacccagaccagcgctacttcatgctggtggtggccctgcaggcccacgcccagaaccagaactacaccctggccgcccagatcagcgagcgcatcatcgtgcgggccagcaaccctggccagtttgaaagtgacagtgatgtgctgtggcagagggcccaggtgcctgacacagtgttccaccacggccgggtgggcatcaacacagacagaccagatgaggccctggtggtgcacggcaatgtgaaggtgatgggcagcctgatgcaccccagcgacctgcgggccaaggagcacgtgcaggaggtggacaccacagagcagctgaagaggatcagcaggatgaggctggtgcactaccgctacaagccagagtttgctgccagcgctggcatcgaggccacagcccctgagaccggggtgattgcccaggaggtgaaggagatcctgcctgaggccgtgaaggacaccggggacatggtgtttgccaacgggaagaccatcgagaacttcctggtggtgaacaaggagcgcatcttcatggagaatgtgggcgctgtgaaggagctgtgcaagctgacagacaacctggagaccagaattgatgagctggagcgctggagccacaagctggccaagctgcggcggctggacagcctgaagagcacaggcagcagcggggccttcagccatgctggcagccagttcagccgggccggctctgtgccccacaagaagaggcctcccaaggtggccagcaagagcagctctgtggtgcctgaccaggcctgcatcagccagcgcttcctgcagggcaccatcatcgccctggtggtggtgatggccttctctgtggtgtccatgagcaccctgtatgtgctgagcctgaggacagaggaggacctggtggacacagatggcagctttgctgtgtccaccagctgcctgctggccctgctgcggccccagcccccaggcggcagcgaggccctgtgcccctggagcagccagagctttggcaccacccagctgcggcagagccccctgaccaccggcctgcccggcatccagcccagcctgctgctggtgaccaccagcctgaccagcagcgcccctggcagcgctgtgaggaccctggacatgtgcagcagccacccctgccctgtgatctgctgcagcagccccaccaccaaccccaccaccggccccagcctgggccccagcttcaaccctggccacgtgctgagccccagccccagccccagcaccaacagaagtggccccagccagatggccctgctgcctgtgaccaacatccgggccaagtcctggggcctgtctgtgaatggcatcggccacagcaagcaccacaagagcctggagcccctggccagccctgctgtgcccttccctgggggccagggcaaggccaagaacagccccagcctgggcttccacggccgggccaggagaggagccctgcagagctctgtgggccctgctgagcccacctgggcccagggccagagcgccagcctgctggccgagcctgtgcccagcctgaccagcatccaggtgctggagaacagcatgagcatcaccagccagtactgtgcccctggagatgcctgcaggcctggcaacttcacctaccacatccctgtgagcagcggcacccccctgcacctgagcctgaccctgcagatgaacagcagcagccctgtgtctgtggtgctgtgcagcctgcggagcaaggaggagccctgtgaggagggcagcctgccccagagcctgcacacccaccaggacacccagggcaccagccaccgctggcccatcaccatcctgtccttccgggagttcacctaccacttccgggtggccctgctgggccaggccaactgcagcagcgaggccctggcccagcctgccacagactaccacttccacttctaccgcctgtgtgactag

SEQ ID NO: 147588 - DNA, 1449 bp, Artificial Sequence
  Description of Artificial Sequence: Synthetic coding sequence
atgctgacctacagagtggatgctgacaagggcttcaacttctctgtgggagatgatgcctttgtgtgccagaagaagaaccacttccaggtgacagtgtacatcggcatgctgggggagcccaagtatgtgaagaccccagagggcctgaagcccctggactgcttctacctgaagctgcacggcctggaggccctgaaccagagcatcaacatcgagcagagccagagcgacaggagcaagaggcccttcaaccctgtgacagtgaacctgcccccagagcaggtgaccaaggtgacagtgggccgcctgcacttcagcgagaccacagccaacaacatgaggaagaagggcaagcccaacccagaccagcgctacttcatgctggtggtggccctgcaggcccacgcccagaaccagaactacaccctggccgcccagatcagcgagcgcatcatcgtgcgggccagcaaccctggccagtttgaaagtgacagtgatgtgctgtggcagagggcccaggtgcctgacaccgtcttccaccacggccgggtgggcatcaacacagacagaccagatgaggccctggtggtgcatggaaatgtgaaggtgatgggcagcctgatgcaccccagcgacctgcgggccaaggagcacgtgcaggaggtggacaccacagagcagctgaagaggatcagcaggatgaggctggtgcactaccgctacaagccagagtttgctgccagcgctggcatcgaggccacagcccctgagactggagtcatcgcccaggaggtgaaggagatcctgcctgaggccgtgaaggacacaggagacatggtgtttgccaacgggaagaccatcgagaacttcctggtggtgaacaaggtgtgtggcctgaagtatgtggtgtactgtgaagatgatgtgtgccacctgcctgtgctgagcctgggcgccaaggaggcctgggccgtgaaggagctgtgcaagctgacagacaacctggagaccagaattgatgagctggagcgctggagccacaagctggccaagctgcggcggctggacagcctgaagagcacaggcagcagcggggccttcagccatgctggcagccagttcagccgggccggctctgtgccccacaagaagaggcctcccaaggtggccagcaaggtgggcagcagctctgtggtgcctgaccaggcctgcatcagccagcgcttcctgcagggcaccatcatcgccctggtggtggtgatggccttccgccaccacctgggcgcccagccccaggagcagggcccccagccctgcccccgggagcgggccctggatggcggcagcagcagcaatggccaccccttcctgtggctgcagaggggcgtgcacgtgcacacagtgcgggcagagcccgcccacagaggaggccctggccgccactag

SEQ ID NO: 147589 - DNA, 789 bp, Artificial Sequence
  Description of Artificial Sequence: Synthetic coding sequence
atggccgcccccagcggcaccgtgtctgattctgagagcagcaacagcagcagtgatgctgaggagctggagcgctgccgggaggccgccatgcctgcctggggcctggagcagaggcctcatgtggccggcaagccccgggccggggccgccaacagccagctgagcaccagccagcccagcctgcggcacaaggtgaatgaacatgagcaggatggaaatgagctgcagaccaccccagagttccgggcccacgtggccaagaagctgggcgccctgctggacagcttcatcaccatcagcgaggccgccaaggagcccgccaaggccaaggtgcagaaggtggccctggaggatgatggcttccgcctcttcttcacctctgtgcctgggggccgggagaaggaggagagcccccagcccaggaggaagaggcagcccagcagcagcagcgaggacagtgatgaggagtggaggcgctgccgggaggccgctgtgtctgccagtgacatcctgcaggagagcgccatccacagccctggcaccgtggagaaggaggccaagaagaagaggaagctgaagaagaaggccaagaaggtggcctctgtggacagcgctgtggccgccaccacccccacctccatggccaccgtgcagaagcagaagtctggagagctgaatggagaccaggtgtccctgggcaccaagaagaagaagaaggccaagaaggccagcgagaccagccccttccccccagccaagagcgccacagccatcccagccaactag

SEQ ID NO: 147590 - DNA, 666 bp, Artificial Sequence
  Description of Artificial Sequence: Synthetic coding sequence
atgttctgccagaaccctggggccgccaacagccagctgagcaccagccagcccagcctgcggcacaaggtgaatgaacatgagcaggatggaaatgagctgcagaccaccccagagttccgggcccacgtggccaagaagctgggcgccctgctggacagcttcatcaccatcagcgaggccgccaaggagcccgccaaggccaaggtgcagaaggtggccctggaggatgatggcttccgcctcttcttcacctctgtgcctgggggccgggagaaggaggagagcccccagcccaggaggaagaggcagcccagcagcagcagcagtgaagattctgatgaggagtggaggcgctgccgggaggccgctgtgtctgccagtgacatcctgcaggagagcgccatccacagccctggcaccgtggagaaggaggccaagaagaagaggaagctgaagaagaaggccaagaaggtggcctctgtggacagcgctgtggccgccaccacccccacctccatggccaccgtgcagaagcagaagagcggggagctgaatggagaccaggtgtccctgggcaccaagaagaagaagaaggccaagaaggccagcgagaccagccccttccccccagccaagagcgccacagccatcccagccaactag

SEQ ID NO: 147591 - DNA, 699 bp, Artificial Sequence
  Description of Artificial Sequence: Synthetic coding sequence
atgcctgcctggggcctggagcagaggcctcatgtggccggcaagccccgggccggggccgccaacagccagctgagcaccagccagcccagcctgcggcacaaggtgaatgaacatgagcaggatggaaatgagctgcagaccaccccagagttccgggcccacgtggccaagaagctgggcgccctgctggacagcttcatcaccatcagcgaggccgccaaggagcccgccaaggccaaggtgcagaaggtggccctggaggatgatggcttccgcctcttcttcacctctgtgcctgggggccgggagaaggaggagagcccccagcccaggaggaagaggcagcccagcagcagcagcgaggacagtgatgaggagtggaggcgctgccgggaggccgctgtgtctgccagtgacatcctgcaggagagcgccatccacagccctggcaccgtggagaaggaggccaagaagaagaggaagctgaagaagaaggccaagaaggtggcctctgtggacagcgctgtggccgccaccacccccacctccatggccaccgtgcagaagcagaagtctggagagctgaatggagaccaggtgtccctgggcaccaagaagaagaagaaggccaagaaggccagcgagaccagccccttccccccagccaagagcgccacagccatcccagccaactag

SEQ ID NO: 147592 - DNA, 1497 bp, Artificial Sequence
  Description of Artificial Sequence: Synthetic coding sequence
atggatgtgacagaccactatgaagatgtgaggaagatctatgatgacttcctgaagaacagcaacatgctggacctgattgatgtgtaccagaagtgccgggccctgaccagcaactgtgagaactacaacacagtgagccccagccagctgctggacttcctgagcggcaagcagtatgctgtgggagatgaaacagacctgagcatccccaccagccccaccagcaagtacaacagagacaatgagaaggtgcagctgctggccaggaagatcatcttctcctacctgaacctgctggtgaacagcaagaatgacctggccgtggcctacatcctgaacatcccagaccggggcctgggccgggaggccttcacagacctgaagcatgctgcccgggagaagcagatgagcatcttcctggtggccaccagcttcatccgcaccatcgagctgggcggcaagggctacgcccccccacccagcgaccccctgcggacccacgtgaagggcctgagcaacttcatcaacttcatcgacaagctggatgagatcctgggggagatccccaaccccagcattgctgggggccagatcctgagcgtcatcaagatgcagctgatcaagggccagaacagccgggaccccttctgcaaggccatcgaggaggtggcccaggacctggacctgcgcatcaagaacatcatcaacagccaggagggcgtggtggccctgagcaccacagacatcagccctgcccggcccaagagccacgccatcaaccacggcacagcctactgcggccgggacacagtgaaggccctgctggtgctgctggatgaggaggccgccaatgcccccaccaagaacaaggccgagctgctgtatgatgaggagaacaccatccaccaccacggcaccagcatcctgaccctcttccgcagccccacccaggtgaacaacagcatcaagcccctgcgggagcgcatctgtgtgtccatgcaggagaagaagatcaagatgaagcagaccctcatccgcagccagtttgcctgcacctacaaggatgactacatgatcagcaaggacaactggaacaacgtgaacctggccagcaagcccctgtgtgtgctgtacatggagaatgacctgtctgaaggagtgaaccccagcgtgggccgcagcaccatcggcaccagctttggaaatgtgcacctggacaggagcaagaatgagaaggtgtccaggaagagcaccagccagacaggcaacaagagcagcaagaggaagcaggtggacctggatggagagaacatcctgtgtgacaacagaaatgaaccaccccagcacaagaatgccaagatccccaagaagagcaatgacagccagaaccggctgtatggcaagctggccaaggtggccaagagcaacaagtgcacagccaaggacaagctgatcagcggccaggccaagctgacccagttcttccggctgtag

SEQ ID NO: 147593 - DNA, 1740 bp, Artificial Sequence
  Description of Artificial Sequence: Synthetic coding sequence
atggctgtgttcaaccagaagtctgtgtctgacatgatcaaggagttcaggaagaactggagggccctgtgcaacagcgagaggaccaccctgtgtggggctgacagcatgctgctggccctgcagctgtccatggccgagaacaacaagcagcacagcggggagttcaccgtgtccctgagtgatgtgctgctgacctggaagtacctgctgcacgagaagctgaacctgcctgtggagaacatggatgtgacagaccactatgaagatgtgaggaagatctatgatgacttcctgaagaacagcaacatgctggacctgattgatgtgtaccagaagtgccgggccctgaccagcaactgtgagaactacaacacagtgagccccagccagctgctggacttcctgagcggcaagcagtatgctgtgggagatgaaacagacctgagcatccccaccagccccaccagcaagtacaacagagacaatgagaaggtgcagctgctggccaggaagatcatcttctcctacctgaacctgctggtgaacagcaagaatgacctggccgtggcctacatcctgaacatcccagaccggggcctgggccgggaggccttcacagacctgaagcacgccgcccgggagaagcagatgagcatcttcctggtggccaccagcttcatccgcaccatcgagctgggcggcaagggctacgcccctcctccaagtgaccccctgcggacccacgtgaagggcctgagcaacttcatcaacttcatcgacaagctggatgagatcctgggggagatccccaaccccagcattgctgggggccagatcctgagcgtcatcaagatgcagctgatcaagggccagaacagccgggaccccttctgcaaggccatcgaggaggtggcccaggacctggacctgcgcatcaagaacatcatcaacagccaggagggcgtggtggccctgagcaccacagacatcagccctgcccggcccaagagccacgccatcaaccacggcacagcctactgcggccgggacacagtgaaggccctgctggtgctgctggatgaggaggccgccaatgcccccaccaagaacaaggccgagctgctgtatgatgaggagaacaccatccaccaccacggcaccagcatcctgaccctcttccgcagccccacccaggtgaacaacagcatcaagcccctgcgggagcgcatctgtgtgtccatgcaggagaagaagatcaagatgaagcagaccctcatccgcagccagtttgcctgcacctacaaggatgactacatgatcagcaaggacaactggaacaacgtgaacctggccagcaagcccctgtgtgtgctgtacatggagaatgacctgtctgagggcgtgaaccccagcgtgggccgcagcaccatcggcaccagctttggaaatgtgcacctggacaggagcaagaatgagaaggtgtccaggaagagcaccagccagacaggcaacaagagcagcaagaggaagcaggtggacctggatggagagaacatcctgtgtgacaacagaaatgagcccccccagcacaagaatgccaagatccccaagaagagcaatgacagccagaaccggctgtatggcaagctggccaaggtggccaagagcaacaagtgcacagccaaggacaagctgatcagcggccaggccaagctgacccagttcttccggctgtag
